US008614309B2

(12) United States Patent
Feinstein et al.

(10) Patent No.: US 8,614,309 B2
(45) Date of Patent: Dec. 24, 2013

(54) DOUBLE-STRANDED RNA DIRECTED TO CASP2 AND METHODS OF USE THEREOF

(75) Inventors: Elena Feinstein, Rehovot (IL); Huseyin Aygun, Frankfurt am Main (DE); Rami Skaliter, Nes Ziona (IL); Hagar Kalinski, Rishon-le-Zion (IL); Igor Mett, Rehovot (IL); James McSwiggen, Boulder, CO (US); Leonid Beigelman, San Mateo, CA (US)

(73) Assignee: Quark Pharmaceuticals, Inc., Fremont, CA (US)

( * ) Notice: Subject to any disclaimer, the term of this patent is extended or adjusted under 35 U.S.C. 154(b) by 0 days.

(21) Appl. No.: 12/733,998

(22) PCT Filed: Sep. 4, 2008

(86) PCT No.: PCT/IL2008/001197
§ 371 (c)(1),
(2), (4) Date: Jan. 18, 2011

(87) PCT Pub. No.: WO2009/044392
PCT Pub. Date: Apr. 9, 2009

(65) Prior Publication Data
US 2011/0112168 A1 May 12, 2011

Related U.S. Application Data

(60) Provisional application No. 60/997,576, filed on Oct. 3, 2007, provisional application No. 61/000,664, filed on Oct. 25, 2007, provisional application No. 61/003,535, filed on Nov. 15, 2007, provisional application No. 61/010,040, filed on Jan. 4, 2008, provisional application No. 61/128,519, filed on May 22, 2008, provisional application No. 61/134,638, filed on Jul. 10, 2008, provisional application No. 61/189,035, filed on Aug. 15, 2008.

(51) Int. Cl.
*C07H 21/04* (2006.01)
(52) U.S. Cl.
USPC ......... 536/24.5; 536/24.31; 536/24.1; 514/44
(58) Field of Classification Search
None
See application file for complete search history.

(56) References Cited

U.S. PATENT DOCUMENTS

| | | | |
|---|---|---|---|
| 5,753,789 A | 5/1998 | Chu et al. | |
| 5,874,277 A | 2/1999 | Shintani et al. | |
| 5,891,683 A | 4/1999 | Usman et al. | |
| 5,898,031 A | 4/1999 | Crooke | |
| 5,929,042 A | 7/1999 | Troy et al. | |
| 5,998,203 A | 12/1999 | Matulic-Adamic et al. | |
| 6,107,094 A | 8/2000 | Crooke | |
| 6,117,657 A | 9/2000 | Usman et al. | |
| 6,235,886 B1 | 5/2001 | Manoharan et al. | |
| 6,251,666 B1 | 6/2001 | Beigelman | |
| 6,268,490 B1 | 7/2001 | Imanishi et al. | |
| 6,506,559 B1 | 1/2003 | Fire | |
| 6,586,238 B1 | 7/2003 | Matulic-Adamic et al. | |
| 6,602,858 B2 | 8/2003 | Beigelman | |
| 7,056,704 B2 | 6/2006 | Tuschl et al. | |
| 7,078,196 B2 | 7/2006 | Tuschl et al. | |
| 7,335,765 B2 | 2/2008 | Kaneko et al. | |
| 7,452,987 B2 | 11/2008 | Giese et al. | |
| 7,629,456 B2 | 12/2009 | Lange et al. | |
| 7,812,002 B2 | 10/2010 | Feinstein | |
| 7,893,245 B2 | 2/2011 | Giese et al. | |
| 8,090,542 B2 | 1/2012 | Khvorova et al. | |
| 8,097,710 B2 | 1/2012 | Baulcombe et al. | |
| 2003/0027783 A1 | 2/2003 | Zernicka-Goetz et al. | |
| 2003/0108923 A1 | 6/2003 | Tuschl et al. | |
| 2004/0192626 A1 | 9/2004 | McSwiggen et al. | |
| 2004/0229266 A1 | 11/2004 | Tuschl et al. | |
| 2004/0265839 A1 | 12/2004 | Mello et al. | |
| 2005/0004064 A1 | 1/2005 | Tei et al. | |
| 2005/0020525 A1 | 1/2005 | McSwiggen et al. | |
| 2005/0037988 A1 | 2/2005 | Zamore et al. | |
| 2005/0080246 A1 | 4/2005 | Allerson et al. | |
| 2005/0181382 A1 | 8/2005 | Zamore et al. | |
| 2005/0223427 A1 | 10/2005 | Leake et al. | |
| 2005/0233342 A1 | 10/2005 | Manoharan et al. | |
| 2005/0255487 A1 | 11/2005 | Khvorova et al. | |
| 2006/0058266 A1 | 3/2006 | Manoharan et al. | |
| 2006/0069056 A1 | 3/2006 | Feinstein et al. | |

(Continued)

FOREIGN PATENT DOCUMENTS

EP 0540742 A1 5/1993
WO WO 99/14226 3/1999

(Continued)

OTHER PUBLICATIONS

International Search Report issued by the International Searching Authority (ISA/US) on Mar. 30, 2009 in connection with International Application No. PCT/IL08/01197.
Written Opinion issued by the International Searching Authority (ISA/US) on Mar. 30, 2009 in connection with International Application No. PCT/IL08/01197.
International Preliminary Report on Patentability issued by the International Searching Authority (ISA/US) on Apr. 7, 2010 in connection with International Application No. PCT/IL08/01197.

(Continued)

*Primary Examiner* — Kimberly Chong
(74) *Attorney, Agent, or Firm* — John P. White; Cooper & Dunham LLP

(57) ABSTRACT

The invention relates to siRNA compounds possessing novel sequences and structural motifs which down-regulate the expression of specific human genes. The invention also relates to pharmaceutical compositions comprising such compounds and a pharmaceutically acceptable carrier. The present invention also provides a method of treating and/or preventing the incidence or severity of various diseases or conditions associated with the genes and/or symptoms associated with such diseases or conditions comprising administering to a subject in need of treatment for such disease or condition and/or symptom the compound or the pharmaceutical composition in a therapeutically effective dose so as to thereby treat the subject.

34 Claims, 79 Drawing Sheets

(56) References Cited

U.S. PATENT DOCUMENTS

| | | | |
|---|---|---|---|
| 2006/0172965 A1 | 8/2006 | Shepard et al. |
| 2006/0217329 A1 | 9/2006 | Feinstein et al. |
| 2006/0241072 A1 | 10/2006 | Baker |
| 2007/0031844 A1 | 2/2007 | Khvorova et al. |
| 2007/0032441 A1 | 2/2007 | McSwiggen et al. |
| 2007/0039072 A1 | 2/2007 | Khvorova et al. |
| 2007/0185047 A1 | 8/2007 | Bhat et al. |
| 2008/0311051 A1 | 12/2008 | Chauvier et al. |
| 2009/0162365 A1 | 6/2009 | Feinstein et al. |

FOREIGN PATENT DOCUMENTS

| | | |
|---|---|---|
| WO | WO 00/44895 | 8/2000 |
| WO | WO 00/44914 | 8/2000 |
| WO | WO 01/68836 | 9/2001 |
| WO | WO 02/24720 | 3/2002 |
| WO | WO 02/055693 | 7/2002 |
| WO | WO 03/039523 | 5/2003 |
| WO | WO 03/064621 | 8/2003 |
| WO | WO 03/070918 | 8/2003 |
| WO | WO 03/074654 | 9/2003 |
| WO | WO 2004/103389 | 12/2004 |
| WO | WO 2005/013886 | 2/2005 |
| WO | WO 2005/110464 A3 | 11/2005 |
| WO | WO 2007/087451 | 8/2007 |
| WO | WO 2007/091269 A3 | 8/2007 |
| WO | WO 2009/044392 A2 | 4/2009 |

OTHER PUBLICATIONS

Amarzguioui et al., (2003) "Tolerance for Mutations and Chemical Modifications in a siRNA". Nucleic Acids Research, 31(2):589-95.
Barik, (2005) "Silence of the Transcripts; RNA Interference in Medicine". Mol. Med 2005, 83:764-773.
Bass, (2001) "The Short Answer". Nature 411:428-29.
Braasch et al., (2003) "RNA Interference in Mammalian Cells by Chemically-Modified RNA". Biochemistry, 42:7967-7975.
Caplen et al., (2001) "Specific Inhibition of Gene Expression by Small Double-Stranded RNAs in Invertebrate Vertebrate Systems". Proc. Natl. Acad. Sci., 98(17):9742-47.
Chakraborty, (2007) "Potentiality of Small Interfering RNAs-(siRNA) as Recent Therapeutic Targets for Gene-Silencing". Current Drug Targets, 8(3):469-82.
Chiu et al., (2002) "RNAi in Human Cells: Basic Structural and Functions Features of Small Interfering RNA". Molecular Cell, vol. 19, pp. 549-561.
Chiu et al., (2003) "siRNA Function in RNAi: a Chemical Modification Analysis". RNA, 9(9):1034-48.
Czauderna et al., (2003) "Structural Variations and Stabilising Modifications of Synthetic siRNAs in Mammalian Cells". Nucleic Acids Research, 31(11):2705-16.
Damha et al., (1991) "Oligonucleotides Containing Unnatural L-2'-deoxyribose". Tetrahedron Letters 32(23):2573-76.
Damha et al., (1994) "Antisense L/D-Oligodeoxynucleotide Chimeras: Nuclease Stability, Base-Pairing Properties, and Activity at Directing Ribonuclease H". Biochem 33:7877-7885.
Elbashir et al., (2001) "RNA Interference is Mediated by 21-and 22-nucleotide RNAs". Genes & Development, 15:188-200.
Elbashir et al., (2001) "Functional Anatomy of siRNAs for Mediating Efficient RNAi in Drosophila Melanogaster Embryo Lysate". EMBO Journal, 20 (23):6877-88.
Elbashir et al., (2001) "Duplexes of 21-nucleotide Mediated RNA Interference in Cultured Mammalian Cells". Nature, 411:494-498.
Elmen et al., (2005) "Locked nucleic acid (LNA) mediated improvements in siRNA stability and functionality". NAR, 33(1):439-47.
Fire et al., (1998) "Potent and Specific Genetic Interference by Double-Stranded RNA in Caenorhabditis Elegans". Nature, vol. 391:806-811.
Garbesi et al., (1993) "L-DNAs as Potential Antimessenger Oligonucleotides: A Reassessment". Nuc. Acids Res., 21(18)4159-65.

Holen et al., (2002) "Positional Effects of Short Interfering RNAs Targeting the Human Coagulation Trigger Tissue Factor". NAR, 30(8):1757-66.
Kawakimi et al., (2005) "Thermodynamic Analysis of Duplex Formation of Heterochiral DNA with L-deoxyadenosine". Analyt. Sci., Feb. 2005 (21):77-82.
Kim et al., (2007) "Superior Structure Stability and Selectivity of Hairpin Nucleic Acid Probes with an L-DNA Stem". Nuc. Acids Res., 35(21):7279-7287.
Mahato et al., (2005) "Modulation of Gene Expression by Antisense and Antigene Oligadeoxynucleotides and Small Interfering RNA". Expert Opinion on Drug Delivery, 2(1):3-28.
McManus et al., (2002) "Gene Silencing in Mammals by Small Interfering RNAs". Nature Reviews Genetics, 3:737-747.
Mucke, (2007) "New ocular therapeutics: A view from the patenting perspective". IDrugs 10(1):37-41.
Prakash et al., (2005) "Positional Effect of Chemical Modifications on Short Interference RNA Activity in Mammalian Cells". J. Med Chem., 48(13):4247-53.
Scherer and Rossi (2004) "Therapeutic Applications of RNA Interferences: Recent Advances in siRNA Design". Advances in Genetics, 22:1-21.
Singh et al., (2001) Cell-specific caspase expression by different neuronal phenotypes in transient retinal ischemia. J Neurochem. 77(2):466-75.
Sioud et al., (2004) "Potential Design Rules and Enzymatic Synthesis of siRNAs" Methods in Molec Biol., 252:457-468.
Tolentino et al., (2004) "Intravitreal injection of vascular endothelial growth factor small interfering RNA inhibits growth and leakage in a nonhuman primate, laser-induced model of choroidal neovascularization". Retina. 24(4) :660.
Ui-Tei et al., (2006) "Essential Notes Regarding the Design of Functional siRNAs for Efficient Mammalian RNAi". J Biomed Biotechnol, 2006:65052.
Ui-Tei et al., (2008) "DNA-modified siRNA-dependent Gene Silencing with Reduced Off-target Effect is Induced through a Pathway Parallel to that for siRNA-mediated RNA Interference". Proc 2008 Micro-NanoMechatronics and Human Science (MHS2008), 339-345.
Ui-Tei et al., (2008) "Functional Dissection of siRNA Sequence by Systematic DNA Substitution: Modified siRNA with a DNA Seed Arm is a Powerful Tool for Mammalian Gene Silencing with Significantly Reduced Off-target Effect". Nucleic Acids Research, 36(7):2136-51.
Urata et al., (1992) "Synthesis and Properties of Mirror-image DNA". Nucleic Acids Research 20(13)3325-3332.
Wang et al., (2005) Endotoxemic acute renal failure is attenuated in caspase-1-deficient mice AJP: Renal Physiology, 288(5) :F997-F1004.
Zamore et al., (2000) "RNAi: Double-Stranded RNA Directs the ATP-Dependent Cleavage of mRNA at 21 to 23 Nucleotide Intervals". Cell, 101:25-33.
International Search Report mailed Oct. 7, 2008 in connection with International Application PCT/IL2007/001278 (WO 2008/050329).
International Preliminary Report on Patentability issued Apr. 28, 2009 including Written Opinion mailed Oct. 7, 2008 in connection with International Patent Application PCT/IL2007/001278 (WO2008/050329).
International Search Report mailed Dec. 12, 2008 in connection with International Patent Application PCT/IL2008/000248 (WO 2007/091269).
International Preliminary Report on Patentability issued Jan. 19, 2010 including Written Opinion mailed Nov. 10, 2008 in connection with International Patent Application PCT/IL2008/000248 (WO 2008/104978).
International Search Report mailed Apr. 14, 2010 in connection with International Patent Application PCT/US2009/061570 (WO 2010/048352).
International Preliminary Report on Patentability issued Apr. 26, 2011 including Written Opinion in connection with International Patent Application PCT/US2009/061570 (WO 2010/048352).

(56) References Cited

OTHER PUBLICATIONS

Amendment filed Nov. 25, 2009 in response to Restriction Requirement issued Jul. 27, 2009 in connection with U.S. Appl. No. 11/978,089 (US 2009/0162365).
Non-final Office Action issued Jul. 26, 2010 in connection with U.S. Appl. No. 11/978,089 (US 2009/0162365).
Amendment filed Jan. 26, 2011 in response to Non-final Office Action issued Jul. 26, 2010 in connection with U.S. Appl. No. 11/978,089 (US 2009/0162365).
Final Office Action issued Mar. 14, 2011 in connection with U.S. Appl. No. 11/978,089 (US 2009/0162365).
Amendment filed Jan. 19, 2012 in response to Final Office Action issued Mar. 14, 2012 in connection with U.S. Appl. No 11/978,089 (US 2009/0162365).
Extended European Search Report and Opinion issued Jan. 9, 2011 in connection with EP 11170912.7 (Divisional application of EPO National Phase application of PCT/IL2007/001278).
Supplementary European Search Report and Opinion issued Dec. 6, 2011 in connection with EP 08808012.2 (EPO National Phase application of PCT/IL2008/001197).
Claims filed May 20, 2011 upon entry to EP National Phase of PCT/US2009/061570 (in claim 1, sense strand SEQ ID No. 9015 and antisense strand SEQ ID No. 9516, are identical to SEQ ID No. 140 and SEQ ID No. 139 respectively, in the instant application).
Rule 161/162 Communication issued Jun. 1, 2011 in connection with EP 09748890.2 (EPO National Phase application of PCT/US2009/061570).
Response filed Dec. 9, 2011 to the Rule 161/162 Communication issued Jun. 1, 2011 in connection with EP 09748890.2(EPO National Phase application of PCT/US2009/061570).
Examination Report issued Mar. 27, 2012 in connection with EP 09748890.2 (EPO National Phase application of PCT/US2009/061570).
English translation of First Office Action issued Sep. 1, 2011 in connection with CN 200880110087.0 (Chinese National Phase application of PCT/IL2008/001197).
English translation of response and claims filed Mar. 16, 2012 to First Office Action issued Sep. 1, 2011 in connection with CN 200880110087.0 (Chinese National Phase application of PCT/IL2008/001197).
English translation of voluntary claim amendment filed Sep. 1, 2011 with Request for Examination in connection with RU 2010113514 (Russian National Phase application of PCT/IL2008/001197).
English translation of Official Action issued Feb. 9, 2012 in connection with RU 2010113514 (Russian National Phase application of PCT/IL2008/001197).
Second preliminary amendment in response to notification of missing requirements under 35 U.S.C. §371, filed May 17, 2011 in connection with U.S. Appl. No. 13/062,161 (US 2011/0229557) (In claim 74, sense strand SEQ ID No. 9015 and antisense strand SEQ ID No. 9516, are identical to SEQ IDd No. 140 and SEQ ID No. 139 respectively in the instant application).
English Translation of Office Action dated Jul. 12, 2012, issued in connection with Chinese Application No. 200880110087.0.
Response to Supplementary European Search Report and Opinion, issued in connection with European Patent Application No. 088080122 on Dec. 6, 2011.
Claims filed with Response to Supplementary European Search Report and Opinion, issued in connection with European Patent Application No. 08808012.2 on Dec. 6, 2011.
Office Action issued on Nov. 20, 2012, in connection with European Patent Application No. 08808012.2.
Response to Extended European Search Report, issued in connection with European Patent Application No. 11170912.7 on Sep. 1, 2011.
Claims filed with Response to Extended European Search Report, issued in connection with European Patent Application No. 11170912.7 on Sep. 1, 2011.
Office Action issued Aug. 1, 2012, in connection with European Patent Application No. 11170912.7.
Office Action issued Jan. 8, 2013, in connection with U.S. Appl. No. 13/062,161.
Response to Office Action issued Jan. 8, 2013, in connection with U.S. Appl. No. 13/062,161.
English Translation of Response filed no earlier than Jun. 11, 2012, to Office Action issued on Feb. 9, 2012 in connection with Russian Patent Application No. 2010113514.
English Translation of Office Action issued on Jul. 27, 2012, in connection with Russian Patent Application No. 2010113514.
English Translation of Response filed no earlier than Sep. 23, 2012, to Office Action issued on Jul. 27, 2012 in connection with Russian Patent Application No. 2010113514.

Figure 1A

| # | | Sequence | SEQ ID |
|---|---|---|---|
| #1 | S1.<br>As1. | 5'-gaagaaaa555ccgcaaaa-3'<br>5'-u5uugcggaaauuuucuuc-3' | SEQ ID NO: 87179<br>SEQ ID NO: 87180 |
| #2 | S1.<br>As2. | 5'-gaagaaaa555ccgcaaaa-3'<br>5'-uuuugcggaaauuu57557-3' | SEQ ID NO: 87179<br>SEQ ID NO: 87180 |
| #3 | S1.<br>As3. | 5'-gaagaaaa555ccgcaaaa-3'<br>5'-55uugcggaaauuuucuuc-3' | SEQ ID NO: 87179<br>SEQ ID NO: 87180 |
| #4 | S2.<br>As1. | 5'-86686aaauuuccgcaaaa-3'<br>5'-u5uugcggaaauuuucuuc-3' | SEQ ID NO: 87179<br>SEQ ID NO: 87180 |
| #5 | S2.<br>As2. | 5'-86686aaauuuccgcaaaa-3'<br>5'-uuuugcggaaauuu57557-3' | SEQ ID NO: 87179<br>SEQ ID NO: 87180 |
| #6 | S2.<br>As3. | 5'-86686aaauuuccgcaaaa-3'<br>5'-55uugcggaaauuuucuuc-3' | SEQ ID NO: 87179<br>SEQ ID NO: 87180 |
| #7 | S3.<br>As1. | 5'-8668666655uccgcaaaa-3'<br>5'-u5uugcggaaauuuucuuc-3' | SEQ ID NO: 87179<br>SEQ ID NO: 87180 |
| #8 | S3.<br>As2. | 5'-8668666655uccgcaaaa-3'<br>5'-uuuugcggaaauuu57557-3' | SEQ ID NO: 87179<br>SEQ ID NO: 87180 |
| #9 | S3.<br>As3. | 5'-8668666655uccgcaaaa-3'<br>5'-55uugcggaaauuuucuuc-3' | SEQ ID NO: 87179<br>SEQ ID NO: 87180 |
| #10 | S4.<br>As1. | 5'-8668666655577gcaaaa-3'<br>5'-u5uugcggaaauuuucuuc-3' | SEQ ID NO: 87179<br>SEQ ID NO: 87180 |
| #11 | S4.<br>As2. | 5'-8668666655577gcaaaa-3'<br>5'-uuuugcggaaauuu57557-3' | SEQ ID NO: 87179<br>SEQ ID NO: 87180 |
| #12 | S4.<br>As3. | 5'-8668666655577gcaaaa-3'<br>5'-55uugcggaaauuuucuuc-3' | SEQ ID NO: 87179<br>SEQ ID NO: 87180 |

Figure 2

| Duplex # | Strand | Sequence (5' -> 3') | SEQ ID No. |
|---|---|---|---|
| 4 | SEN | 5' <u>GAAGAA</u>GAAAAUUUCCGCAAAAA 3' | SEQ ID NO: 87183 |
|  | AS | 5' U<u>U</u>UUUGCGGAAAUUUUCUUCUUC 3' | SEQ ID NO: 87184 |
| 5 | SEN | 5' <u>GAAGAA</u>GAAAAUUUCCGCAAAAA 3' | SEQ ID NO: 87183 |
|  | AS | 5' UUUUUGCGGAAAUUUUCUUCUUC 3' | SEQ ID NO: 87184 |
| 6 | SEN | 5' <u>GAAGA</u>AGAAAAUUUCCGCAAAAA 3' | SEQ ID NO: 87183 |
|  | AS | 5' <u>UU</u>UUUGCGGAAAUUUUCUUCUUC 3' | SEQ ID NO: 87184 |
| 8 | SEN | 5' <u>GAAGAAGAAA</u>AUUUCCGCAAAAA 3' | SEQ ID NO: 87183 |
|  | AS | 5' UUUUUGCGGAAAUUUUCUUCUUC 3' | SEQ ID NO: 87184 |
| 11 | SEN | 5' <u>GAAGAAGAAAUU</u>CCGCAAAAA 3' | SEQ ID NO: 87183 |
|  | AS | 5' UUUUUGCGGAAAUUUUCUUCUUC 3' | SEQ ID NO: 87184 |
| 2 | SEN | 5' GAAGAAGAAA<u>AUU</u>CCGCAAAAA 3' | SEQ ID NO: 87183 |
|  | AS | 5' UUUUUGCGGAAAUUUUCUUCUUC 3' | SEQ ID NO: 87184 |

Figure 3A

| | | | |
|---|---|---|---|
| 4+19 | Sense | 5'-CCUUGCACUCCUGAAUUUUAUCA-3' | SEQ ID NO: 267 |
| | AS | 5'-UGAUAAAAUUCAGGAGUGCAAGG-3' | SEQ ID NO: 268 |
| 3+19+1 | Sense | 5'-CUUGCACUCCUGAAUUUUAUCAA-3' | SEQ ID NO: 269 |
| | AS | 5'-UUGAUAAAAUUCAGGAGUGCAAG-3' | SEQ ID NO: 270 |
| 2+19+2 | Sense | 5'-UUGCACUCCUGAAUUUUAUCAAA-3' | SEQ ID NO: 271 |
| | AS | 5'-UUUGAUAAAAUUCAGGAGUGCAA-3' | SEQ ID NO: 272 |
| 1+19+3 | Sense | 5'-UGCACUCCUGAAUUUUAUCAAAC-3' | SEQ ID NO: 273 |
| | AS | 5'-GUUUGAUAAAAUUCAGGAGUGCA-3' | SEQ ID NO: 274 |
| 19+4 | Sense | 5'-GCACUCCUGAAUUUUAUCAAACA-3' | SEQ ID NO: 275 |
| | AS | 5'-UGUUUGAUAAAAUUCAGGAGUGC-3' | SEQ ID NO: 276 |

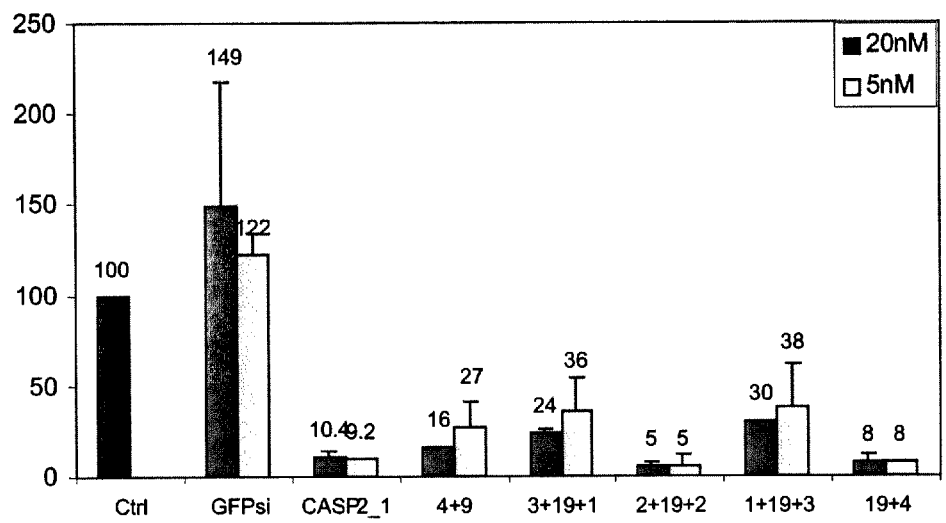

| 4+19 | Sense | 5'-CCUUGCACUCCUGAAUUUUAUCA -3' | SEQ ID NO: 267 |
|---|---|---|---|
| | AS | 5'-UGAUAAAAUUCAGGAGUGC AAGG-3' | SEQ ID NO: 268 |
| 3+19+1 | Sense | 5'-CUUGCACUCCUGAAUUUUAUCA A-3' | SEQ ID NO: 269 |
| | AS | 5'-UUGAUAAAAUUCAGGAGUGC AAG-3' | SEQ ID NO: 270 |
| 2+19+2 | Sense | 5'-UUGCACUCCUGAAUUUUAUCA AA-3' | SEQ ID NO: 271 |
| | AS | 5'-UUUGAUAAAAUUCAGGAGUGC AA-3' | SEQ ID NO: 272 |
| 1+19+3 | Sense | 5'-UGCACUCCUGAAUUUUAUCA AAC-3' | SEQ ID NO: 273 |
| | AS | 5'-GUUUGAUAAAAUUCAGGAGUGC A-3' | SEQ ID NO: 274 |
| 19+4 | Sense | 5'-GCACUCCUGAAUUUUAUCA AACA-3' | SEQ ID NO: 275 |
| | AS | 5'-UGUUUGAUAAAAUUCAGGAGUGC -3' | SEQ ID NO: 276 |

Figure 5B

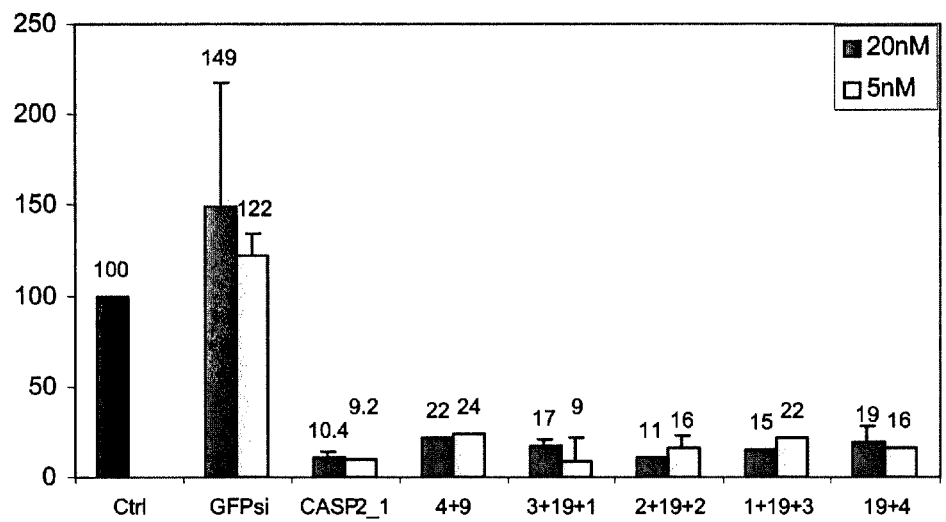

Figure 6A

|   | 5' ⟶ 3' | |
|---|---|---|
| #1 | 3prime1QM5-s  GAAGAAAAUUUCCGCA666-dT | SEQ ID NO: 87185 |
|    | 3prime1QM5-as UUUUGCGGAAAUUUUC557-dT | SEQ ID NO: 87186 |
| #2 | 3prime2QM5-s  866GAAAAUUUCCGCAAAA-dT | SEQ ID NO: 87185 |
|    | 3prime1QM5-as UUUUGCGGAAAUUUUC557-dT | SEQ ID NO: 87186 |
| #3 | 3prime3QM5-s  866GAAAAUUUCCGCA666-dT | SEQ ID NO: 87185 |
|    | 3prime1QM5-as UUUUGCGGAAAUUUUC557-dT | SEQ ID NO: 87186 |
| #4 | QM5-s 5' GAAGAAAAUUUCGCGCAAA 3' | SEQ ID NO: 87179 |
|    | 3prime1QM5-as UUUUGCGGAAAUUUUC557-dT | SEQ ID NO: 87186 |
| #5 | 3prime1QM5-s  GAAGAAAAUUUCCGCA666-dT | SEQ ID NO: 87185 |
|    | 3prime2QM5-as 555UGCGGAAAUUUUCUUC-dT | SEQ ID NO: 87186 |

|   | 5' ⟶ 3' | |
|---|---|---|
| #6 | 3prime2QM5-s  866GAAAAUUUCCGCAAAA-dT | SEQ ID NO: 87185 |
|    | 3prime2QM5-as 555UGCGGAAAUUUUCUUC-dT | SEQ ID NO: 87186 |
| #7 | 3prime3QM5-s  866GAAAAUUUCCGCA666-dT | SEQ ID NO: 87185 |
|    | 3prime2QM5-as 555UGCGGAAAUUUUCUUC-dT | SEQ ID NO: 87186 |
| #8 | QM5-s 5' GAAGAAAAUUUCGCGCAAA 3' | SEQ ID NO: 87179 |
|    | 3prime2QM5-as 555UGCGGAAAUUUUCUUC-dT | SEQ ID NO: 87186 |
| #9 | 3prime1QM5-s  GAAGAAAAUUUCCGCA666-dT | SEQ ID NO: 87185 |
|    | 3prime3QM5-as 555UGCGGAAAUUUUC557-dT | SEQ ID NO: 87186 |
| #10 | 3prime1QM5-s  GAAGAAAAUUUCCGCA666-dT | SEQ ID NO: 87185 |
|     | QM5-as 5' UUUUGCGGAAAUUUUCUUC 3' | SEQ ID NO: 87180 |

Figure 7A

| #1 | 1 CASP2_4 S/<br>1CASP2_4 AS | S-5'- GCCAGAAUGUGGAACUC*C*U*dT-3'<br>AS-5'- AGGAGUUCCACAUUCUG*G*C*dT-3' | SEQ ID NO: 87187<br>SEQ ID NO: 87188 |
|---|---|---|---|
| #2 | 2 CASP2_4 S/<br>1CASP2_4 AS | S-5'- G*C*C*AGAAUGUGGAACUCCUdT-3'<br>AS-5'- AGGAGUUCCACAUUCUG*G*C*dT-3' | SEQ ID NO: 87187<br>SEQ ID NO: 87188 |
| #3 | 1 CASP2_4 S/<br>1CASP2_4 AS<br>(BLUNT) | S-5'- GCCAGAAUGUGGAACUC*C*U*-3'<br>AS-5'- AGGAGUUCCACAUUCUG*G*C-3' | SEQ ID NO: 139<br>SEQ ID NO: 140 |
| #4 | 2 CASP2_4 S/<br>1CASP2_4 AS<br>(BLUNT) | S-5'- G*C*C*AGAAUGUGGAACUCCU-3'<br>AS-5'- AGGAGUUCCACAUUCUG*G*C-3' | SEQ ID NO: 139<br>SEQ ID NO: 140 |

Figure 7B

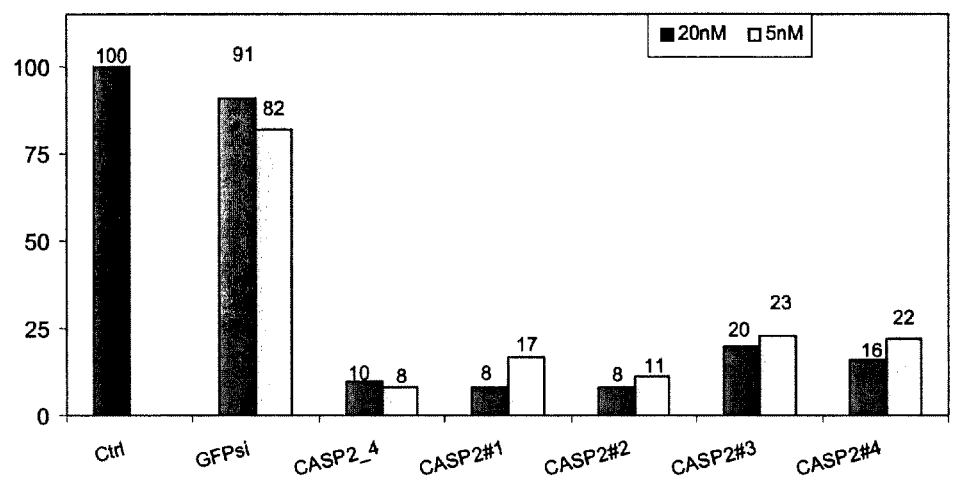

Figure 8A

| #1 | 1 DDIT4_2 S/<br>1 DDIT4_2 AS | S-5'- UACUGUAGCAUGAAACA*A*A*dT-3'<br>AS-5'- UUUGUUUCAUGCUACAG*U*A*dT-3' | SEQ ID NO: 87189<br>SEQ ID NO: 87190 |
|---|---|---|---|
| #2 | 2 DDIT4_2 S/<br>1 DDIT4_2 AS | S-5'- U*A*C*UGUAGCAUGAAACAAAdT-3'<br>AS-5'- UUUGUUUCAUGCUACAG*U*A*dT-3' | SEQ ID NO: 87189<br>SEQ ID NO: 87190 |
| #3 | 1 DDIT4_2 S/<br>1 DDIT4_2 AS<br>(BLUNT) | S-5'- UACUGUAGCAUGAAACA*A*A-3'<br>AS-5'- UUUGUUUCAUGCUACAG*U*A-3' | SEQ ID NO: 87191<br>SEQ ID NO: 87192 |
| #4 | 2 DDIT4_2 S/<br>1 DDIT4_2 AS<br>(BLUNT) | S-5'- U*A*C*UGUAGCAUGAAACAAA-3'<br>AS-5'- UUUGUUUCAUGCUACAG*U*A-3' | SEQ ID NO: 87191<br>SEQ ID NO: 87192 |

Figure 8B

| #1 | 1 QM5 S/<br>1 QM5 AS | S-5'- GAAGAAAAUUUCCGCAA*A*A*dT-3'<br>AS-5'- UUUUGCGGAAAUUUUCU*U*C*dT-3' | SEQ ID NO: 87185<br>SEQ ID NO: 87186 |
|---|---|---|---|
| #2 | 2 QM5 S/<br>1 QM5 AS | S-5'- G*A*A*GAAAAUUUCCGCAAAAdT-3'<br>AS-5'- UUUUGCGGAAAUUUUCU*U*C*dT-3' | SEQ ID NO: 87185<br>SEQ ID NO: 87186 |
| #3 | 1 QM5 S/<br>1 QM5 AS<br>(BLUNT) | S-5'- GAAGAAAAUUUCCGCAA*A*A-3'<br>AS-5'- UUUUGCGGAAAUUUUCU*U*C-3' | SEQ ID NO: 87179<br>SEQ ID NO: 87180 |
| #4 | 2 QM5 S/<br>1 QM5 AS<br>(BLUNT) | S-5'- G*A*A*GAAAAUUUCCGCAAAA-3'<br>AS-5'- UUUUGCGGAAAUUUUCU*U*C-3' | SEQ ID NO: 87179<br>SEQ ID NO: 87180 |

Figure 9A

| | | |
|---|---|---|
| #3-dT | S-5'-GAAGAAAAUUUCCGC AAAAdT-3' | SEQ ID NO: 87185 |
| | AS-5'-UUUUGCGGAAAUUUUCU *U*C*dT-3' | SEQ ID NO: 87186 |
| #3-Blunt | S-5'-GAAGAAAAUUUCCGC AAAA-3' | SEQ ID NO: 87179 |
| | AS-5'-UUUUGCGGAAAUUUUCU *U*C-3' | SEQ ID NO: 87180 |
| #4-dT | S-5'-GAAGAAAAU UUCCGCAA *A*A*dT-3' | SEQ ID NO: 87185 |
| | AS-5'-U<u>U</u>UUGCGGAAAUUUUCU *U*C*dT-3' | SEQ ID NO: 87186 |
| #4-Blunt | S-5'-GAAGAAAAU UUCCGCAA *A*A-3' | SEQ ID NO: 87179 |
| | AS-5'-U<u>U</u>UUGCGGAAAUUUUCU *U*C-3' | SEQ ID NO: 87180 |
| #5-dT | S-5'-GAAGAAAAU UUCCGCAA *A*A*dT-3' | SEQ ID NO: 87185 |
| | AS-5'-U<u>U</u>UUGCGGAAAUUUUCU *U*C*dT-3' | SEQ ID NO: 87186 |
| #5-Blunt | S-5'-GAAGAAAAU UUCCGCAA *A*A-3' | SEQ ID NO: 87179 |
| | AS-5'-U<u>U</u>UUGCGGAAAUUUUCU *U*C-3' | SEQ ID NO: 87180 |
| #6-dT | S-5'-G*A*A*GAAAAU UUCCGCAA *A*A*dT-3' | SEQ ID NO: 87185 |
| | AS-5'-UUUUGCGGAAAUUUUC UUCdT-3' | SEQ ID NO: 87186 |
| #6-Blunt | S-5'-G*A*A*GAAAAU UUCCGCAA *A*A-3' | SEQ ID NO: 87179 |
| | AS-5'-UUUUGCGGAAAUUUUC UUC-3' | SEQ ID NO: 87180 |
| #7-dT | S-5'-G*A*A*GAAAAUUUCCGCAA *A*A*dT-3' | SEQ ID NO: 87185 |
| | AS-5'-UUUUGCGGAAAUUUUC UUCdT-3' | SEQ ID NO: 87186 |
| #7-Blunt | S-5'-G*A*A*GAAAAUUUCCGCAA *A*A-3' | SEQ ID NO: 87179 |
| | AS-5'-UUUUGCGGAAAUUUUC UUC-3' | SEQ ID NO: 87180 |
| #8-dT | S-5'-G*A*A*GAAAAU UUCCGCAA *A*A*dT-3' | SEQ ID NO: 87185 |
| | AS-5'-UUUUGCGGAAAUUUUC UUCdT-3' | SEQ ID NO: 87186 |
| #8-Blunt | S-5'-G*A*A*GAAAAU UUCCGCAA *A*A-3' | SEQ ID NO: 87179 |
| | AS-5'-UUUUGCGGAAAUUUUC UUC-3' | SEQ ID NO: 87180 |

Figure 9B

| | | |
|---|---|---|
| #9-dT | S-5'-GAAGAAAAU UUCCGCAA *A*A*dT-3' | SEQ ID NO: 87185 |
| | AS-5'-UUUUGCGGAAAUUUUC UUCdT-3' | SEQ ID NO: 87186 |
| # 9-Blunt | S-5'-GAAGAAAAU UUCCGCAA *A*A-3' | SEQ ID NO: 87179 |
| | AS-5'-UUUUGCGGAAAUUUUC UUC-3' | SEQ ID NO: 87180 |
| #10-dT | S-5'-GAAGAAAAUUUCCGCAA *A*A*dT-3' | SEQ ID NO: 87185 |
| | AS-5'-UUUUGCGGAAAUUUUCUUCdT-3' | SEQ ID NO: 87186 |
| # 10-Blunt | S-5'-GAAGAAAAUUUCCGCAA *A*A-3' | SEQ ID NO: 87179 |
| | AS-5'-UUUUGCGGAAAUUUUCUUC-3' | SEQ ID NO: 87180 |
| #11-dT | S-5'-G*A*A*GAAAAU UUCCGCAAAAdT-3' | SEQ ID NO: 87185 |
| | AS-5'-UUUUGCGGAAAUUUUCUUCdT-3' | SEQ ID NO: 87186 |
| # 11-Blunt | S-5'-G*A*A*GAAAAU UUCCGCAAAA-3' | SEQ ID NO: 87179 |
| | AS-5'-UUUUGCGGAAAUUUUCUUC-3' | SEQ ID NO: 87180 |
| #12-dT | S-5'-GAAGAAAAUUUCCGCA AAAdT-3' | SEQ ID NO: 87185 |
| | AS-5'-UUUUGCGGAAAUUUUCUUCdT-3' | SEQ ID NO: 87186 |
| # 12-Blunt | S-5'-GAAGAAAAUUUCCGCA AAA-3' | SEQ ID NO: 87179 |
| | AS-5'-UUUUGCGGAAAUUUUCUUC-3' | SEQ ID NO: 87180 |
| #13-dT | S-5'-GAAGAAAAUUUCCGCAAAAdT-3' | SEQ ID NO: 87185 |
| | AS-5'-UUUUGCGGAAAUUUUCUUCdT-3' | SEQ ID NO: 87186 |
| # 13-Blunt | S-5'-GAAGAAAAUUUCCGCAAAA-3' | SEQ ID NO: 87179 |
| | AS-5'-UUUUGCGGAAAUUUUCUUC-3' | SEQ ID NO: 87180 |

Figure 10A

| Dup.# | Strand | Sequence (5' -> 3') | SEQ ID No. |
|---|---|---|---|
| 1 | SEN | 5' GAAGAAGAAAAUUUCCGCAA*A*A*A 3' | SEQ ID NO: 87183 |
|   | AS  | 5' UUUUUGCGGAAAUUUUCUUC*U*U*C 3' | SEQ ID NO: 87184 |
| 2 | SEN | 5' G*A*A*GAAGAAAAUUUCCGCAAAAA 3' | SEQ ID NO: 87183 |
|   | AS  | 5' UUUUUGCGGAAAUUUUCUUC*U*U*C 3' | SEQ ID NO: 87184 |
| 3 | SEN | 5' G*A*A*GAAGAAAAUUUCCGCAA*A*A*A 3' | SEQ ID NO: 87183 |
|   | AS  | 5' UUUUUGCGGAAAUUUUCUUC*U*U*C 3' | SEQ ID NO: 87184 |
| 1alt | SEN | 5' GAAGAAGAAAAUUUCCGCAA*A*A*A 3'' | SEQ ID NO: 87183 |
|      | AS  | 5' <u>UUUUUGCGGAAAUUUUCUUCUUC</u> 3' | SEQ ID NO: 87184 |
| 2alt | SEN | 5' G*A*A*GAAGAAAAUUUCCGCAAAAA 3' | SEQ ID NO: 87183 |
|      | AS  | 5' <u>UUUUUGCGGAAAUUUUCUUCUUC</u> 3' | SEQ ID NO: 87184 |
| 3alt | SEN | 5' G*A*A*GAAGAAAAUUUCCGCAA*A*A*A 3' | SEQ ID NO: 87183 |
|      | AS  | 5' <u>UUUUUGCGGAAAUUUUCUUCUUC</u> 3' | SEQ ID NO: 87184 |

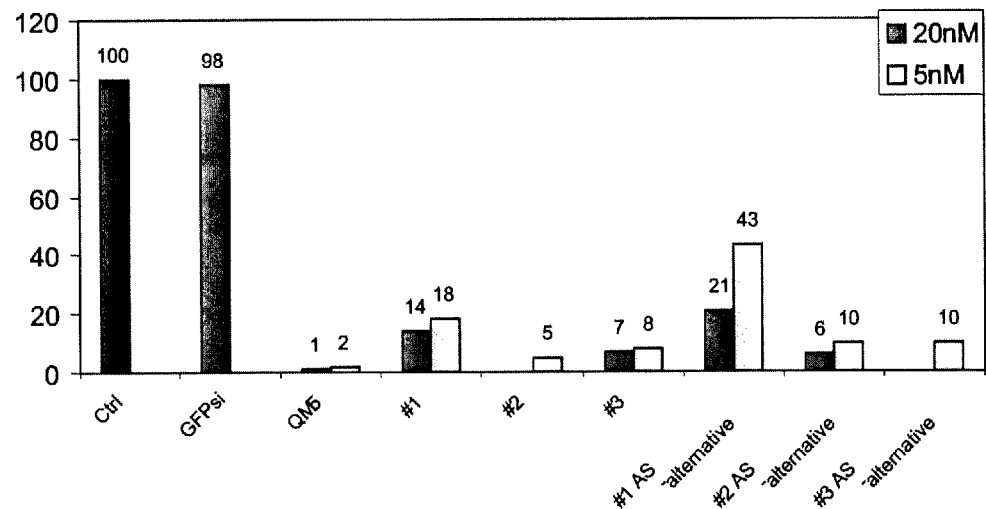

| 4+19 | Sense | 5'-C*C*U*UGCACUCCUGAAUUUUAUCA-3' | SEQ ID NO: 267 |
|---|---|---|---|
| | AS | 5'-UGAUAAAAUUCAGGAGUGCAAGG-3' | SEQ ID NO: 268 |
| 3+19+1 | Sense | 5'-C*U*U*GCACUCCUGAAUUUUAUCAA-3' | SEQ ID NO: 269 |
| | AS | 5'-UUGAUAAAAUUCAGGAGUGCAAG-3' | SEQ ID NO: 270 |
| 2+19+2 | Sense | 5'-U*U*G*CACUCCUGAAUUUUAUCAAA-3' | SEQ ID NO: 271 |
| | AS | 5'-UUUGAUAAAAUUCAGGAGUGCAA-3' | SEQ ID NO: 272 |
| 1+19+3 | Sense | 5'-U*G*C*ACUCCUGAAUUUUAUCAAAC-3' | SEQ ID NO: 273 |
| | AS | 5'-GUUUGAUAAAAUUCAGGAGUGCA-3' | SEQ ID NO: 274 |
| 19+4 | Sense | 5'-G*C*A*CUCCUGAAUUUUAUCAAACA-3' | SEQ ID NO: 275 |
| | AS | 5'-UGUUUGAUAAAAUUCAGGAGUGC-3' | SEQ ID NO: 276 |

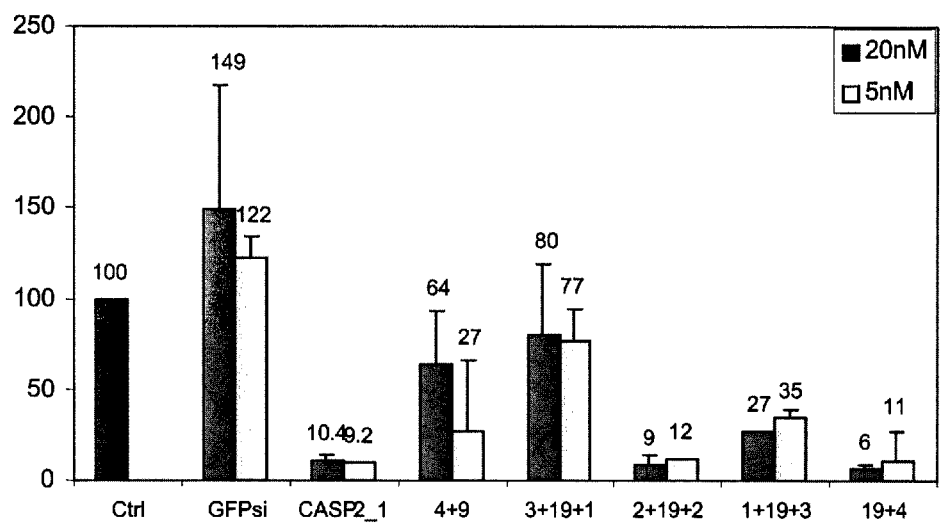

| 4+19 | Sense | 5'-C*C*U*UGCACUCCUGAAUUUUAUCA-3' | SEQ ID NO: 267 |
|---|---|---|---|
|  | AS | 5'-UGAUAAAAUUCAGGAGUGCAA*G*G-3' | SEQ ID NO: 268 |
| 3+19+1 | Sense | 5'-C*U*UGCACUCCUGAAUUUUAUCAA-3' | SEQ ID NO: 269 |
|  | AS | 5'-UUGAUAAAAUUCAGGAGUGCA*A*G-3' | SEQ ID NO: 270 |
| 2+19+2 | Sense | 5'-U*U*G*CACUCCUGAAUUUUAUCAAA-3' | SEQ ID NO: 271 |
|  | AS | 5'-UUUGAUAAAAUUCAGGAGUGC*A*A-3' | SEQ ID NO: 272 |
| 1+19+3 | Sense | 5'-U*G*C*ACUCCUGAAUUUUAUCAAAC-3' | SEQ ID NO: 273 |
|  | AS | 5'-GUUUGAUAAAAUUCAGGAGUG*C*A-3' | SEQ ID NO: 274 |
| 19+4 | Sense | 5'-G*C*A*CUCCUGAAUUUUAUCAAACA-3' | SEQ ID NO: 275 |
|  | AS | 5'-UGUUUGAUAAAAUUCAGGAGU*G*C-3' | SEQ ID NO: 276 |

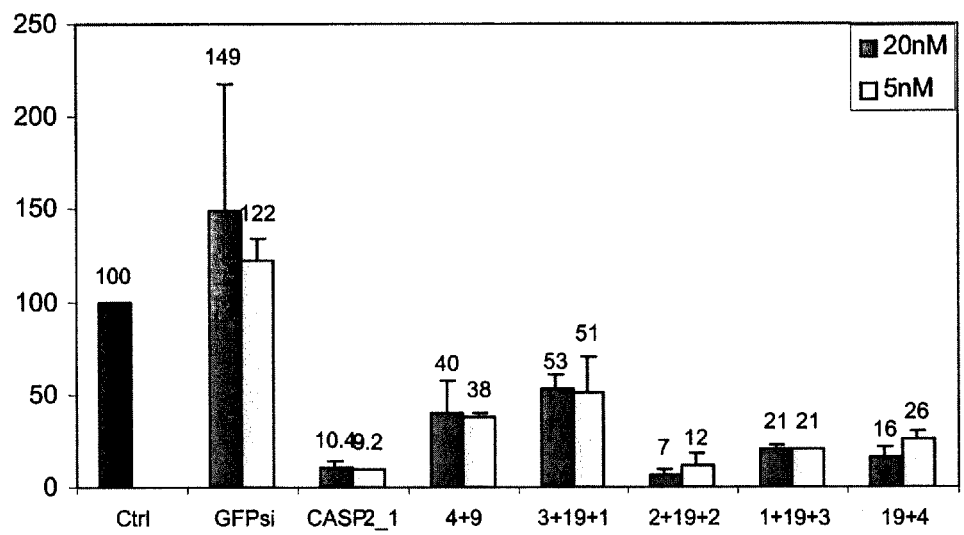

| No | siRNA-duplex name | Mirror nucleotide siRNA structures underlined characters =mirror nucs | SEQ ID No. |
|---|---|---|---|
| 1 | Sp4QM5-S/Sp4QM5-AS | S-5'-GAAGAAAAUUUCCGCAA<u>AA</u>-dT- 3' | SEQ ID NO: 87185 |
| | | AS-3'-dT-<u>C</u>UUCUUUUAAAGGCGUUUU- 5' | SEQ ID NO: 87186 |
| 2 | Sp5QM5-S/Sp4QM5-AS | S-5'-<u>GA</u>AGAAAAUUUCCGCAAAAA-dT- 3' | SEQ ID NO: 87185 |
| | | AS-3'-dT-<u>C</u>UUCUUUUAAAGGCGUUUU- 5' | SEQ ID NO: 87186 |
| 3 | Sp6QM5-S/Sp4QM5-AS | S-5'-<u>GA</u>AGAAAAUUUCCGCAA<u>AA</u>-dT- 3' | SEQ ID NO: 87185 |
| | | AS-3'-dT-<u>C</u>UUCUUUUAAAGGCGUUUU- 5' | SEQ ID NO: 87186 |
| 4 | QM5-S/Sp4QM5-AS | S-5'-GAAGAAAAUUUCCGCAAAAA-dT- 3' | SEQ ID NO: 87185 |
| | | AS-3'-dT-<u>C</u>UUCUUUUAAAGGCGUUUU- 5' | SEQ ID NO: 87186 |
| 5 | Sp4QM5-S/Sp5QM5-AS | S-5'-GAAGAAAAUUUCCGCAA<u>AA</u>-dT- 3' | SEQ ID NO: 87185 |
| | | AS-3'-dT-CUUCUUUUAAAGGCGUUU<u>T</u>- 5' | SEQ ID NO: 87193 |
| 6 | Sp5QM5-S/Sp5QM5-AS | S-5'-<u>GA</u>AGAAAAUUUCCGCAAAAA-dT- 3' | SEQ ID NO: 87185 |
| | | AS-3'-dT-CUUCUUUUAAAGGCGUUU<u>T</u>- 5' | SEQ ID NO: 87193 |
| 7 | Sp6QM5-S/Sp5QM5-AS | S-5'-<u>GA</u>AGAAAAUUUCCGCAA<u>AA</u>-dT- 3' | SEQ ID NO: 87185 |
| | | AS-3'-dT-<u>C</u>UUCUUUUAAAGGCGUUU<u>T</u>- 5' | SEQ ID NO: 87193 |
| 8 | QM5-S/Sp5QM5-AS | S-5'-GAAGAAAAUUUCCGCAAAAA-dT- 3' | SEQ ID NO: 87185 |
| | | AS-3'-dT-CUUCUUUUAAAGGCGUUU<u>T</u>- 5' | SEQ ID NO: 87193 |
| 9 | Sp4QM5-S/Sp6QM5-AS | S-5'-GAAGAAAAUUUCCGCAA<u>AA</u>-dT- 3' | SEQ ID NO: 87185 |
| | | AS-3'-dT-<u>C</u>UUCUUUUAAAGGCGUUU<u>T</u>- 5' | SEQ ID NO: 87193 |
| 10 | Sp4QM5-S/QM5-AS | S-5'-GAAGAAAAUUUCCGCAA<u>AA</u>-dT- 3' | SEQ ID NO: 87185 |
| | | AS-3'-dT-CUUCUUUUAAAGGCGUUUU- 5' | SEQ ID NO: 87186 |
| 11 | Sp5QM5-S/Sp6QM5-AS | S-5'-<u>GA</u>AGAAAAUUUCCGCAAAAA-dT- 3' | SEQ ID NO: 87185 |
| | | AS-3'-dT-<u>C</u>UUCUUUUAAAGGCGUUU<u>T</u>- 5' | SEQ ID NO: 87193 |
| 12 | Sp5QM5-S/QM5-AS | S-5'-<u>GA</u>AGAAAAUUUCCGCAAAAA-dT- 3' | SEQ ID NO: 87185 |
| | | AS-3'-dT-CUUCUUUUAAAGGCGUUUU- 5' | SEQ ID NO: 87186 |
| 13 | Sp6QM5-S/Sp6QM5-AS | S-5'-<u>GA</u>AGAAAAUUUCCGCAA<u>AA</u>-dT- 3' | SEQ ID NO: 87185 |
| | | AS-3'-dT-<u>C</u>UUCUUUUAAAGGCGUUU<u>T</u>- 5' | SEQ ID NO: 87193 |
| 14 | QM5-S/Sp6QM5-AS | S-5'-GAAGAAAAUUUCCGCAAAAA-dT- 3' | SEQ ID NO: 87185 |
| | | AS-3'-dT-<u>C</u>UUCUUUUAAAGGCGUUU<u>T</u>- 5' | SEQ ID NO: 87193 |
| 15 | Sp6QM5-S/QM5-AS | S-5'-<u>GA</u>AGAAAAUUUCCGCAA<u>AA</u>-dT- 3' | SEQ ID NO: 87185 |
| | | AS-3'-dT-<u>C</u>UUCUUUUAAAGGCGUUUU- 5' | SEQ ID NO: 87186 |

Figure 13C
L-DNA structure
| | |
|---|---|
| S 5'- GAAGAAAAUUUCCGCA<u>666</u>-dT-3' | SEQ ID NO: 87185 |
| AS 5'- UUUUGCGGAAAUUUUC<u>557</u>-dT-3' | SEQ ID NO: 87186 |
<u>5</u>: L-thymidine
<u>6</u>: L-deoxyadenosine
<u>7</u>: L-deoxycytidine
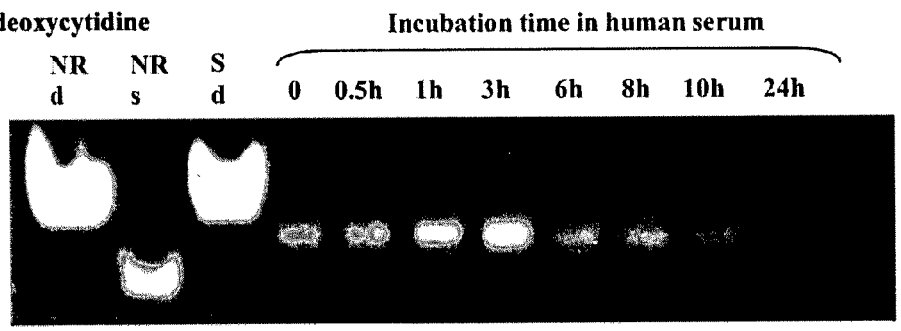
Figure 13D
IC50 = 0.23 nM           IC50 = 0.09 nM
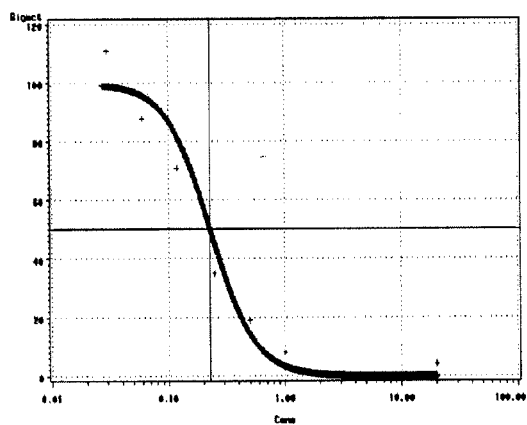 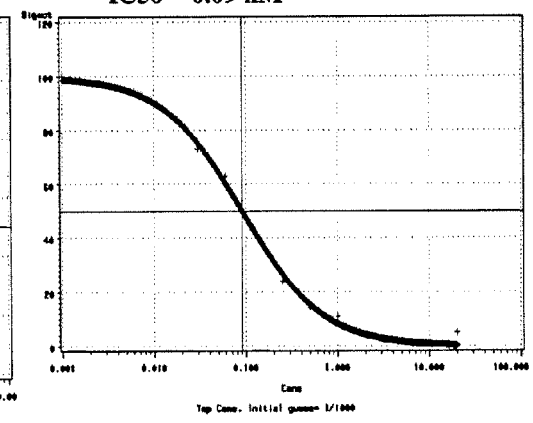
S-5'-XmXmXmXmXmXmXmXmXmX    S-5'-XXXXXXXXXXXXXXXXXXXLL-3'
AS-3'-mXmXmXmXmXmXmXmXmXm    AS-3' LXXXXXXXXXXXXXXXXXXX
m – 2'O-Me
L – L-RNA

Figure 14A

| No | LNA siRNA-duplex name | LNA siRNA structures | SEQ ID No. |
|---|---|---|---|
|  |  | underlined characters =LNA nucs |  |
| 1 | LNA1QM5-S/LNA1QM5-AS | S-5'-GAAGAAAAUUUCCGCA<u>AAA</u>-dT-3' | SEQ ID NO: 87185 |
|  |  | AS-3'-dT-<u>CUU</u>CUUUUAAAGGCGUUUU-5' | SEQ ID NO: 87186 |
| 2 | LNA2QM5-S/LNA1QM5-AS | S-5'-<u>GAA</u>GAAAAUUUCCGCAAAA-dT-3' | SEQ ID NO: 87185 |
|  |  | AS-3'-dT-<u>CUU</u>CUUUUAAAGGCGUUUU-5' | SEQ ID NO: 87186 |
| 3 | LNA3QM5-S/LNA1QM5-AS | S-5'-<u>GAA</u>GAAAAUUUCCGCA<u>AAA</u>-dT-3' | SEQ ID NO: 87185 |
|  |  | AS-3'-dT-<u>CUU</u>CUUUUAAAGGCGUUUU-5' | SEQ ID NO: 87186 |
| 4 | QM5-S/LNA1QM5-AS | S-5'-GAAGAAAAUUUCCGCAAAA-3' | SEQ ID NO: 87179 |
|  |  | AS-3'-dT-<u>CUU</u>CUUUUAAAGGCGUUUU-5' | SEQ ID NO: 87186 |
| 5 | LNA1QM5-S/LNA2QM5-AS | S-5'-GAAGAAAAUUUCCGCA<u>AAA</u>-dT-3' | SEQ ID NO: 87185 |
|  |  | AS-3'-dT-CUUCUUUUAAAGGCG<u>UUU</u>-5' | SEQ ID NO: 87186 |
| 6 | LNA2QM5-S/LNA2QM5-AS | S-5'-<u>GAA</u>GAAAAUUUCCGCAAAA-dT-3' | SEQ ID NO: 87185 |
|  |  | AS-3'-dT-CUUCUUUUAAAGGCG<u>UUU</u>-5' | SEQ ID NO: 87186 |
| 7 | LNA3QM5-S/LNA2QM5-AS | S-5'-<u>GAA</u>GAAAAUUUCCGCA<u>AAA</u>-dT-3' | SEQ ID NO: 87185 |
|  |  | AS-3'-dT-CUUCUUUUAAAGGCG<u>UUU</u>-5' | SEQ ID NO: 87186 |
| 8 | QM5-S/LNA2QM5-AS | S-5'-GAAGAAAAUUUCCGCAAAA-3' | SEQ ID NO: 87179 |
|  |  | AS-3'-dT-CUUCUUUUAAAGGCG<u>UUU</u>-5' | SEQ ID NO: 87186 |
| 9 | LNA1QM5-S/LNA3QM5-AS | S-5'-GAAGAAAAUUUCCGCA<u>AAA</u>-dT-3' | SEQ ID NO: 87185 |
|  |  | AS-3'-dT-<u>CUU</u>CUUUUAAAGGCG<u>UUU</u>-5' | SEQ ID NO: 87186 |
| 10 | LNA1QM5-S/QM5-AS | S-5'-GAAGAAAAUUUCCGCA<u>AAA</u>-dT-3' | SEQ ID NO: 87185 |
|  |  | AS-3'-CUUCUUUUAAAGGCGUUUU-5' | SEQ ID NO: 87180 |
| 11 | LNA2QM5-S/LNA3QM5-AS | S-5'-<u>GAA</u>GAAAAUUUCCGCAAAA-dT-3' | SEQ ID NO: 87185 |
|  |  | AS-3'-dT-<u>CUU</u>CUUUUAAAGGCG<u>UUU</u>-5' | SEQ ID NO: 87186 |
| 12 | LNA2QM5-S/QM5-AS | S-5'-<u>GAA</u>GAAAAUUUCCGCAAAA-dT-3' | SEQ ID NO: 87185 |
|  |  | AS-3'-CUUCUUUUAAAGGCGUUUU-5' | SEQ ID NO: 87180 |
| 13 | LNA3QM5-S/LNA3QM5-AS | S-5'-<u>GAA</u>GAAAAUUUCCGCA<u>AAA</u>-dT-3' | SEQ ID NO: 87185 |
|  |  | AS-3'-dT-<u>CUU</u>CUUUUAAAGGCG<u>UUU</u>-5' | SEQ ID NO: 87186 |
| 14 | QM5-S/LNA3QM5-AS | S-5'-GAAGAAAAUUUCCGCAAAA-3' | SEQ ID NO: 87179 |
|  |  | AS-3'-dT-<u>CUU</u>CUUUUAAAGGCG<u>UUU</u>-5' | SEQ ID NO: 87186 |
| 15 | LNA3QM5-S/QM5-AS | S-5'-<u>GAA</u>GAAAAUUUCCGCA<u>AAA</u>-dT-3' | SEQ ID NO: 87185 |
|  |  | AS-3'-CUUCUUUUAAAGGCGUUUU-5' | SEQ ID NO: 87180 |
| 16 | QM5-S/QM5-AS (positive control) | S-5'-GAAGAAAAUUUCCGCAAAA-3' | SEQ ID NO: 87179 |
|  |  | AS-3'-CUUCUUUUAAAGGCGUUUU-5' | SEQ ID NO: 87180 |

Tandem siRNA molecule

S-5'  agagcgagaugaucuggaadTsdTuuagagaagaucuacguguuadTsdT3'
(SEQ ID NO:87194)

A-3'dTsdTucucgcucuacuagaccuudTsdT   ucucuucuagaugcacaau         5'
(SEQ ID NO:87195)                   (SEQ ID NO:87196)

Figure 17A

| duplex No | siRNA-duplex name | Bold underlined N = 2'Ome  Small case italicized = 2'-5'bond plus 3'Ome | Activity 20nM- % target gene post KD | SEQ ID No. |
|---|---|---|---|---|
| 1 | 3'Ome-1QM5-as/ 3'Ome-1-QM5-s | S-5'-GAAGAAAAUUUCCGCAaaA-3' |  | SEQ ID NO:87179 |
|   |   | AS-5'-UUUUGCGGAAAUUUUCuuC- 3' |  | SEQ ID NO:87180 |
| 2 | 3'Ome-1QM5-as/ 3'Ome-2-QM5-s | S-5'-*gaa*GAAAAUUUCCGCAAAA-3' | 35; 17 | SEQ ID NO:87179 |
|   |   | AS-5'-UUUUGCGGAAAUUUUCuuC- 3' |  | SEQ ID NO:87180 |
| 3 | 3'Ome-1QM5-as/ QM5-s | S-5'- GAAGAAAAUUUCCGCAAAA- 3' | 57 | SEQ ID NO:87179 |
|   |   | AS-5'-UUUUGCGGAAAUUUUCuuC- 3' |  | SEQ ID NO:87180 |
| 4 | 3'Ome-2-QM5-as/ 3'Ome-1-QM5-s | S-5'-GAAGAAAAUUUCCGCAaaA-3' | 100 | SEQ ID NO:87179 |
|   |   | AS-5'-uuuUGCGGAAAUUUUCUUC- 3' |  | SEQ ID NO:87180 |
| 5 | 3'Ome-2-QM5-as/ 3'Ome-2-QM5-s | S-5'-*gaa*GAAAAUUUCCGCAAAA-3' | 100 | SEQ ID NO:87179 |
|   |   | AS-5'-uuuUGCGGAAAUUUUCUUC- 3' |  | SEQ ID NO:87180 |
| 6 | 3'Ome-2-QM5-as/ QM5-s | S-5'- GAAGAAAAUUUCCGCAAAA- 3' | 100 | SEQ ID NO:87179 |
|   |   | AS-5'-uuuUGCGGAAAUUUUCUUC- 3' |  | SEQ ID NO:87180 |
| 7 | QM5as/ 3'Ome-1-QM5-s | S-5'-GAAGAAAAUUUCCGCAaaA-3' | 26 (5nM); 13 | SEQ ID NO:87179 |
|   |   | AS-5'-UUUUGCGGAAAUUUUCUUC- 3' |  | SEQ ID NO:87180 |
| 8 | QM5as/ 3'Ome-2-QM5-s | S-5'-*gaa*GAAAAUUUCCGCAAAA-3' | 16; 16 | SEQ ID NO:87179 |
|   |   | AS-5'-UUUUGCGGAAAUUUUCUUC- 3' |  | SEQ ID NO:87180 |

Figure 17B

| siRNA-duplex No | siRNA-duplex name | *Italicized small case=P-Ethoxy-dN;* <u>N</u> = 2'-Ome | Activity at 20nM-% target gene KD | SEQ ID No. |
|---|---|---|---|---|
| 1 | Y1QM5-as/ Y1QM5-s | S-5'-GAAGAAAAUUUCCGCA*aaa*-dT-3' | 55 (5nM) | SEQ ID NO:87185 |
| | | AS-5'-UUUUGCGGAAAUUUUC*uuc*-dT-3' | | SEQ ID NO:87186 |
| 2 | Y1QM5-as/ Y2QM5-s | S-5'-*gaa*GAAAAUUUCCGCAAAA-dT-3' | 100 | SEQ ID NO:87185 |
| | | AS-5'-UUUUGCGGAAAUUUUC*uuc*-dT-3' | | SEQ ID NO:87186 |
| 3 | Y1QM5-as/ QM5-s | S-5'-GAA<u>GAAAAUUUCCGCAAAA</u>- 3' | 38 | SEQ ID NO:87179 |
| | | AS-5'-UUUUGCGGAAAUUUUC*uuc*-dT-3' | | SEQ ID NO:87186 |
| 4 | Y2QM5-as/ Y1QM5-s | S-5'-GAAGAAAAUUUCCGCA*aaa*-dT-3' | 87 | SEQ ID NO:87185 |
| | | AS-5'-*uuu*UGCGGAAAUUUUCUUC-dT-3' | | SEQ ID NO:87186 |
| 5 | Y2QM5-as/ Y2QM5-s | S-5'-*gaa*GAAAAUUUCCGCAAAA-dT-3' | 100 | SEQ ID NO:87185 |
| | | AS-5'-*uuu*UGCGGAAAUUUUCUUC-dT-3' | | SEQ ID NO:87186 |
| 6 | Y2QM5-as/ QM5-s | S-5'-GAA<u>GAAAAUUUCCGCAAAA</u>- 3' | 100 | SEQ ID NO:87179 |
| | | AS-5'-*uuu*UGCGGAAAUUUUCUUC-dT-3' | | SEQ ID NO:87186 |
| 7 | QM5-as/ Y1QM5-s | S-5'-GAAGAAAAUUUCCGCA*aaa*-dT-3' | 27 (5nM) | SEQ ID NO:87185 |
| | | AS-3'-<u>CUUCUUUUAAAGGCGUUUU</u>- 5' | | SEQ ID NO:87180 |
| 8 | QM5-as/ Y2QM5-s | S-5'-*gaa*GAAAAUUUCCGCAAAA-dT-3' | 19 | SEQ ID NO:87185 |
| | | AS-3'-<u>CUUCUUUUAAAGGCGUUUU</u>- 5' | | SEQ ID NO:87180 |

Figure 17C

| siRNA-duplex No | siRNA-duplex name | *ITALICS CAPITAL* = 2'-5'-nucs; n=LNA; N - 2'-Ome *italics small* - L-DNA | 3'-end Pi | Activity at 20nM-% target gene KD (residual) | SEQ ID No. |
|---|---|---|---|---|---|
| 4 | CASP2_4_DS_1 | gccAGAAUGUGGAACU*CCU* | y | 11 (8) | SEQ ID NO:139 |
| | | *AGGAGUUCCACAUUCUGGC* | y | | SEQ ID NO:140 |
| 5 | CASP2_4_DS_2 | gccAGAAUGUGGAACU*CCU* | y | 10 (8) | SEQ ID NO:139 |
| | | *AGGAGUUCCACAUUCUGGC* | y | | SEQ ID NO:140 |
| 4 | CASP2_4_S-2-5-Pi-3'/ CASP2_4_AS-Pi | GCCAGAAUGUGGAACU*CCU* | y | 6 | SEQ ID NO:139 |
| | | *AGGAGUUCCACAUUCUGGC* | y | | SEQ ID NO:140 |
| 1 | CASP2_4_S1/ CASP2_4_AS_alt | GCCAGAAUGUGGAACU*CCU* | y-2' | 11 | SEQ ID NO:139 |
| | | *AGGAGUUCCACAUUCUGGC* | y | | SEQ ID NO:140 |
| 2 | CASP2_4_S2/ CASP2_4_AS_alt | GCCAGAAUGUGGAACU*CCU* | y-2' | 17 | SEQ ID NO:139 |
| | | *AGGAGUUCCACAUUCUGGC* | y | | SEQ ID NO:140 |
| 5 | CASP2_4_S5/ CASP2_4_AS_alt | GCCAGAAUGUGGAACUC*cu* | y | 3 | SEQ ID NO:139 |
| | | *AGGAGUUCCACAUUCUGGC* | y | | SEQ ID NO:140 |
| 6 | CASP2_4_S6/ CASP2_4_AS_alt | GCCAGAAUGUGGAACUC*Cu* | y | 6 | SEQ ID NO:139 |
| | | *AGGAGUUCCACAUUCUGGC* | y | | SEQ ID NO:140 |
| 7 | CASP2_4_S7/ CASP2_4_AS_alt | GCCAGAAUGUGGAACU*ccu* | y | 10 | SEQ ID NO:139 |
| | | *AGGAGUUCCACAUUCUGGC* | y | | SEQ ID NO:140 |
| 8 | CASP2_4_S8/ CASP2_4_AS_alt | GCCAGAAUGUGGAACUC*cu* | y | 4 | SEQ ID NO:139 |
| | | *AGGAGUUCCACAUUCUGGC* | y | | SEQ ID NO:140 |
| 9 | CASP2_4_S9/ CASP2_4_AS_alt | GCCAGAAUGUGGAACUCC*u* | y | 8 | SEQ ID NO:139 |
| | | *AGGAGUUCCACAUUCUGGC* | y | | SEQ ID NO:140 |
| 10 | CASP2_4_S10/ CASP2_4_AS_alt | GCCAGAAUGUGGAACUC*cu* | y | 7 | SEQ ID NO:139 |
| | | *AGGAGUUCCACAUUCUGGC* | y | | SEQ ID NO:140 |
| 11 | CASP2_4_S11/ CASP2_4_AS_alt | GCCAGAAUGUGGAACUCC*cU* | y | 6 | SEQ ID NO:139 |
| | | *AGGAGUUCCACAUUCUGGC* | y | | SEQ ID NO:140 |
| 12 | CASP2_4_S12/ CASP2_4_AS_alt | GCCAGAAUGUGGAACU*Cc*U | y | 18 | SEQ ID NO:139 |
| | | *AGGAGUUCCACAUUCUGGC* | y | | SEQ ID NO:140 |
| 3 | CASP2_4_S3/ CASP2_4_AS_alt | GCCAGAAUGUGGAACU*CCU* | y | 17 | SEQ ID NO:139 |
| | | *AGGAGUUCCACAUUCUGGC* | y | | SEQ ID NO:140 |

Figure 18

| Strand name | 19-mer - Sense - (5'>3') | |
|---|---|---|
| CASP2_4-S-dn1 | GCCAGAAUGUG*GAACTCCT* | SEQ ID NO:87201 |
| CASP2_4-S-dn2 | GCCAGAAUGUGG*AACTCCT* | SEQ ID NO:87202 |
| CASP2_4-S-dn3 | GCCAGAAUGUGGA*ACTCCT* | SEQ ID NO:87203 |
| CASP2_4-S-dn4 | *GCCAGA*AUGUGGAACUCCU | SEQ ID NO:87204 |
| CASP2_4-S-dn5 | *GCCAGA*AUGUGGA*ACTCCT* | SEQ ID NO:87205 |
| CASP2_4-S-dn6 | *GCCAG*AAUGUGGA*ACTCCT* | SEQ ID NO:87206 |

| Strand name | 19-mer-Antisense (5'>3') | |
|---|---|---|
| CASP2_4-AS-dn1 | *AGGAGTTC*CACAUUCUGGC | SEQ ID NO:87207 |
| CASP2_4-AS-dn2 | *AGGAGTT*CCACAUUCUGGC | SEQ ID NO:87208 |
| CASP2_4-AS-dn3 | *AGGAGT*UCCACAUUCUGGC | SEQ ID NO:87209 |
| CASP2_4-AS-dn4 | *AGGAG*UUCCACAUUCUGGC | SEQ ID NO:87210 |
| CASP2_4-AS-dn5 | *AGGAG*UUCCACAUU*CTGGC* | SEQ ID NO:87211 |
| CASP2_4-AS-dn6 | 6g8a8u5c7a7a5u7u8g7 | SEQ ID NO:140 |

Figure 19A

| Strand sequence 5'>3' | Strand | SEQ ID No. |
|---|---|---|
| Gc̲CAGAAUGUGGAACUCc̲U | Sense | SEQ ID NO: 139 |
| AGGAGUUCCACAUUCUGGC | AS | SEQ ID NO: 140 |
| | | |
| GcCAGAAUGUGGAACUc̲cU | Sense | SEQ ID NO: 139 |
| A̲G̲G̲A̲G̲U̲U̲C̲C̲A̲C̲A̲U̲U̲C̲U̲G̲G̲C̲ | AS | SEQ ID NO: 140 |
| Legend | | |
| n̲ = L-DNA | | |
| N̲ - 2'-OMe ribonucleotide | | |

Figure 19B

| Sense Strand (N'y); 19-mer (5'>3') | SEQ ID No. |
|---|---|
| Gc̲CAGAAUGUGGAACUc̲cU | SEQ ID NO: 139 |
| Gc̲ c̲AGAAUGUGGAACUc̲cU | SEQ ID NO: 139 |
| Gc̲CAGAAUGUGGAACUCc̲U | SEQ ID NO: 139 |
| Gc̲ c̲AGAAUGUGGAACUCc̲U | SEQ ID NO: 139 |
| Lc-GCCAGAAUGUGGAACUc̲cU | SEQ ID NO: 139 |
| Lc-GCCAGAAUGUGGAACUc̲cU | SEQ ID NO: 139 |
| Lc-GCCAGAAUGUGGAACUCc̲U | SEQ ID NO: 139 |
| Lc-GCCAGAAUGUGGAACUCc̲U | SEQ ID NO: 139 |
| ab-GCCAGAAUGUGGAACUc̲cU | SEQ ID NO: 139 |
| ab-GCCAGAAUGUGGAACUc̲cU | SEQ ID NO: 139 |
| ab-GCCAGAAUGUGGAACUCc̲U | SEQ ID NO: 139 |
| ab-GCCAGAAUGUGGAACUCc̲U | SEQ ID NO: 139 |
| AS Strand (N)x; 19-mer (5'>3') | |
| AGGAGUUCCACAUUCUGGC | SEQ ID NO: 140 |
| A̲GGA̲G̲UUC̲CA̲CA̲UUC̲UG̲GC̲ | SEQ ID NO: 140 |
| A̲G̲G̲A̲G̲U̲U̲C̲C̲A̲C̲A̲U̲U̲C̲U̲G̲G̲C̲ | SEQ ID NO: 140 |
| Legend | | n̲ = L-DNA (L-deoxyribocytidine)
N̲ - 2'-OMe ribonucleotide
Lc- L-Deoxy cytidine 5'-overhang
ab- Abasic 2'deoxyribo moiety

Figure 19C

| OLIGO NAME | SEQUENCE (5' -> 3') | SEQ ID No. |
|---|---|---|
| CASP2_4_S1 | 5' GCCAGAAUGUGGAAdCUC_cA | SEQ ID NO:87212 |
| CASP2_4_S2 | 5' GCCAGAAUGUGGAAdC_cC_cA | SEQ ID NO:87213 |
| CASP2_4_S3 | 5' I GCCAGAAUGUGGAAdCUC_cA | SEQ ID NO:87212 |
| CASP2_4_S4 | 5' _c GCCAGAAUGUGGAAdCUC_cA | SEQ ID NO:87212 |
| CASP2_4_S5 | 5' C6-GCCAGAAUGUGGAAdCUC_cA | SEQ ID NO:87212 |
| CASP2_4_S6 | 5' C6-GCCAGAAUGUGGAAdC_cC_cA | SEQ ID NO:87213 |
| CASP2_4_S7 | 5' G_cCAGAAUGUGGAAdCUC_cA | SEQ ID NO:87212 |
| CASP2_4_S8 | 5' G_cCAGAAUGUGGAAdC_cC_cA | SEQ ID NO:87213 |
| | | |
| CASP2_4_AS1 | 5' AGGAGUUCCACAUUCUGGC | SEQ ID NO:140 |
| CASP2_4_AS2 | 5' AG_gAGUU_cCA_cAUUCUGG_c | SEQ ID NO:140 |

| _n_ = L-DNA (L-deoxyribonucleotide) |
|---|
| N - 2'-OMe ribonucleotide |
| dN- 2'deoxynucleotide |
| I- INVERTED Abasic 2'deoxyribo moiety |
| C6- C6 imino Pi |

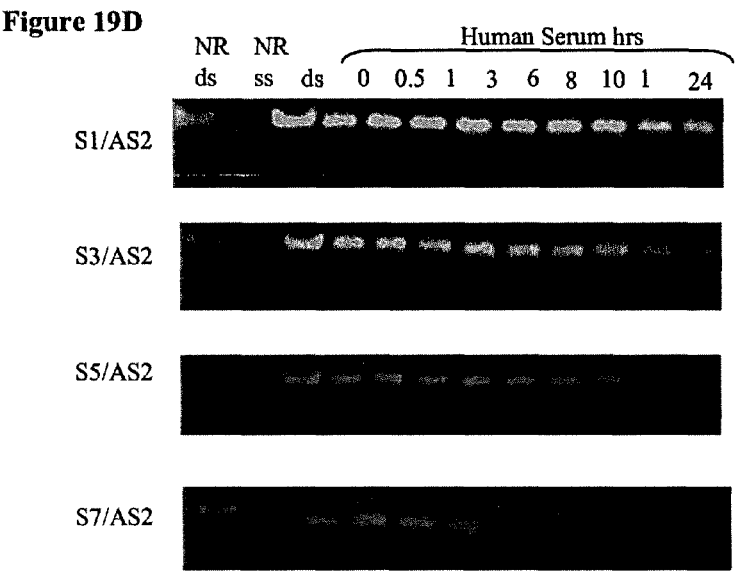

| DUPLEX motifs (5' > 3') SEN/AS | 3'end P1 | Activity at 20nM % target gene KD (= residual target gene activity) | SEQ ID NO. |
|---|---|---|---|
| GAAGGATCTTCGGAATGAT<br>ATCATTCCGAAGATCCTTC | Y<br>Y | 1.7 | SEQ ID NO:87139<br>SEQ ID NO:87140 |
| GAAGGATCTTCGGAATGAT<br>ATCATTCCGAAGATCCTTC | N<br>Y | 2.1 | SEQ ID NO:87139<br>SEQ ID NO:87140 |
| GAAGGATCTTCGGAATG*A*T<br>ATCATTCCGAAGATCCTTC | N<br>Y | 3.4 | SEQ ID NO:87139<br>SEQ ID NO:87140 |
| GAAGGATCTTCGGAATG*A*T<br>ATCATTCCGAAGATCCTTC | Y<br>Y | 3.2 | SEQ ID NO:87139<br>SEQ ID NO:87140 |
| GAAGGATCTTCGGAATG*A*T<br>ATCATTCCGAAGATCCTTC | Y 2'<br>Y | 3.2 | SEQ ID NO:87139<br>SEQ ID NO:87140 |
| GAAGGATCTTCGGAATGat<br>ATCATTCCGAAGATCCTTC | Y<br>Y | 2.2 | SEQ ID NO:87139<br>SEQ ID NO:87140 |
| GAAGGATCTTCGGAATGat<br>ATCATTCCGAAGATCCTTC | N<br>Y | 2.5 | SEQ ID NO:87139<br>SEQ ID NO:87140 |
| GAAGGATCTTCGGAATGAT<br>ATCATTCCGAAGATCCTTC | Y<br>N | 3 | SEQ ID NO:87139<br>SEQ ID NO:87140 |
| GAAGGATCTTCGGAATGAT<br>ATCATTCCGAAGATCCTTC | N<br>N | 6 | SEQ ID NO:87139<br>SEQ ID NO:87140 |
| GAAGGATCTTCGGAATG*A*T<br>ATCATTCCGAAGATCCTTC | N<br>N | 8 | SEQ ID NO:87139<br>SEQ ID NO:87140 |
| GAAGGATCTTCGGAATG*A*T<br>ATCATTCCGAAGATCCTTC | Y<br>N | 4 | SEQ ID NO:87139<br>SEQ ID NO:87140 |
| GAAGGATCTTCGGAATG*A*T<br>ATCATTCCGAAGATCCTTC | Y 2'<br>N | 5 | SEQ ID NO:87139<br>SEQ ID NO:87140 |
| GAAGGATCTTCGGAATGat<br>ATCATTCCGAAGATCCTTC | Y<br>N | 4 | SEQ ID NO:87139<br>SEQ ID NO:87140 |
| GAAGGATCTTCGGAATGat<br>ATCATTCCGAAGATCCTTC | N<br>N | 4 | SEQ ID NO:87139<br>SEQ ID NO:87140 |

*Note: T in the above table corresponds to U in the Sequence Listing originally filed

Figure 20

Legend

| |
|---|
| Underlined N- 2'OMe ribonucleotide |
| ab - abasic pseudonucleotide |
| I - inverted abasic pseudonucleotide |
| *Italicized 5N= 5-OMe DNA* |
| White capital N - LNA |
| *italicized small case underlined* : L-DNA |
| ~~strikethrough - mismatches~~ |

Figure 20A

| Name | Set1-Sense strands(5'>3') | SEQ ID No. |
|---|---|---|
| CASP2_4_S1 | 5'-GCCAGAAUGUGGAACUC<u>c</u>U (19) | SEQ ID NO: 139 |
| CASP2_4_S2 | 5'-GCCAGAAUGUGGAACU<u>cc</u>U (19) | SEQ ID NO: 139 |
| CASP2_4_S3 | 5'-*5G* CCAGAAUGUGGAACUCcU (19) | SEQ ID NO: 139 |
| CASP2_4_S4 | 5'-*5G* CCAGAAUGUGGAACU<u>*Cc*</u>U (19) | SEQ ID NO: 139 |
| CASP2_4_S5 | 5'-I-GCCAGAAUGUGGAACUC<u>c</u>U (20) | SEQ ID NO: 139 |
| CASP2_4_S6 | 5'-I-GCCAGAAUGUGGAACU<u>cc</u>U (20) | SEQ ID NO: 139 |
| Name | Set1- AS strands (5'-3') | |
| CASP2_4_AS1 | 5'- A<u>GG</u>Aab<u>UU</u>CCACA<u>U</u>U<u>CU</u>GG<u>C</u> (19) | SEQ ID NO: 140 |
| CASP2_4_AS2 | 5'- A<u>GG</u>AGab<u>U</u>CCACA<u>U</u>U<u>CU</u>GG<u>C</u> (19) | SEQ ID NO: 140 |
| CASP2_4_AS3 | 5'- A<u>GG</u>AG<u>U</u>UCCACA<u>U</u>UabGG<u>C</u> (19) | SEQ ID NO: 140 |
| CASP2_4_AS4 | 5'- A<u>GG</u>AG<u>UU</u>CCACA<u>U</u>ab<u>CU</u>GG<u>C</u> (19) | SEQ ID NO: 140 |
| CASP2_4_ASx | 5'- A<u>GG</u>AG<u>UU</u>CCACAUUab<u>U</u>GGC (19) | SEQ ID NO: 140 |
| CASP2_4_ASy | 5'- A<u>GG</u>Aab<u>UU</u>CCACA<u>U</u>UCUGGC (19) | SEQ ID NO: 140 |

Figure 20B

| Name | Set2-Sense strands(5'>3') | SEQ ID No. |
|---|---|---|
| CASP2_4_S7 | 5'-I CCAGAAUGUGGAACabababab (19) | SEQ ID NO: 139 |
| CASP2_4_S8 | 5'-5G CAGAAUGUGGAAabababab (19) | SEQ ID NO: 139 |
| CASP2_4_S9 | 5'-I abCAGAAUGUGGAACUababab (19) | SEQ ID NO: 139 |
| CASP2_4_S10 | 5'-I ababAGAAUGUGGAACUCabab (19) | SEQ ID NO: 139 |
| CASP2_4_S11 | 5'-I abababGAAUGUGGAACUCCab (19) | SEQ ID NO: 139 |
| CASP2_4_S12 | 5'-I ababababAAUGUGGAACUCCU (19) | SEQ ID NO: 139 |
| CASP2_4_S13 | 5'-5G CCAGAAUGUGGAAababababab(19) | SEQ ID NO: 139 |
| CASP2_4_S14 | 5'-IG abababAAUGUGGAACUCCU (19) | SEQ ID NO: 139 |
| Name | Set2- AS strands (5'-3') | |
| CASP2_4_AS5 | 5'- AGGAGUUCCACAUUCUGGC (19) | SEQ ID NO: 140 |
| CASP2_4_AS6 | 5'- AGGAGUUCCACAUUCUGGC (19) | SEQ ID NO: 140 |

Figure 20C

| Name | Set3-duplex sequences (5'>3') | SEQ ID No. |
|---|---|---|
| CASP2_4_S15 | 5'-I GCCAGAAUGUGGAAUUCcU (20) | a SEQ ID NO:139 |
| CASP2_4_AS7 | 5'- AGGAAUUCCACAUUCUGGC (19) | d SEQ ID NO:140 |
| CASP2_4_S16 | 5'-I GCCAGAAUGUGGAAUUCcU (20) | a SEQ ID NO:139 |
| CASP2_4_AS7 | 5'- AGGAAUUCCACAUUCUGGC (19) | d SEQ ID NO:140 |
| CASP2_4_S17 | 5'-I GCCAGAAUGUGGACUCcU (20) | b SEQ ID NO:139 |
| CASP2_4_AS8 | 5'- AGGAGUCCACAUUCUGGC (19) | e SEQ ID NO:140 |
| CASP2_4_S18 | 5'-I GCCAGAAUGUGGACUCcU (20) | b SEQ ID NO:139 |
| CASP2_4_AS8 | 5'- AGGAGUCCACAUUCUGGC (19) | e SEQ ID NO:140 |
| CASP2_4_S19 | 5'-I GCCAGAUGUGGAACUCcU (20) | c SEQ ID NO:139 |
| CASP2_4_AS9 | 5'- AGGAGUUCCACAUCUGGC (19) | f SEQ ID NO:140 |
| CASP2_4_S20 | 5'-I GCCAGAUGUGGAACUCcU (20) | c SEQ ID NO:139 |
| CASP2_4_AS9 | 5'- AGGAGUUCCACAUCUGGC (19) | f SEQ ID NO:140 |

Figure 20D

| Oligo Name | Set4- SEN strands (5'>3') | SEQ ID No. |
|---|---|---|
| CASP2_4_S1 | 5'-GCCAGAAUGUGGAACUCcU (19) | SEQ ID NO: 139 |
| CASP2_4_S2 | 5'-GCCAGAAUGUGGAACUccU (19) | SEQ ID NO: 139 |
| CASP2_4_S3 | 5'-5G CCAGAAUGUGGAACUCcU (19) | SEQ ID NO: 139 |
| CASP2_4_S4 | 5'-5G CCAGAAUGUGGAACUccU (19) | SEQ ID NO: 139 |
| CASP2_4_S5 | 5'-I GCCAGAAUGUGGAACUCcU (20) | SEQ ID NO: 139 |
| CASP2_4_S6 | 5'-I GCCAGAAUGUGGAACUccU (20) | SEQ ID NO: 139 |

| Oligo Name | Set4- AS strands (5'-3') | |
|---|---|---|
| CASP2_4_AS10 | 5'- AGGAabUUCCACAUUCUGGC (19) | SEQ ID NO: 140 |
| CASP2_4_AS11 | 5'- AGGAGbaUCCACAUUCUGGC (19) | SEQ ID NO: 140 |
| CASP2_4_AS12 | 5'- AGGAGUUCCACAUUabUGGC (19) | SEQ ID NO: 140 |
| CASP2_4_AS13 | 5'- AGGAGUUCCACAUabCUGGC (19) | SEQ ID NO: 140 |
| CASP2_4_AS14 | 5'- AGGAabUUCCACAUUCUGGC (19) | SEQ ID NO: 140 |
| CASP2_4_AS15 | 5'- AGGAabUUCCACAUUCUGGC (19) | SEQ ID NO: 140 |
| CASP2_4_AS16 | 5'- AGGAGUUCCACAUUabUGGC (19) | SEQ ID NO: 140 |
| CASP2_4_AS17 | 5'- AGGAGUUCCACAUUabUGGC (19) | SEQ ID NO: 140 |

Figure 20E

| Oligo Name | Set5-Sense strands(5'>3')<br>Same sense strands as in SET1 | SEQ ID No. |
|---|---|---|
| CASP2_4_S1 | 5'-GCCAGAAUGUGGAACUC<u>c</u>U (19) | SEQ ID NO:139 |
| CASP2_4_S2 | 5'-GCCAGAAUGUGGAACU<u>cc</u>U (19) | SEQ ID NO:139 |
| CASP2_4_S3 | 5'-5G CCAGAAUGUGGAACUC<u>c</u>U (19) | SEQ ID NO:139 |
| CASP2_4_S4 | 5'-5G CCAGAAUGUGGAACU<u>cc</u>U (19) | SEQ ID NO:139 |
| CASP2_4_S5 | 5'-I GCCAGAAUGUGGAACUC<u>c</u>U (20) | SEQ ID NO:139 |
| CASP2_4_S6 | 5'-I GCCAGAAUGUGGAACU<u>cc</u>U (20) | SEQ ID NO:139 |

| Oligo Name | Set5- AS strands (5'-3') | SEQ ID No. |
|---|---|---|
| CASP2_4_AS18 | 5'- A<u>GGAGU</u>ab<u>CC</u>AC<u>AUUC</u>U<u>GGC</u> (19) | SEQ ID NO:140 |
| CASP2_4_AS19 | 5'- A<u>GGAGUU</u>ab<u>C</u>AC<u>AUUC</u>U<u>GGC</u> (19) | SEQ ID NO:140 |
| CASP2_4_AS20 | 5'- A<u>GGAGUUC</u>ab<u>AC</u>AU<u>UC</u>U<u>GGC</u> (19) | SEQ ID NO:140 |
| CASP2_4_AS21 | 5'- A<u>GGAGUUCC</u>ab<u>C</u>AU<u>UC</u>U<u>GGC</u> (19) | SEQ ID NO:140 |
| CASP2_4_AS22 | 5'- A<u>GGAGUUCCA</u>ab<u>AUUCUGGC</u> (19) | SEQ ID NO:140 |
| CASP2_4_AS23 | 5'- A<u>GGAGUUCCAC</u>ab<u>UUCUGGC</u> (19) | SEQ ID NO:140 |
| CASP2_4_AS24 | 5'- A<u>GGAGUUC</u>C<u>AC</u>Aab<u>UCUGGC</u> (19) | SEQ ID NO:140 |

Figure 20F

| Oligo Name | Set6-Sense strand(5'>3') | SEQ ID No. |
|---|---|---|
| CASP2_4_S0 | 5'-GCCAGAAUGUGGAACUCCU (19) | SEQ ID NO:139 |

| Oligo Name | Set6- AS strands (5'-3') | SEQ ID No. |
|---|---|---|
| CASP2_4_AS0 | 5'- AGGAGUUCCACAUUCUGGC (19) | SEQ ID NO:140 |
| CASP2_4_AS1 | 5'- AGGAabUUCCACAUUCUGGC (19) | SEQ ID NO:140 |
| CASP2_4_AS2 | 5'- AGGAGabUCCACAUUCUGGC (19) | SEQ ID NO:140 |
| CASP2_4_AS3 | 5'- AGGAGUUCCACAUUabUGGC (19) | SEQ ID NO:140 |
| CASP2_4_AS4 | 5'- AGGAGUUCCACAUabCUGGC (19) | SEQ ID NO:140 |
| CASP2_4_AS18 | 5'- AGGAGUabCCACAUUCUGGC (19) | SEQ ID NO:140 |
| CASP2_4_AS19 | 5'- AGGAGUUabCACAUUCUGGC (19) | SEQ ID NO:140 |
| CASP2_4_AS20 | 5'- AGGAGUUCabACAUUCUGGC (19) | SEQ ID NO:140 |
| CASP2_4_AS21 | 5'- AGGAGUUCCabCAUUCUGGC (19) | SEQ ID NO:140 |
| CASP2_4_AS22 | 5'- AGGAGUUCCAabAUUCUGGC (19) | SEQ ID NO:140 |
| CASP2_4_AS23 | 5'- AGGAGUUCCACabUUCUGGC (19) | SEQ ID NO:140 |
| CASP2_4_AS24 | 5'- AGGAGUUCCACAabUCUGGC (19) | SEQ ID NO:140 |

Figure 20G

| Oligo Name | Set7-Sense strands(5'>3') | SEQ ID No. |
|---|---|---|
| CASP2_4_S1 | 5'-GCCAGAAUGUGGAACUCcU (19) | SEQ ID NO:139 |
| CASP2_4_S2 | 5'-GCCAGAAUGUGGAACUccU (19) | SEQ ID NO:139 |
| CASP2_4_S3 | 5'-5G CCAGAAUGUGGAACUCcU (19) | SEQ ID NO:139 |
| CASP2_4_S4 | 5'-5G CCAGAAUGUGGAACUccU (19) | SEQ ID NO:139 |
| CASP2_4_S5 | 5'-I GCCAGAAUGUGGAACUCcU (20) | SEQ ID NO:139 |
| CASP2_4_S6 | 5'-I GCCAGAAUGUGGAACUccU (20) | SEQ ID NO:139 |

| Oligo Name | Set7- AS strand (5'-3') | SEQ ID No. |
|---|---|---|
| CASP2_4_AS0 | 5'- AGGAGUUCCACAUUCUGGC (19) | SEQ ID NO:140 |

Figure 21

| Monomer name/ alias | Structure | Base pairing capability | Availability/ supplier | Citations/references |
|---|---|---|---|---|
| 6 des amino adenosine/ Nebularine | Nebularine | 1H bond could be possible | Chem Genes ANP-7601 | |
| 4-Me-indole | 4-Methylindole | None | Glen Research 10-1045-90 | |
| 3-nitropyrrole | 3-nitropyrrole | None | Glen Research 10-1043-90 | |
| 5-nitroindole | 5-Nitroindole | None | Glen Research 10-1044-90 | |
| Ds | dS | None | Glen Res 10-1521-90 | http://www.glenresearch.com/GlenReports/GR20-11.html or Hirao Nature Methids, 2006,3729-35 |
| Pa | dP | None | Glen Res10-1523-90 | http://www.glenresearch.com/GlenReports/GR20-11.html or Hirao Nature Methids, 2006,3729-35 |
| N3-Me ribo U | N3-Me-riboU | Probably none due to steric hindrance of Me group | Chem Genes ANP-7451 | |

Figure 21 cont.

| Monomer name/ alias | Structure | Base pairing capability | Availability/ supplier | Citations/references |
|---|---|---|---|---|
| N3-Me riboT | 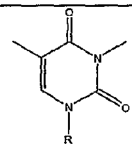 | Probably none due to steric hindrance of Me group | Chem Genes ANP-7461 | |
| N3-Me dC | | Probably none due to steric hindrance of Me group | Chem Genes ANP3851 | |
| N3-Me-dT | 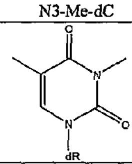 | Probably none due to steric hindrance of Me group | Chem Genes ANP3856 | Nature 419,178, 2002 |
| N1-Me-dG | 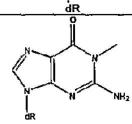 | Probably none due to steric hindrance of Me group | Chem Genes ANP6122 | Nature 419,178, 2002 |
| N1-Me-dA | 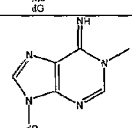 | Probably none due to steric hindrance of Me group | Chem Genes ANP-6121 | Nature 419,178, 2002 |
| N3-ethyl-dC | 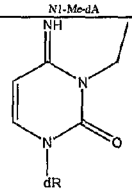 | Probably none due to steric hindrance of Me group | Chem Genes ANP3856 | Nature 419,178, 2002 BBA ,823,111,1985 NAR ,20,6471,1992 |
| N3-Me dC | | Probably none due to steric hindrance of Et group | Chem Genes ANP3851 | Nature 419,178, 2002 BBA ,823,111,1985 NAR ,20,6471,1992 |

FIG. 23

| ID | Sense | AntiSense | Activity at 20nM (% of control) | IC50 (nM) | Stability in hum-serum |
|---|---|---|---|---|---|
| Q-001 | rG;rA;rG;rA;rA;rA;rA;rU;rU;rC;rG;rC;rA;LdA;LdA;LdA;dT$ (SEQ ID No. 87185) | rU;rU;rU;rU;rG;rC;rG;rA;rA;rU;rU;rU;rU;rC;LdT;LdT;LdC;dT$ (SEQ ID No. 87186) | 100 | | 10 |
| Q-002 | LdG;LdA;LdA;rG;rA;rA;rA;rA;rU;rU;rC;rG;rC;rA;rA;rA;rA;dT$ (SEQ ID No. 87185) | rU;rU;rU;rU;rG;rC;rG;rA;rA;rU;rU;rU;rU;rC;LdT;LdC;dT$ (SEQ ID No. 87186) | 100 | | |
| Q-003 | LdG;LdA;LdA;rG;rA;rA;rA;rA;rU;rU;rC;rG;rC;rA;LdA;LdA;LdA;dT$ (SEQ ID No. 87185) | rU;rU;rU;rU;rG;rC;rG;rA;rA;rU;rU;rU;rU;rC;LdT;LdC;dT$ (SEQ ID No. 87186) | 100 | | |
| Q-004 | rG;mA;rA;mG;rA;mA;rA;mA;rU;mU;rU;mC;rC;mG;rC;mA;rA;mA;rA$ (SEQ ID No. 87179) | rU;rU;rU;rU;rG;rC;rG;rA;rA;rU;rU;rU;rU;rC;rU;rU;rC;dT$ (SEQ ID No. 87186) | 100 | | |
| Q-005 | rG;rA;rA;rG;rA;rA;rA;rA;rU;rU;rC;rG;rC;rA;LdA;LdA;LdA;dT$ (SEQ ID No. 87185) | LdT;LdT;LdT;LdT;rU;rG;rC;rG;rA;rA;rU;rU;rU;rU;rC;rU;rC;dT$ (SEQ ID No. 87186) | 89 | | |
| Q-006 | LdG;LdA;LdA;rG;rA;rA;rA;rA;rU;rU;rC;rG;rC;rA;rA;rA;rA;dT (SEQ ID No. 87185) | LdT;LdT;LdT;LdT;rU;rG;rC;rG;rA;rA;rU;rU;rU;rU;rC;rU;rC;dT$ (SEQ ID No. 87186) | 84 | | |
| Q-007 | LdG;LdA;LdA;rG;rA;rA;rA;rA;rU;rU;rC;rG;rC;rA;LdA;LdA;LdA;dT (SEQ ID No. 87185) | LdT;LdT;LdT;LdT;rU;rG;rC;rG;rA;rA;rU;rU;rU;rU;rC;rU;rU;rC;dT$ (SEQ ID No. 87186) | 100 | | |
| Q-008 | rG;mA;rA;mG;rA;mA;rA;mA;rU;mU;rU;mC;rC;mG;rC;mA;rA;mA;rA$ (SEQ ID No. 87179) | LdT;LdT;LdT;LdT;rU;rG;rC;rG;rA;rA;rU;rU;rU;rU;rC;LdT;LdT;LdC;dT (SEQ ID No. 87186) | 92 | | |
| Q-009 | rG;rA;rA;rG;rA;rA;rA;rA;rU;rU;rC;rG;rC;rA;LdA;LdA;LdA;dT (SEQ ID No. 87185) | mU;rU;mU;rU;mG;rU;mG;rC;mG;rA;mA;rA;mA;rU;mU;rU;mU;rC;mU;rU;mC;dT$ (SEQ ID No. 87186) | 17 | | 3 |
| Q-010 | LdG;LdA;LdA;rG;rA;rA;rA;rA;rU;rU;rC;rG;rC;rA;rA;rA;rA;dT (SEQ ID No. 87185) | LdT;LdT;LdT;LdT;rU;rG;rC;rG;rA;rA;rU;rU;rU;rU;rC;LdT;LdT;LdC;dT$ (SEQ ID No. 87186) | 100 | | |
| Q-011 | LdG;LdA;LdA;rG;rA;rA;rA;rA;rU;rU;rC;rG;rC;rA;rA;rA;rA;dT (SEQ ID No. 87185) | mU;rU;mU;rU;mG;rU;mG;rC;mG;rA;mA;rA;mA;rU;mU;rU;mU;rC;mU;rU;mC;dT$ (SEQ ID No. 87186) | 74 | | |
| Q-012 | LdG;LdA;LdA;rG;rA;rA;rA;rA;rU;rU;rC;rG;rC;rA;LdA;LdA;LdA;dT (SEQ ID No. 87185) | mU;rU;mU;rU;mG;rU;mG;rC;mG;rA;mA;rA;mA;rU;mU;rU;mU;rC;mU;rU;mC;dT$ (SEQ ID No. 87186) | 100 | | |
| Q-013 | LdG;LdA;LdA;rG;rA;rA;rA;rA;rU;rU;rC;rG;rC;rA;LdA;LdA;LdA;dT (SEQ ID No. 87185) | LdT;LdT;LdT;LdT;rU;rG;rC;rG;rA;rA;rU;rU;rU;rU;rC;LdT;LdT;LdC;dT (SEQ ID No. 87186) | 74 | | |
| Q-014 | LdG;LdA;LdA;rG;rA;rA;rA;rA;rU;rU;rC;rG;rC;rA;LdA;LdA;LdA;dT (SEQ ID No. 87185) | mU;rU;mU;rU;mG;rU;mG;rC;mG;rA;mA;rA;mA;rU;mU;rU;mU;rC;mU;rU;mC;dT$ (SEQ ID No. 87186) | 82 | | |
| Q-015 | rG;mA;rA;mG;rA;mA;rA;mA;rU;mU;rU;mC;rC;mG;rC;mA;rA;mA;rA$ (SEQ ID No. 87179) | LdT;LdT;LdT;LdT;rU;rG;rC;rG;rA;rA;rU;rU;rU;rU;rC;LdT;LdT;LdC;dT (SEQ ID No. 87186) | 25 | | 0 |
| Q-016 | rG;rA;rA;rG;rA;rA;rA;rA;rU;rU;rC;rG;rC;rA;rA;rA;rA (SEQ ID No. 87179) | rU;mU;rU;mU;rG;rC;rG;rA;rA;rU;rU;rU;rU;rC;rU;rU;rC (SEQ ID No. 87180) | 100 | | |
| Q-017 | rG;rA;rA;rG;rA;rA;rA;rA;rU;rU;rC;rG;rC;rA;rA;rA;rA (SEQ ID No. 87179) | rU;rU;rU;rU;rG;rC;rG;rA;rG;rA;rA;rU;rU;rU;rU;rC;mU;mU;mC (SEQ ID No. 87180) | 12 | | 24 |
| Q-018 | rG;rA;rA;rG;rA;rA;rA;rA;rU;rU;rC;rG;rC;rA;rA;rA;rA (SEQ ID No. 87179) | mU;rU;rU;rU;rG;rC;rG;rA;rG;rA;rA;rU;rU;rU;rU;rC;mU;mU;mC (SEQ ID No. 87180) | 40 | | 24 |

FIG. 23 Continued

| ID | Sense | AntiSense | Activity at 20nM (% of control) | IC50 (nM) | Stability in human serum |
|---|---|---|---|---|---|
| Q-019 | mG;mA;mA;mG;mA;rA;A;rA;rU;rU;rC;rG;rU;rC;rC;rA;rA;rA (SEQ ID No. 87179) | rU;mU;rU;rG;rC;rG;rA;rA;rA;rU;rU;rU;rU;rU;rC;rU;rU;rC (SEQ ID No. 87180) | 10 | | |
| Q-020 | mG;mA;mA;mG;mA;rA;A;rA;rU;rU;rC;rG;rU;rC;rC;rA;rA;rA (SEQ ID No. 87179) | rU;rU;rU;rG;rC;rG;rA;rA;rA;rU;rU;rU;mU;mC;mU;mC (SEQ ID No. 87180) | 13 | 0.977 | |
| Q-021 | mG;mA;mA;mG;mA;rA;rA;rA;rU;rU;rC;rG;rU;rC;rC;rA;rA;rA (SEQ ID No. 87179) | mU;mU;rU;rG;rC;rG;rA;rA;rA;rU;rU;rU;rU;rU;rC (SEQ ID No. 87180) | 16 | | |
| Q-022 | mG;mA;mA;mG;mA;mA;mA;mA;rU;rU;rC;rG;rU;rC;rC;rA;rA;rA (SEQ ID No. 87179) | rU;rU;rU;rG;rC;rG;rA;rA;rA;rU;rU;rU;mU;mC;mU;mC (SEQ ID No. 87180) | 40 | | |
| Q-023 | mG;mA;mA;mG;mA;mA;mA;mA;mA;mA;rU;rC;rG;rU;rC;rC;rA;rA;rA (SEQ ID No. 87179) | rU;rU;rU;rG;rC;rG;rA;rA;rA;rU;rU;rU;mU;mC;mU;mC (SEQ ID No. 87180) | 14 | 0.913 | |
| Q-024 | mG;mA;mA;mG;mA;mA;mA;mA;mA;mA;rU;rC;rG;rU;rC;rC;rA;rA;rA (SEQ ID No. 87179) | mU;mU;rU;rG;rC;rG;rA;rA;rA;rU;rU;rU;rU;rU;rC (SEQ ID No. 87180) | 52 | | |
| Q-025 | mG;mA;mA;mG;mA;mA;mA;mA;mA;mU;mU;mC;rG;rU;rC;rC;rA;rA;rA (SEQ ID No. 87179) | rU;rU;rU;rG;rC;rG;rA;rA;rA;rU;rU;rU;mU;mC;mU;mC (SEQ ID No. 87180) | 35 | | |
| Q-026 | mG;mA;mA;mG;mA;mA;mA;mA;mA;mU;mU;mC;mC;rG;rU;rC;rC;rA;rA;rA (SEQ ID No. 87179) | mU;mU;rU;rG;rC;rG;rA;rA;rA;rU;rU;rU;mU;mC;mU;mC (SEQ ID No. 87180) | 11 | 0.871 | |
| Q-027 | mG;mA;mA;mG;mA;mA;mA;mA;mA;mU;mU;mC;mC;mC;rG;rU;rC;rA;rA;rA (SEQ ID No. 87179) | mU;mU;rU;rG;rC;rG;rA;rA;rA;rU;rU;rU;rU;rU;rC (SEQ ID No. 87180) | 44 | | |
| Q-028 | rG;rA;rA;rG;rA;rA;rA;rA;rU;rU;rC;rG;rU;rC;rC;rA;rA2p;rA2p;dT$ (SEQ ID No. 87185) | rU;rU;rU;rG;rC;rG;rA;rA;rA;rU;rU;rU;rU;rU;rC;rU2p;rC2p;dT$ (SEQ ID No. 87186) | 6 | | 16 |
| Q-029 | rG2p;rA2p;rA2p;rG;rA;rA;rA;rA;rU;rU;rC;rG;rU;rC;rC;rA;rA;rA;dT$ (SEQ ID No. 87185) | rU;rU;rU;rG;rC;rG;rA;rA;rA;rU;rU;rU;rU;rU;rC;rU2p;rC2p;dT$ (SEQ ID No. 87186) | 3 | | 6 |
| Q-030 | rG2p;rA2p;rA2p;rG;rA;rA;rA;rA;rU;rU;rC;rG;rU;rC;rC;rA;rA2p;rA2p;rA2p;dT$ (SEQ ID No. 87185) | rU;rU;rU;rG;rC;rG;rA;rA;rA;rU;rU;rU;rU;rU;rC;rU2p;rC2p;dT$ (SEQ ID No. 87186) | 9 | | 3 |
| Q-031 | rG;rA;rA;rG;rA;rA;rA;rA;rU;rU;rC;rG;rU;rC;rC;rA;rA;rA;dT (SEQ ID No. 87185)$ | rU;rU;rU;rG;rC;rG;rA;rA;rA;rU;rU;rU;rU;rU;rC;rU2p;rC2p;dT$ (SEQ ID No. 87186) | 20 | | |
| Q-032 | rG;rA;rA;rG;rA;rA;rA;rA;rU;rU;rC;rG;rU;rC;rC;rA;rA2p;rA2p;dT$ (SEQ ID No. 87185) | rU2p;rU2p;rU2p;rG;rC;rG;rA;rA;rA;rU;rU;rU;rU;rU;rC;rU;rU;rC;dT$ (SEQ ID No. 87186) | 100 | | |
| Q-033 | rG2p;rA2p;rA2p;rG;rA;rA;rA;rA;rU;rU;rC;rG;rU;rC;rC;rA;rA;rA;dT$ (SEQ ID No. 87185) | rU2p;rU2p;rU2p;rG;rC;rG;rA;rA;rA;rU;rU;rU;rU;rU;rC;rU;rU;rC;dT$ (SEQ ID No. 87186) | 100 | | |
| Q-034 | rG2p;rA2p;rA2p;rG;rA;rA;rA;rA;rU;rU;rC;rG;rU;rC;rC;rA;rA2p;rA2p;dT$ (SEQ ID No. 87185) | rU2p;rU2p;rU2p;rG;rC;rG;rA;rA;rA;rU;rU;rU;rU;rU;rC;rU;rU;rC;dT$ (SEQ ID No. 87186) | 100 | | |
| Q-035 | rG;rA;rA;rG;rA;rA;rA;rA;rU;rU;rC;rG;rU;rC;rC;rA;rA;rA;dT$ (SEQ ID No. 87185) | rU2p;rU2p;rU2p;rG;rC;rG;rA;rA;rA;rU;rU;rU;rU;rU;rC;rU;rU;rC;dT$ (SEQ ID No. 87186) | 54 | | |
| Q-036 | rG;rA;rA;rG;rA;rA;rA;rA;rU;rU;rC;rG;rU;rC;rC;rA;rA2p;rA2p;dT$ (SEQ ID No. 87185) | rU2p;rU2p;rU2p;rG;rC;rG;rA;rA;rA;rU;rU;rU;rU;rU;rC;rU2p;rC2p;dT$ (SEQ ID No. 87186) | 100 | | |

FIG. 23 Continued

| ID | Sense | AntiSense | Activity at 20nM (% of control) | IC50 (nM) | Stability in human serum |
|---|---|---|---|---|---|
| Q-037 | rG;rA;rA;rG;rA;rA;rU;rU;rG;rC;rC;rG;rC;rA;rA2p;rA2p; dT$ (SEQ ID No. 87185) | mU;rU;mU;rU;mG;rG;mC;rC;mG;rG;mA;rA;mA;rU;mU;rU;mU;rU;mC; dT$ (SEQ ID No. 87186) | 10 | 0.41 | 8 |
| Q-038 | rG2p;rU2p;rA2p;rG;rA;rA;rU;rU;rG;rC;rC;rG;rC;rA;rA;rA; dT$ (SEQ ID No. 87185) | rU2p;rU2p;rU2p;rU;rU;rG;rG;rC;rC;rG;rG;rA;rA;rU;rU2p;rU2p;rC 2p;dT$ (SEQ ID No. 87186) | 70 | | |
| Q-039 | rG2p;rA2p;rA2p;rG;rA;rA;rU;rU;rG;rC;rC;rG;rC;rA;rA;rA; dT$ (SEQ ID No. 87185) | mU;mU;mU;rU;mU;rG;rG;mC;mG;rG;mA;rA;mA;rU;mU;rU;mU;mC$ (SEQ ID No. 87180) | 2 | | 8-10 |
| Q-040 | rG2p;rA2p;rA2p;rG;rA;rA;rA;rU;rU;rG;rC;rC;rG;rC;rA;rA2 p;rA2p;dT$ (SEQ ID No. 87185) | rU2p;rU2p;rU2p;rU;rU;rG;rG;rC;rG;rG;rA;rA;rA;rU;rU2p;rU2p;rC 2p;dT$ (SEQ ID No. 87186) | 100 | | |
| Q-041 | rG;rA;rG;rA;rA;rA;rU;rU;rG;rC;rC;rG;rC;rA;rA;rA;dT$ (SEQ ID No. 87185) | rU2p;rU2p;rU2p;rU;rG;rC;rG;rG;rA;rA;rA;rU;rU;rU2p;rU2p;rC 2p;dT$ (SEQ ID No. 87186) | 100 | | |
| Q-042 | rG2p;rA2p;rG;rA;rA;rA;rU;rU;rC;rC;rG;rC;rA;rA2p;rA2p;rA2 p;A2p;dT$ (SEQ ID No. 87185) | mU;rU;mU;rU;mG;rC;mG;rG;mA;rA;mA;rU;mU;rU;mU;rU;mC$ (SEQ ID No. 87180) | 15 | | 10-24 |
| Q-043 | rG;mA;rA;mG;rA;mA;rU;mU;rC;mC;rC;mG;rC;mA;rA;mA;r A;rA;dT$ (SEQ ID No. 87185) | mU;rU;mU;rU;mU;rG;mG;rC;mG;rG;mA;rA;mA;rU;mU;rU;mU;rU;mC$ (SEQ ID No. 87180) | 1 | | |
| Q-044 | rG;mG;rA;mA;rG;mA;rA;mA;rU;mU;rC;mC;rC;mG;rC;mG;r C;mA;rA;mA;rA (SEQ ID No. 87181) | mU;rG;mU;rU;mG;rG;mC;rC;mG;rG;mA;rA;mA;rU;mU;rU;mU;rU;mC;r U;mU;rC;mC (SEQ ID No. 87182) | 7 | 0.29 | 24 |
| Q-045 | rG;mG;rA;mA;rG;mA;rA;mA;rU;mU;rC;mC;rC;mG;rC;mG;r C;mA;rA;mA;rA (SEQ ID No. 87181) | mU;rU;mU;rU;mU;rG;mC;rG;mG;rA;mA;rA;mU;rU;mU;rU;mU;rU;mU;r C;mU;rU;mC (SEQ ID No. 87182) | 100 | | |
| Q-046 | rG;mA;rA;mG;rA;mA;rA;mU;rU;mC;rC;mG;rC;mA;rA;mC;r A;mA;rA;mA;rA (SEQ ID No. 87183) | mU;rU;mU;rU;mU;rG;mC;rG;mG;rA;mA;rA;mU;rU;mU;rU;mU;rU;mU;r U;mU;rC;mC (SEQ ID No. 87184) | 5 | | |
| Q-047 | rG;mA;rA;mG;rA;mA;rA;mU;rU;mC;rC;mG;rC;mA;rA;mC;r A;mA;rA;mA;rA (SEQ ID No. 87183) | mU;rU;mU;rU;mU;rU;mU;rG;mC;rG;mG;rA;mA;rA;mU;rU;mU;rU;mU;r C;mU;rU;mC (SEQ ID No. 87184) | 5 | 0.386 | 24 |
| Q-048 | rG;rA;rG;rA;rA;rA;rU;rU;rC;rC;rG;rC;rA;inaA;inaA;inaA; T$ (SEQ ID No. 87185) | rU;rU;rU;rU;rU;rG;rC;rG;rA;rA;rA;rU;rU;rU;rC;inaT;inaC;dT$ (SEQ ID No. 87186) | 69 | | |
| Q-049 | inaG;inaA;inaA;rG;rA;rA;rA;rU;rU;rC;rC;rG;rC;rA;rA;rA;rA;d T$ (SEQ ID No. 87185) | rU;rU;rU;rU;rU;rG;rC;rG;rA;rA;rA;rU;rU;rU;rC;inaT;inaC;dT$ (SEQ ID No. 87186) | 66 | | |
| Q-050 | inaG;inaA;inaA;rG;rA;rA;rA;rU;rU;rC;rC;rG;rC;rA;inaA; inaA;dT$ (SEQ ID No. 87179) | rU;rU;rU;rU;rU;rG;rC;rG;rA;rA;rA;rU;rU;rU;rC;inaT;inaC;dT$ (SEQ ID No. 87186) | 51 | | |
| Q-051 | rG;mA;rA;mG;rA;mA;rA;mA;rU;mU;rC;mC;rG;mG;rC;mA;rA;mA;r A$ (SEQ ID No. 87179) | rU;rU;rU;rU;rU;rG;rC;rG;rA;rA;rA;rU;rU;rU;rC;inaT;inaC;dT$ (SEQ ID No. 87186) | 51 | | |
| Q-052 | rG;rA;rG;rA;rA;rA;rU;rU;rC;rC;rG;rC;rA;inaA;inaA;inaA; T$ (SEQ ID No. 87185) | inaT;inaT;inaT;rU;rG;rC;rG;rA;rA;rA;rU;rU;rU;rU;rC;rU;rC;dT$ (SEQ ID No. 87186) | 68 | | |
| Q-053 | inaG;inaA;inaA;rG;rA;rA;rA;rU;rU;rC;rC;rG;rC;rA;rA;rA;rA;d T$ (SEQ ID No. 87185) | inaT;inaT;inaT;rU;rG;rC;rG;rA;rA;rA;rU;rU;rU;rU;rC;rU;rC;dT$ (SEQ ID No. 87186) | 80 | | |
| Q-054 | inaG;inaA;inaA;rG;rA;rA;rA;rU;rU;rC;rC;rG;rC;rA;inaA;inaA; inaA;dT$ (SEQ ID No. 87185) | inaT;inaT;inaT;rU;rG;rC;rG;rA;rA;rA;rU;rU;rU;rU;rC;rU;rC;dT$ (SEQ ID No. 87186) | 69 | | |

FIG. 23 Continued

| ID | Sense | AntiSense | Activity at 20nM (% of control) | IC50 (nM) | Stability in human serum |
|---|---|---|---|---|---|
| Q-055 | rG;mA;rA;mG;rA;mA;rA;mA;rU;mU;rC;mC;rG;mC;mA;rA;mA;rA$ (SEQ ID No. 87179) | lnaT;lnaT;lnaT;rU;rG;rC;rG;rA;rA;rA;rU;rU;rU;rC;rU;rU;rC;dT$ (SEQ ID No. 87186) | 64 | | |
| Q-056 | rG;rA;rA;rG;rA;rA;rA;rA;rU;rU;rC;rC;rG;rC;rA;lnaA;lnaA;lnaA;dT$ (SEQ ID No. 87185) | lnaT;lnaT;lnaT;rU;rG;rC;rG;rA;rA;rA;rU;rU;rU;rC;lnaT;lnaT;lnaC;dT$ (SEQ ID No. 87186) | 56 | | |
| Q-057 | rG;rA;rA;rG;rA;rA;rA;rA;rU;rU;rC;rC;rG;rC;rA;lnaA;lnaA;lnaA;dT$ (SEQ ID No. 87185) | mU;rU;mU;rU;mG;rC;mG;rA;mA;rA;mA;rU;mU;rU;mU;rC;mU;rU;mC$ (SEQ ID No. 87180) | 4 | 0.23 | 0 |
| Q-058 | lnaG;lnaA;lnaA;rG;rA;rA;rA;rA;rU;rU;rC;rC;rG;rC;rA;rA;rA;rA;dT$ (SEQ ID No. 87186) | lnaT;lnaT;lnaT;rU;rG;rC;rG;rA;rA;rA;rU;rU;rU;rC;lnaT;lnaT;lnaC;dT$ (SEQ ID No. 87186) | 62 | | |
| Q-059 | lnaG;lnaA;lnaA;rG;rA;rA;rA;rA;rU;rU;rC;rC;rG;rC;rA;rA;rA;rA;dT$ (SEQ ID No. 87186) | mU;rU;mU;rU;mG;rC;mG;rA;mA;rA;mA;rU;mU;rU;mU;rC;mU;rU;mC$ (SEQ ID No. 87180) | 9,4 | 0.18 | 0 |
| Q-060 | lnaG;lnaA;lnaA;rG;rA;rA;rA;rA;rU;rU;rC;rC;rG;rC;rA;lnaA;lnaA;lnaA;dT$ (SEQ ID No. 87185) | lnaT;lnaT;lnaT;rU;rG;rC;rG;rA;rA;rA;rU;rU;rU;rC;lnaT;lnaT;lnaC;dT$ (SEQ ID No. 87186) | 51 | | |
| Q-061 | rG;mA;rA;mG;rA;mA;rA;mA;rU;mU;rC;mC;rG;mC;rA;mA;rA;mA;rA$ (SEQ ID No. 87179) | lnaT;lnaT;lnaT;rU;rG;rC;rG;rA;rA;rA;rU;rU;rU;rC;lnaT;lnaT;lnaC;dT$ (SEQ ID No. 87186) | 55 | | |
| Q-062 | lnaG;lnaA;lnaA;rG;rA;rA;rA;rA;rU;rU;rC;rC;rG;rC;rA;lnaA;lnaA;lnaA;dT$ (SEQ ID No. 87185) | mU;rU;mU;rU;mG;rC;mG;rA;mA;rA;mA;rU;mU;rU;mU;rC;mU;rU;mC$ (SEQ ID No. 87180) | 2 | 0.22 | 0 |
| Q-063 | LdG;LdA;rA;rG;rA;rA;rA;rA;rU;rU;rC;rC;rG;rC;rA;rA;LdA;LdA;dT$ (SEQ ID No. 87185) | rU;rU;rU;rU;rG;rC;rG;rA;rA;rA;rU;rU;rU;rC;rU;rU;LdC;dT$ (SEQ ID No. 87186) | 14,5 | 0.091 | 10 |
| Q-064 | LdG;LdA;rA;rG;rA;rA;rA;rA;rU;rU;rC;rC;rG;rC;rA;rA;LdA;LdA;dT$ (SEQ ID No. 87185) | rU;rU;rU;rU;rG;rC;rG;rA;rA;rA;rU;rU;rU;rC;rU;rU;LdC;dT$ (SEQ ID No. 87186) | 10 | | 1 |
| Q-065 | LdG;LdA;rA;rG;rA;rA;rA;rA;rU;rU;rC;rC;rG;rC;rA;rA;LdA;LdA;dT$ (SEQ ID No. 87185) | rU;rU;rU;rU;rG;rC;rG;rA;rA;rA;rU;rU;rU;rC;rU;rU;LdC;dT$ (SEQ ID No. 87186) | 16 | | 0 |
| Q-066 | rG;rA;rA;rG;rA;rA;rA;rA;rU;rU;rC;rC;rG;rC;rA;rA;rA;rA;dT$ (SEQ ID No. 87186) | rU;rU;rU;rU;rG;rC;rG;rA;rA;rA;rU;rU;rU;rC;rU;rU;LdC;dT$ (SEQ ID No. 87186) | 54 | | |
| Q-067 | rG;rA;rA;rG;rA;rA;rA;rA;rU;rU;rC;rC;rG;rC;rA;rA;LdA;LdA;dT$ (SEQ ID No. 87185) | LdT;rU;rU;rU;rG;rC;rG;rA;rA;rA;rU;rU;rU;rC;rU;rU;rC;dT$ (SEQ ID No. 87186) | 24 | | |
| Q-068 | LdG;LdA;rA;rG;rA;rA;rA;rA;rU;rU;rC;rC;rG;rC;rA;rA;rA;rA;dT$ (SEQ ID No. 87186) | LdT;rU;rU;rU;rG;rC;rG;rA;rA;rA;rU;rU;rU;rC;rU;rU;rC;dT$ (SEQ ID No. 87186) | 30 | | |
| Q-069 | LdG;LdA;rA;rG;rA;rA;rA;rA;rU;rU;rC;rC;rG;rC;rA;rA;LdA;LdA;dT$ (SEQ ID No. 87185) | LdT;rU;rU;rU;rG;rC;rG;rA;rA;rA;rU;rU;rU;rC;rU;rU;rC;dT$ (SEQ ID No. 87186) | 47 | | |
| Q-070 | rG;rA;rA;rG;rA;rA;rA;rA;rU;rU;rC;rC;rG;rC;rA;rA;rA;rA;dT$ (SEQ ID No. 87186) | LdT;rU;rU;rU;rG;rC;rG;rA;rA;rA;rU;rU;rU;rC;rU;rU;rC;dT$ (SEQ ID No. 87186) | 32 | | |
| Q-071 | rG;rA;rA;rG;rA;rA;rA;rA;rU;rU;rC;rC;rG;rC;rA;rA;LdA;LdA;dT$ (SEQ ID No. 87185) | LdT;rU;rU;rU;rG;rC;rG;rA;rA;rA;rU;rU;rU;rC;rU;rU;LdC;dT$ | 67 | | |
| Q-072 | rG;rA;rA;rG;rA;rA;rA;rA;rU;rU;rC;rC;rG;rC;rA;rA;LdA;LdA;dT$ (SEQ ID No. 87185) | rU;rU;rU;rU;rG;rC;rG;rA;rA;rA;rU;rU;rU;rC;rU;rU;rC;dT$ (SEQ ID No. 87186) | 7,1 | | 3 |

FIG. 23 Continued

| ID | Sense | AntiSense | Activity at 20nM (% of control) | IC50 (nM) | Stability in human serum |
|---|---|---|---|---|---|
| Q-073 | LdG;LdA;rA;rG;rA;rA;rU;rU;rC;rG;rG;rC;rA;rA;rA;rA;dT$ (SEQ ID No. 87185) | LdT;rU;rU;rU;rG;rC;rG;rA;rA;rU;rU;rC;rU;rU;rC;rU;rU;LdC;dT$ (SEQ ID No. 87186) | 66 | | |
| Q-074 | LdG;LdA;rA;rG;rA;rA;rA;rU;rU;rC;rG;rG;rC;rA;rA;rA;rA;dT$ (SEQ ID No. 87185) | rU;rU;rU;rU;rG;rC;rG;rA;rA;rU;rU;rC;rU;rU;rC;rU;rU;rC;dT$ (SEQ ID No. 87186) | 6 | | 0 |
| Q-075 | LdG;LdA;rA;rG;rA;rA;rU;rU;rC;rG;rG;rC;rA;rA;LdA;LdA;dT$ (SEQ ID No. 87185) | LdT;rU;rU;rU;rG;rC;rG;rA;rA;rU;rU;rC;rU;rU;rC;rU;rU;LdC;dT$ (SEQ ID No. 87186) | 77 | | |
| Q-076 | rG;rA;rA;rG;rC;rA;rA;rU;rU;rC;rG;rG;rC;rG;rC;rA;rA;rA;rA;dT$ (SEQ ID No. 87185) | LdT;rU;rU;rU;rG;rC;rG;rA;rA;rU;rU;rC;rU;rU;LdC;dT$ (SEQ ID No. 87186) | 63 | | |
| Q-077 | LdG;LdA;rA;rG;rA;rA;rU;rU;rC;rG;rG;rC;rA;rA;LdA;LdA;dT$ (SEQ ID No. 87185) | rU;rU;rU;rU;rG;rC;rG;rA;rA;rU;rU;rC;rU;rU;rC;rU;rU;rC;dT$ (SEQ ID No. 87186) | 11 | | 0 |
| Q-078 | mG;mA;mA;mG;mA;rG;rA;rA;rA;rU;rU;rC;rG;rC;rA;rA;rA;rA (SEQ ID No. 87183) | rU;mU;rU;rU;rG;rC;rG;rA;rA;rU;rU;rC;rU;rU;rC;rU;rU;rC (SEQ ID No. 87184) | 5 | | 0 |
| Q-079 | mG;mA;mA;mG;mA;rG;rA;rA;rA;rU;rU;rC;rG;rC;rA;rA;rA;rA (SEQ ID No. 87183) | rU;rU;rU;rU;rG;rC;rG;rA;rA;rU;rU;rC;rU;rU;rC;rU;mU;mC;mU;m U;mC (SEQ ID No. 87184) | 7 | | |
| Q-080 | mG;mA;mA;mG;mA;rG;rA;rA;rA;rU;rU;rC;rG;rC;rA;rA;rA;rA (SEQ ID No. 87183) | mU;mU;rU;rU;rG;rC;rG;rA;rA;rU;rU;rC;rU;rU;rC;rU;rU;rC;rU;r C (SEQ ID No. 87184) | 4 | | |
| Q-081 | mG;mA;mA;mG;mA;mA;mG;mA;mA;rA;rU;rA;rU;rC;rG;rC;rA;rC;rG;rC;rA;rA;rA;rA (SEQ ID No. 87183) | rU;rU;rU;rU;rG;rC;rG;rA;rA;rU;rU;rC;rU;rU;rC;rU;rU;rC;mU;m U;mC (SEQ ID No. 87184) | 5 | | 0 |
| Q-082 | mG;mA;mA;mG;mA;mA;mG;mA;mA;mA;mU;mU;rC;rG;rC;rG;rC;rA;rA;rA;rA;rA (SEQ ID No. 87183) | rU;rU;rU;rU;rG;rC;rG;rA;rA;rU;rU;rC;rU;rU;rC;rU;rU;rC;mU;m U;mC (SEQ ID No. 87184) | 11 | | |
| Q-083 | rG;rA;rA;rG;rA;rG;rA;rA;rA;mA;mA;mU;rU;rC;rG;rC;rG;rC;rA;rA;r A;rA;rA (SEQ ID No. 87183) | rU;rU;rU;rU;rG;rC;rG;rA;rA;rU;rU;rC;rU;rU;rC;rU;rU;rC;mU;m U;mC (SEQ ID No. 87184) | 24 | | |
| Q-084 | rG;rA;rA;rG;rA;rA;rA;rA;rU;rA;rU;rC;rG;rC;rG;rC;rA;rA;rA2p;rA2p (SEQ ID No. 87183) | rU;rU;rU;rU;rG;rC;rG;rA;rA;rU;rU;rC;rU;rU;rC;rU;rU;rC;rU2p;rU2 p;rC2p (SEQ ID No. 87184) | 14 | | 0 |
| Q-085 | rG2p;rA2p;rA2p;rA2p;rG;rA;rA;rA;rU;rU;rC;rG;rC;rG;rC;rA;rA;rA;rA (SEQ ID No. 87183) | rU;rU;rU;rU;rG;rC;rG;rA;rA;rU;rU;rC;rU;rU;rC;rU2p;rU2p;rC2 p;rC2p (SEQ ID No. 87184) | 1 | | |
| Q-086 | rG2p;rA2p;rA2p;rA2p;rG;rA;rA;rA;rU;rU;rC;rG;rC;rG;rC;rA;rA;rA;rA (SEQ ID No. 87183) | rU;rU;rU;rU;rG;rC;rG;rA;rA;rU;rU;rC;rU;rU;rC;rU;rU;rC;rU2p;rU 2p;rC2p (SEQ ID No. 87184) | 7 | | |
| Q-087 | rC;mC;rU;mU;rG;mC;rA;mC;rU;mC;rC;mU;mG;mA;rA;mU;rU;mU (SEQ ID No. 87185) | mU;rG;mA;rU;mA;rA;mA;rA;mA;rA;mU;rU;mC;rA;mG;rG;mA;rG;mA;rG;mC;mC;rU (SEQ ID No. 87184) | 16 | | |
| Q-088 | rC;mU;rU;mU;rG;rC;mA;rC;mU;rC;mC;rU;mG;rA;mA;rU;mU;rU (SEQ ID No. 87185) | mU;rU;mG;rA;mU;rA;mA;rA;mA;rA;mU;rU;mC;rA;mG;rG;mA;rG;mC;mC (SEQ ID No. 87184) | 23 | | |
| Q-089 | rU;mU;rU;mG;mC;mA;rC;mU;rC;mC;rU;rG;mA;rA;rU;rU;rU;rA;mU (SEQ ID No. 87185) | mU;rU;mU;rG;mA;rU;mA;rA;rA;mA;rA;mU;rU;mC;rA;mG;rG;mA;rG;mA;rG;mU;r G;mC;rA;mA (SEQ ID No. 87184) | 7 | | |
| Q-090 | rU;mG;rC;mA;rC;mU;rC;mC;rU;mG;rA;mA;rU;rU;rU;rA;rA;rU;mU;rA;mU (SEQ ID No. 87185) | mG;rU;mU;rU;mG;rA;mU;rA;rA;mA;rA;mA;rU;rU;mC;mA;rG;rG;mA;rG;rC;mA;mU (SEQ ID No. 87184) | 30 | | |

FIG. 23 Continued

| ID | Sense | AntiSense | Activity at 20nM (% of control) | IC50 (nM) | Stability in human serum |
|---|---|---|---|---|---|
| Q-091 | rG;mC;rA;mC;rU;mC;rC;mU;rG;mA;rA;mU;rU;mA;rU;mC; rA;mA;rA;mC;rA (SEQ ID No. 275) | mU;rG;mU;rU;mU;rG;mA;rU;mA;rA;mA;rA;mU;mC;rA;mG;rG;mA;r G;mU;rG;mC (SEQ ID No. 276) | 10 | | |
| Q-092 | rC2p;rC2p;rU;rG;rC;rU;rC;rC;rU;rU;rU;rU;rU;rU;rU;rU; rA;rU;rC;rA (SEQ ID No. 267) | mU;rG;mA;rU;mA;rA;mU;mC;rA;mG;rG;mA;rG;mU;rG;mC;r A;mA;rG;mG (SEQ ID No. 268) | 43 | | |
| Q-093 | rC2p;rU2p;rU2p;rG;rC;rA;rC;rU;rC;rC;rU;rU;rU;rU;rA; rU;rC;rA;rA (SEQ ID No. 269) | mU;rU;mG;rA;mA;rA;mA;mU;rC;mA;rG;mG;rA;mG;rU;mG;r C;mA;rA;mG (SEQ ID No. 270) | 52 | | |
| Q-094 | rU2p;rU2p;rG2p;rC;rA;rC;rU;rC;rC;rU;rU;rU;rU;rA;rU; rC;rA;rA;rA (SEQ ID No. 271) | mU;rU;mU;rG;mA;rU;mA;rA;rA;rA;rA;mU;rC;rA;mG;rA;rG;mU;r G;mC;rA;mA (SEQ ID No. 272) | 13 | | 0 |
| Q-095 | rU2p;rG2p;rC;rA;rC;rU;rC;rC;rU;rG;rA;rA;rA;rU;rU;rC; rA;rA;rC (SEQ ID No. 273) | mG;rU;mU;rG;rA;mU;rA;mA;rA;rA;mA;rU;mU;rC;mA;rG;rA;mG;r U;mG;rC;mA (SEQ ID No. 274) | 27 | | |
| Q-096 | rG2p;rC2p;rA2p;rC;rU;rC;rC;rU;rG;rA;rU;rA;rA;rU;rU; rA;rA;rC;rA (SEQ ID No. 275) | mU;rU;mU;rU;mA;rU;mA;rU;mA;rA;rU;mC;rA;mG;rG;mA;r G;mU;rG;mC (SEQ ID No. 276) | 4 | | |
| Q-097 | mC;mC;mU;mG;rC;rA;rC;rU;rC;rC;rU;rG;rA;rU;rA;rA; rU;rU;rA;rA (SEQ ID No. 267) | mU;rU;mG;rA;mU;mA;rA;rU;rU;mC;rA;mG;rG;mA;rG;mU;rG;r A;mA;rA;mG (SEQ ID No. 268) | 31 | | |
| Q-098 | mC;mU;mU;mG;mC;mA;rC;rU;rC;rC;rU;rG;rA;rU;rA;rU; rC;rA;rA (SEQ ID No. 269) | mU;rU;mG;rA;mA;rA;mA;mU;rC;mA;rG;mG;rA;rG;rU;mG;r C;mA;rA;mG (SEQ ID No. 270) | 25 | | |
| Q-099 | mU;rU;mU;mG;mC;mA;rC;rU;rC;rC;rU;rA;rA;rU;rA;rU; C;rA;rA;rU (SEQ ID No. 271) | mU;rU;mU;rG;mA;rU;mA;rA;rU;rU;mC;rA;mU;rU;rC;mA;rG;mU;r G;mC;rA;mA (SEQ ID No. 272) | 9 | | |
| Q-100 | mU;rU;mU;mU;mC;mA;rC;rU;rC;rC;rU;rG;rA;rA;rU;rC;r A;rU;rA;rC (SEQ ID No. 273) | mG;rU;mU;rG;rA;mU;rG;rA;mA;rA;mA;rU;mU;rC;mA;rG;mU;r U;mG;rC;mA (SEQ ID No. 274) | 24 | | |
| Q-101 | mG;rC;mA;mC;mU;rC;rC;rU;rG;rA;rU;rA;rA;rU;rU;rA;rC;rA (SEQ ID No. 275) | mU;rG;mU;rU;mU;rG;mA;rU;mA;rA;mA;rA;rA;mA;rU;mC;rA;mG;rG;mA;r G;mU;rG;mC (SEQ ID No. 276) | 17 | | |
| Q-102 | mC;mC;mU;mU;mG;rC;rA;rC;rU;rC;rC;rU;rG;rA;rU;rA; A;rU;rC;rA (SEQ ID No. 267) | rU;mG;rA;rU;rG;rA;rA;rA;rA;rU;rA;rA;rU;rU;rC;rA;rG;rG;rA;rG;rU;rG;r G (SEQ ID No. 268) | 22 | | |
| Q-103 | mC;mU;mU;mG;mC;rA;rC;rU;rC;rC;rU;rG;rA;rU;rA;rA;r U;rC;rA;rA (SEQ ID No. 269) | rU;mU;rG;rA;rU;rA;rA;rA;rA;rU;rA;rU;rC;rA;rG;rC;rA;rG;rC;rA;rG (SEQ ID No. 270) | 20 | | |
| Q-104 | mU;mU;mG;mC;mA;rC;rU;rC;rC;rU;rG;rA;rU;rA;rA;rU; C;rA;rA;rA (SEQ ID No. 271) | rU;mU;rU;rG;rU;rU;rA;rA;rU;rU;rA;rU;rU;rC;rA;rG;rC;rA;rG;rC;rG;rU;rA (SEQ ID No. 272) | 10 | | |
| Q-105 | mU;mG;mC;mA;mC;rU;rC;rC;rU;rG;rA;rU;rA;rA;rU;rU; A;rA;rC;rA (SEQ ID No. 273) | rG;mU;rU;rU;rG;rU;rU;rA;rU;rA;rU;rC;rA;rG;rA;rG;rA;rG;rU;rG;rC; A (SEQ ID No. 274) | 15 | | |
| Q-106 | mG;mC;mA;mC;mU;mC;rC;rU;rG;rA;rU;rA;rA;rU;rA;rA;r A;rA;rC;rA (SEQ ID No. 275) | rU;mG;rU;rU;rU;rG;rU;rG;rA;rU;rU;rA;rA;rU;rU;rC;rA;rG;rC;rA;rG;rU;rG;r C (SEQ ID No. 276) | 19 | | |
| Q-107 | rC2p;rC2p;rU2p;rG;rC;rA;rC;rU;rC;rC;rU;rG;rA;rA;rU;rU; rA;rU;rC;rA (SEQ ID No. 267) | rU;rG;rA;rU;rA;rA;rU;rU;rC;rA;rG;rG;rA;rG;rU;rG;rC;rA2p;rG2 p;rG2p (SEQ ID No. 268) | 28 | | |
| Q-108 | rC2p;rU2p;rU2p;rG;rC;rA;rC;rU;rC;rC;rU;rG;rA;rU;rU; rU;rU;rA;rA (SEQ ID No. 269) | rU;rU;rG;rU;rU;rU;rA;rU;rC;rA;rG;rC;rG;rA;rG;rU;rG;rC;rA2p;rA2 p;rG2p (SEQ ID No. 270) | 47 | | |

FIG. 23 Continued

| ID | Sense | AntiSense | Activity at 20nM (% of control) | IC50 (nM) | Stability in human serum |
|---|---|---|---|---|---|
| Q-109 | rU2p;rU2p;rG2p;rC;rA;rC;rU;rC;rC;rU;rG;rA;rA;rA;rU;rU;rU;rU;rA;rU; rC;rA;rA;rA (SEQ ID No. 271) | rU;rU;rU;rG;rA;rU;rA;rU;rA;rA;rA;rU;rU;rC;rA;rG;rG;rA;rG;rC2p;rA2 p;rA2p (SEQ ID No. 272) | 9 | | |
| Q-110 | rU2p;rG2p;rC2p;rA;rC;rU;rC;rC;rU;rG;rA;rA;rA;rU;rU;rU;rU;rA;rU;rC; rA;rA;rA;rC (SEQ ID No. 273) | rG;rU;rU;rU;rG;rA;rU;rA;rU;rA;rA;rA;rU;rU;rC;rA;rG;rG;rA;rG;rU;rG2p;rC2 p;rA2p (SEQ ID No. 274) | 22 | | |
| Q-111 | rG2p;rC2p;rA2p;rC;rU;rC;rC;rU;rG;rA;rA;rA;rU;rU;rU;rU;rA;rU;rC;rA; rA;rA;rC;rA (SEQ ID No. 275) | rU;rG;rU;rU;rU;rG;rA;rU;rA;rU;rA;rA;rA;rU;rU;rC;rA;rG;rG;rA;rG;rU2p;rG2 p;rC2p (SEQ ID No. 276) | 20 | | |
| Q-112 | rG;rA;rG;rA;rA;rG;rA;rA;rA;rU;rU;rU;rC;rG;rC;rG;rA;rA;rU;rA2p ;rA2p;rA2p (SEQ ID No. 87183) | mU;rU;mU;rU;mU;rG;mG;rA;mA;rA;mU;rU;mC;rU;mU;r C;mU;rU;mC (SEQ ID No. 87184) | 21 | | |
| Q-113 | rG2p;rA2p;rA2p;rG;rA;rA;rG;rA;rA;rA;rU;rU;rU;rC;rC;rG;rC;rA; rA;rA;rA;rA (SEQ ID No. 87183) | mU;rU;mU;rU;mU;rG;mC;rG;mG;rA;mA;rA;mU;rU;mC;rU;mU;r C;mU;rU;mC (SEQ ID No. 87184) | 6 | 1.2 | 24 |
| Q-114 | rG2p;rA2p;rA2p;rG;rA;rA;rG;rA;rA;rA;rU;rU;rU;rC;rC;rG;rC;rA;rA; rA;rA2p;rA2p (SEQ ID No. 87183) | mU;rU;mU;rU;mU;rG;mC;rG;mG;rA;mA;rA;mU;rU;mC;rU;mU;r C;mU;rU;mC (SEQ ID No. 87184) | 1 | 4.556 | 24 |
| Q-115 | rG;rA;rA;rG;rA;rA;rA;rU;rU;rC;rC;rG;rC;rA;rA2p;rA2p;rA2p (SEQ ID No. 87179) | rU;rU;rU;rG;rC;rG;rA;rU;rU;rU;rC;rU;rU;rC;rU2p;rU2p;rC2p (SEQ ID No. 87180) | 56 | | 8 |
| Q-116 | rG2p;rA2p;rA2p;rG;rA;rA;rA;rU;rU;rC;rC;rG;rC;rA;rA;rA;rA (SEQ ID No. 87179) | rU;rU;rU;rG;rC;rG;rA;rU;rU;rU;rC;rU;rU;rC;rU2p;rU2p;rC2p (SEQ ID No. 87180) | 30 | | 0 |
| Q-117 | rU;rA;rC;rU;rG;rU;rU;rA;rA;rA;rA;rU;rA;rA;rU;rC;rA;rA2p;rA2p; dT$ (SEQ ID No. 87189) | rU;rU;rU;rU;rG;rU;rU;rU;rU;rA;rC;rA;rG;rU2p;rA2p;dT$ (SEQ ID No. 87190) | 41 | | |
| Q-118 | rU2p;rA2p;rC2p;rU;rG;rU;rU;rA;rA;rA;rA;rU;rA;rA;rU;rC;rA;rA;rA; dT$ (SEQ ID No. 87189) | rU;rU;rU;rU;rG;rU;rU;rU;rU;rA;rC;rA;rG;rU2p;rA2p;dT$ (SEQ ID No. 87190) | 75 | | |
| Q-119 | rU;rA;rC;rU;rG;rU;rU;rA;rA;rA;rA;rU;rA;rA;rU;rC;rA;rA2p;rA2p dT$ (SEQ ID No. 87191) | rU;rU;rU;rU;rA;rU;rU;rU;rU;rA;rC;rA;rG;rU2p;rA2p (SEQ ID No. 87192) | 36 | | 0 |
| Q-120 | rU2p;rA2p;rC2p;rU;rG;rU;rU;rA;rA;rA;rA;rU;rA;rA;rC;rA;rA;rA dT$ (SEQ ID No. 87191) | rU;rU;rU;rU;rA;rU;rU;rU;rU;rA;rC;rA;rG;rU2p;rA2p (SEQ ID No. 87192) | 77 | | 0 |
| Q-121 | rG;rC;rC;rA;rG;rA;rA;rU;rU;rG;rA;rA;rA;rU;rC2p;rC2p;rU2p; dT$ (SEQ ID No. 139) | rA;rG;rG;rA;rU;rU;rU;rC;rA;rA;rU;rU;rU;rU;rG;rG2p;rC2p;dT$ (SEQ ID No. 140) | 8 | | 0 |
| Q-122 | rG2p;rC2p;rC2p;rA;rG;rA;rA;rU;rU;rG;rA;rA;rA;rU;rC;rC;rU; dT$ (SEQ ID No. 139) | rA;rG;rG;rA;rU;rU;rU;rC;rA;rA;rU;rU;rU;rU;rG;rG2p;rC2p;dT$ (SEQ ID No. 140) | 8 | | |
| Q-123 | rG;rC;rC;rA;rG;rA;rA;rU;rU;rG;rA;rA;rA;rU;rC;rC;rU;rC2p;rU2p (SEQ ID No. 139) | rA;rG;rG;rA;rU;rU;rU;rC;rA;rA;rU;rU;rU;rU;rG;rG2p;rC2p (SEQ ID No. 140) | 10 | 0.932 | 24 |
| Q-124 | rG2p;rC2p;rC2p;rA;rG;rA;rA;rU;rU;rG;rA;rA;rA;rU;rC;rC;rU (SEQ ID No. 139) | rA;rG;rG;rA;rU;rU;rU;rC;rA;rA;rU;rU;rU;rU;rG;rG2p;rC2p (SEQ ID No. 140) | 16 | 1.7 | 10 |
| Q-125 | mG;mA;mA;mG;rA;rA;rA;rU;rU;rC;rG;rC;mA;mA;mA;mA;mA ;dT$ (SEQ ID No. 87185) | rU;rU;rU;rU;rG;rC;rG;rA;rA;rU;rU;rU;rC;rU2p;rU2p;rC2p;dT$ (SEQ ID No. 87186) | 3 | | |
| Q-126 | mG;mA;mA;mG;rA;rA;rA;rU;rU;rC;rC;rG;rA;rA;rA;rA;mA;mA (SEQ ID No. 87179) | rU;rU;rU;rU;rG;rC;rG;rA;rU;rU;rU;rC;rU;rU;rC;rU2p;rU2p;rC2p (SEQ ID No. 87180) | 26 | | |

FIG. 23 Continued

| ID | Sense | AntiSense | Activity at 20nM (% of control) | IC50 (aM) | Stability in human serum |
|---|---|---|---|---|---|
| Q-127 | rG;rA;rG;rA;rA;rA;rU;mU;rU;rC;rC;rA;rA2p;rA2p;rA2p;dT$ (SEQ ID No. 87185) | rU;mU;rU;rU;rG;rC;rG;rA;rG;rA;rA;rU;rU;rC;rU2p;rU2p;C2p;dT$ (SEQ ID No. 87186) | 58 | | |
| Q-128 | rG;rA;rG;rA;rG;rA;rA;rA;rU;mU;rU;rC;rC;rA;rA2p;rA2p;rA2p;dT$ (SEQ ID No. 87179) | rU;mU;rU;rU;rG;rC;rG;rA;rG;rA;rA;rU;rU;rC;rU2p;rU2p;rC2p (SEQ ID No. 87186) | 100 | | |
| Q-129 | rG2p;rA2p;rA2p;rG;rA;rA;rA;rU;mU;rU;rC;rC;rA;rA2p;rA2p;dT$ (SEQ ID No. 87185) | mU;mU;rU;rU;rG;rC;rG;rA;rG;rA;rA;rU;rU;rC;mU;mU;mC;dT$ (SEQ ID No. 87186) | 100 | | |
| Q-130 | rG2p;rA2p;rA2p;rG;rA;rA;rA;rU;mU;rU;rC;rC;rA;rA2p;rA2p;rA2p (SEQ ID No. 87179) | mU;mU;rU;rU;rG;rC;rG;rA;rG;rA;rA;rU;rU;rC;mU;mU;mC (SEQ ID No. 87180) | 75 | | |
| Q-131 | rG2p;rA2p;rA2p;rA;rA;rA;rA;rU;rU;rU;rC;rC;rC;rA;rA2p;rA2p;dT$ (SEQ ID No. 87185) | mU;mU;rU;rU;rG;rC;rG;rA;rG;rA;rA;rU;rU;rC;mU;mU;mC;dT$ (SEQ ID No. 87186) | 100 | | |
| Q-132 | rG2p;rA2p;rA2p;rG;rA;rA;rA;rU;rU;rU;rC;rC;rA;rA2p;rA2p;rA2p (SEQ ID No. 87179) | mU;mU;rU;rU;rG;rC;rG;rA;rG;rA;rA;rU;rU;rC;mU;mU;mC (SEQ ID No. 87180) | 70 | | |
| Q-133 | rG2p;rA2p;rA2p;rG;rA;rA;rA;rU;mU;rU;rC;rC;rA;rA2p;rA2p;dT$ (SEQ ID No. 87185) | rU;rU;rU;rU;rG;rC;rG;rA;rA;rU;rU;rC;mU;mU;mC;dT$ (SEQ ID No. 87186) | 38 | | |
| Q-134 | rG2p;rA2p;rA2p;rG;rA;rA;rA;rU;mU;rU;rC;rC;rA;rA2p;rA2p;rA2p (SEQ ID No. 87179) | rU;rU;rU;rU;rG;rC;rG;rA;rG;rA;rA;rU;rU;rC;mU;mU;mC (SEQ ID No. 87180) | 29 | | |
| Q-135 | rG;rA;rA;rG;rA;rA;rA;rU;mU;rU;rC;rC;rA;rA2p;rA2p;rA2p;dT$ (SEQ ID No. 87185) | rU;rU;rU;rU;rG;rC;rG;rA;rG;rA;rA;rU;rU;rC;mU;mU;mC;dT$ (SEQ ID No. 87186) | 27 | | |
| Q-136 | rG;rA;rA;rG;rA;rA;rA;rU;mU;rU;rC;rC;rA;rA2p;rA2p;rA2p (SEQ ID No. 87179) | rU;rU;rU;rU;rG;rC;rG;rA;rG;rA;rA;rU;rU;rC;mU;mU;mC (SEQ ID No. 87180) | 15 | | |
| Q-137 | rG;rA;rA;rG;rA;rA;rA;rU;rU;rU;rC;rC;rG;rA;rA2p;rA2p;dT$ (SEQ ID No. 87185) | mU;rU;mU;rU;mG;rC;mG;rA;mA;rA;mA;rU;mU;rU;mC;mU;dT$ (SEQ ID No. 87186) | 6 | | |
| Q-138 | rG;rA;rA;rG;rA;rA;rA;rU;rU;rU;rC;rC;rG;rA;rA2p;rA2p (SEQ ID No. 87179) | mU;rU;mU;rU;mG;rC;mG;rA;mA;rA;mA;rU;mU;rU;mC;mU;mC (SEQ ID No. 87180) | 6 | 0.408 | 24 |
| Q-139 | rG2p;rA2p;rA;rG;rA;rA;rA;rU;rU;rU;rC;rC;rG;rA;rA;rA (SEQ ID No. 87179) | mU;rU;mU;rU;mG;rC;mG;rA;mA;rA;mA;rU;mU;rU;mC;mU;mC (SEQ ID No. 87180) | 6 | | |
| Q-140 | rG2p;rA2p;rA2p;rA;rA;rA;rU;rU;rU;rC;rC;rG;rA;rA;rA (SEQ ID No. 87179) | mU;rU;mU;rU;mG;rC;mG;rA;mA;rA;mA;rU;mU;rU;mC;mU;mC; (SEQ ID No. 87180) | 3 | | |
| Q-141 | rG;rA;rA;rG;rA;rA;rA;rU;rU;rU;rC;rC;rG;rA;mA;mA;mA;dT$ (SEQ ID No. 87185) | mU;rU;mU;rU;mG;rC;mG;rA;mA;rA;mA;rU;mU;rU;mC;mU;dT$ (SEQ ID No. 87186) | 1 | | 10 |
| Q-142 | rG;rA;rA;rG;rA;rA;rA;rU;rU;rU;rC;rG;rG;rA;rA;mA;mA (SEQ ID No. 87179) | mU;rU;mU;rU;mG;rC;mG;rA;mA;rA;mA;rU;mU;rU;mC;mU;mC (SEQ ID No. 87180) | 1 | | |
| Q-143 | mG;mA;mA;mG;rA;rA;rA;rU;rU;rU;rC;rC;rG;rA;rA;rA;dT$ (SEQ ID No. 87185) | mU;rU;mU;rU;mG;rC;mG;rA;mA;rA;mA;rU;mU;rU;mC;mU;mC; (SEQ ID No. 87186) | 4 | | 10 |
| Q-144 | mG;mA;mA;mG;rA;rA;rA;rU;rU;rU;rC;rC;rG;rA;rA;rA (SEQ ID No. 87179) | mU;rU;mU;rU;mG;rC;mG;rA;mA;rA;mA;rU;mU;rU;mC;mU;mC (SEQ ID No. 87180) | 4 | | 24 |

FIG. 23 Continued

| ID | Sense | AntiSense | Activity at 20nM (% of control) | IC50 (nM) | Stability in ham-serum |
|---|---|---|---|---|---|
| Q-145 | rG;rA;rG;rA;rA;rA;rA;rU;rU;rC;rC;rG;rC;rA;rA;rA;rA;dT$ (SEQ ID No. 87185) | p;rU;rU;mU;rU;mG;rC;mG;mA;rA;mA;rU;mU;rU;mU;rC;mU;rU;m C$ (SEQ ID No. 87180) | 12 | | 24 |
| Q-146 | mG;mA;mA;mG;mA;mA;mA;mA;mU;mU;mC;mC;rG;rC;rA;rA;rA;rA;dT$ (SEQ ID No. 87185) | p;rU;rU;rU;rU;rG;rC;rG;rA;rA;rU;rU;rU;rU;mC;mU;mC;dT$ (SEQ ID No. 87186) | 41 | | |
| Q-147 | rG;rA;rG;rA;rA;rA;rA;rU;rU;rC;rC;rG;rC;rA;rA2p;rA2p;rA2p; dT$ (SEQ ID No. 87185) | p;rU;rU;rU;rU;rG;rC;rG;rA;rA;rU;rU;rU;rU;rC;rU2p;rC2p;dT $ (SEQ ID No. 87186) | 29 | | |
| Q-148 | rG;rA;rA;rG;rA;rA;rA;rU;rU;rC;rG;rC;rA;rA2p;rA2p;rA2p; dT$ (SEQ ID No. 87185) | rU2p;rU2p;rU;rG;rC;rG;rA;rA;rU;rU;rU;rU;rC;rU;rC;dT$ (SEQ ID No. 87186) | 88 | | |
| Q-149 | rG2p;rA2p;rA2p;rA;rA;rA;rU;rU;rC;rC;rG;rC;rA;rA;rA;rA; dT$ (SEQ ID No. 87185) | rU2p;rU2p;rU;rG;rC;rG;rA;rA;rU;rU;rU;rU;rC;rU;rC;dT$ (SEQ ID No. 87186) | 91 | | |
| Q-150 | lnaA;lnaC;rU;rC;rA;rG;rA;rC;rU;rU;rC;rA;rG2p;rC2 p;rU2p (SEQ ID No. 87214) | mA;rG;mC;rU;mG;rU;mC;rC;mA;rA;mG;rU;mC;rU;mG;rA;mG;rG;mU (SEQ ID No. 87215) | 62 | | 8 |
| Q-151 | lnaA;lnaC;rU;rC;rA;rG;rA;rC;rU;rU;rC;rA;rG2p;rC2 p;rU2p (SEQ ID No. 87214) | rA;rG;rC;rU;rG;rU;rC;rC;rA;rA;rG;rU;rC;rU;rG;rA;rG;rG;rU (SEQ ID No. 87215) | 51 | | 8 |
| Q-152 | lnaA;lnaC;rU;rC;rA;rG;rA;rC;rU;rU;rC;rA;rG2p;rC2 p;rU2p (SEQ ID No. 87214) | mA;mG;rC;rU;rG;rU;rC;rC;rA;rA;rG;rU;rC;rU;rG;rA;rG;rG;rU (SEQ ID No. 87215) | 61 | | 8 |
| Q-153 | lnaG;lnaC;lnaC;rU;rC;rA;rG;rA;rC;rU;rU;rC;rA;rG2p;rC2 p;rU2p (SEQ ID No. 139) | mA;rG;mG;rA;mG;rU;rG;rA;mC;rA;mC;rA;mU;rC;rU;rU;mG;rG;mC (SEQ ID No. 140) | 11 | 0.5 | 24 |
| Q-154 | lnaG;lnaC;lnaC;rA;rG;rA;rG;rA;rC;rU;rU;rC;rA;rG2p;rC2 p;rU2p (SEQ ID No. 139) | rA;rG;rG;rA;rG;rU;rG;rA;rC;rA;rC;rA;rU;rC;rU;rU;rG;rG;rC (SEQ ID No. 140) | 10 | 0.12 | 24 |
| Q-155 | lnaG;lnaC;lnaC;rA;rG;rA;rG;rA;rC;rU;rU;rC;rA;rG2p;rC2 p;rU2p (SEQ ID No. 139) | mA;mG;rG;rA;rG;rU;rG;rA;rC;rA;rC;rA;rU;rC;rU;rU;rG;rG;rC (SEQ ID No. 140) | 22 | 2.5 | 24 |
| Q-156 | rG;rA;rG;rC;rC;rA;rC;rC;rU;rG;rA;rU;rC;rA;rG2p;rC2p;rU2p $ (SEQ ID No. 87216) | rA;rA;rU;rC;rA;rG;rG;rU;rG;rG;rC;rG;rC2p;rA2p;rC2p$ (SEQ ID No. 87217) | | | 0 |
| Q-157 | rG;rA;rA;rG;rA;rA;rA;rU;rU;rC;rC;rG;rC;rA;rA;dA;dA;dA;dT$ (SEQ ID No. 87185) | rU;rU;rU;rU;rG;rC;rG;rA;rA;rU;rU;rU;rU;rC;mUpeth;mUpeth;dC; dT$ (SEQ ID No. 87186) | 55 | | 16 |
| Q-158 | mGpeth;dA;dA;rG;rA;rA;rA;rA;rU;rU;rC;rC;rG;rC;rA;rA;rA;d T$ (SEQ ID No. 87185) | rU;rU;rU;rU;rG;rC;rG;rA;rA;rU;rU;rU;rU;rC;mUpeth;mUpeth;dC; dT$ (SEQ ID No. 87186) | 100 | | |
| Q-159 | rG;mA;rA;mG;rA;mA;rA;mA;rU;mU;rU;mU;rC;mC;rG;mC;rA;mA;r A$ (SEQ ID No. 87179) | rU;rU;rU;rU;rG;rC;rG;rA;rA;rU;rU;rU;rU;rC;mUpeth;mUpeth;dC; dT$ (SEQ ID No. 87186) | 38 | | 16 |
| Q-160 | rG;rA;rG;rA;rA;rA;rA;rU;rU;rC;rC;rG;rC;rA;rA;rA;rA;dT$ (SEQ ID No. 87185) | mUpeth;mUpeth;mUpeth;rU;rG;rC;rG;rA;rA;rU;rU;rU;rU;rU;rC; U;rC;dT$ (SEQ ID No. 87186) | 87 | | |
| Q-161 | mGpeth;dA;dA;rG;rA;rA;rA;rA;rU;rU;rC;rC;rG;rC;rA;rA;rA;d T$ (SEQ ID No. 87185) | mUpeth;mUpeth;mUpeth;rU;rG;rC;rG;rA;rA;rU;rU;rU;rU;rC;rU;r U;rC;dT$ (SEQ ID No. 87186) | 100 | | |
| Q-162 | rG;mA;rA;mG;rA;mA;rA;mA;rU;mU;rU;mU;rC;mC;rG;mC;rA;mA;r A$ (SEQ ID No. 87179) | mUpeth;mUpeth;mUpeth;rU;rG;rC;rG;rA;rA;rU;rU;rU;rU;rC;rU;r U;rC;rU;r (SEQ ID No. 87186) | 100 | | |

FIG. 23 Continued

| ID | Sense | AntiSense | Activity at 20nM (% of control) | IC50 (nM) | Stability in hum-serum |
|---|---|---|---|---|---|
| Q-163 | rG;rA;rG;rA;rA;rA;rU;rU;rC;rC;rG;rC;rA;dA;dA;dA;dT$ (SEQ ID No. 87185) | mU;rU;mU;rU;mG;rC;mG;rA;mA;rA;mA;rU;mU;rU;mU;rC;mU;rU;mC$ (SEQ ID No. 87180) | 17 | 0.19 | 16 |
| Q-164 | mCpeth;dA;dA;rG;rA;rA;rA;rA;rU;rU;rC;rC;rG;rC;rA;rA;rA;rA;d T$ (SEQ ID No. 87185) | mU;rU;mU;rU;mG;rC;mG;rA;mA;rA;mA;rU;mU;rU;mU;rC;mU;rU;mC$ (SEQ ID No. 87180) | 19 | 1.14 | 16 |
| Q-165 | rG;rA;rG;rA;rA;rA;rA;rU;rU;rC;rC;rG;rC;rA;LdA;LdA;rA (SEQ ID No. 87179) | rU;rU;rU;rU;rG;rC;rG;rA;rA;rA;rA;rU;rU;rU;rU;rC;rU;LdT;rC (SEQ ID No. 87180) | 91 | | 0 |
| Q-166 | rG;rA;rA;rG;rA;rA;rA;rA;rU;rU;rC;rC;rG;rC;rA;rA;rA;LdA;rA (SEQ ID No. 87179) | rU;rU;rU;rU;rG;rC;rG;rA;rA;rA;rA;rU;rU;rU;rU;rC;rU;LdT;rC (SEQ ID No. 87180) | 60 | | 0 |
| Q-167 | rG;rA;rA;rG;rA;rA;rA;rA;rU;rU;rC;rC;rG;rC;rA;rA;LdA;rA (SEQ ID No. 87179) | rU;rU;rU;rU;rG;rC;rG;rA;rA;rA;rA;rU;rU;rU;rU;rC;LdT;LdT;rC (SEQ ID No. 87180) | 78 | | 0 |
| Q-168 | rG;rA;rG;rA;rA;rA;rA;rU;rU;rC;rC;rG;rC;rA;LdA;LdA;rA (SEQ ID No. 87179) | rU;rU;rU;rU;rG;rC;rG;rA;rA;rA;rA;rU;rU;rU;rU;rC;LdT;LdT;rC (SEQ ID No. 87180) | 9 | | 0 |
| Q-169 | rG;rA;rC;rG;rU;rU;rC;rC;rU;rG;rC;rA;rC;rU;rC;rA;rA;LdG;LdA (SEQ ID No. 87218) | rU;rC;rU;rG;rA;rG;rU;rG;rC;rA;rG;rG;rA;rA;rC;rG;rU;LdC;rC (SEQ ID No. 87219) | 15 | | 1 |
| Q-170 | rG;rA;rC;rC;rU;rG;rC;rC;rU;rU;rU;rU;rA;rU;rU;rA;rU;LdC;LdA (SEQ ID No. 133) | rU;rG;rA;rU;rA;rA;rU;rA;rA;rA;rG;rG;rA;rG;rG;rU;rC;LdC;rC (SEQ ID No. 134) | 29 | | 0 |
| Q-171 | rA;rG;rU;rU;rG;rA;rU;rU;rU;rA;rU;rU;rU;rG;LdA;LdT (SEQ ID No. 211) | rA;rC;rA;rA;rA;rU;rA;rA;rA;rU;rC;rA;rA;rC;rU;rU;rG;rC;LdC;LdC (SEQ ID No. 212) | 39 | | 1 |
| Q-172 | rG;rA;rG;rU;rG;rU;rU;rC;rA;rU;rU;rU;rU;rC;rA;rU;LdG;LdT (SEQ ID No. 87220) | rA;rC;rA;rU;rG;rA;rA;rA;rA;rU;rG;rA;rA;rC;rA;rC;rU;rC;LdC;LdC (SEQ ID No. 87221) | 18 | | 1 |
| Q-173 | rG;rC;rA;rG;rG;rC;rC;rC;rA;rU;rU;rU;rA;rU;rU;rC;rA;LdG;LdT (SEQ ID No. 87222) | rA;rC;rU;rG;rA;rA;rU;rA;rA;rA;rU;rG;rG;rG;rC;rC;rU;rG;LdC (SEQ ID No. 87223) | 17 | | 0 |
| Q-174 | rG;rU;rG;rC;rC;rA;rU;rU;rA;rC;rA;rU;rA;rA;rA;rC;LdC;rA (SEQ ID No. 87224) | rU;rG;rG;rU;rU;rU;rA;rU;rG;rU;rA;rA;rU;rG;rG;rC;rA;LdC;rC (SEQ ID No. 87225) | 38 | | 0 |
| Q-175 | rC;rC;rC;rG;rG;rG;rC;rA;rC;rU;rA;rU;rG;rA;rC;rA;LdA;LdA (SEQ ID No. 87226) | rU;rU;rG;rU;rC;rA;rU;rA;rG;rU;rG;rC;rC;rC;rG;rG;LdG;rC (SEQ ID No. 87227) | 22 | | 0 |
| Q-176 | rC;rC;rC;rU;rU;rA;rA;rA;rC;rU;rA;rA;rC;rA;LdA;LdA (SEQ ID No. 87228) | rU;rU;rU;rG;rU;rA;rU;rA;rG;rU;rU;rU;rA;rA;rG;rG;LdG (SEQ ID No. 87229) | 19 | | 0 |
| Q-177 | rG;rC;rU;rU;rG;rU;rA;rU;rU;rU;rU;rA;LdA;LdA (SEQ ID No. 87230) | rU;rU;rU;rA;rA;rA;rA;rU;rA;rC;rA;rA;rG;rC;LdG (SEQ ID No. 87231) | 17 | | 0 |
| Q-178 | rG;rC;rC;rA;rA;rU;rG;rG;rU;rG;rK;rA;rC;rU;rC;LdC;LdT (SEQ ID No. 139) | rA;rG;rG;rA;rG;rU;rC;rA;rC;rA;rC;rC;rA;rU;rU;rG;rG;LdC (SEQ ID No. 140) | 10 | 0.375 | 10 |
| Q-179 | rG;rC;rC;rA;rC;rU;rU;rA;rA;rC;rU;rU;rG;rU;LdA;LdC (SEQ ID No. 235) | rG;rU;rA;rC;rA;rA;rG;rU;rU;rA;rA;rG;rU;rG;rG;LdC (SEQ ID No. 236) | 36 | | 0 |
| Q-180 | rU;rC;rC;rG;rU;rU;rG;rA;rU;rU;rG;rA;rC;LdA;LdA (SEQ ID No. 87232) | rU;rU;rG;rU;rC;rA;rA;rU;rC;rA;rA;rC;rG;rG;LdA (SEQ ID No. 87233) | 8 | | 1 |

FIG. 23 Continued

| ID | Sense | AntiSense | Activity at 20nM (% of control) | IC50 (nM) | Stability in hum-serum |
|---|---|---|---|---|---|
| Q-181 | rG;rA;rG;rA;rA;rA;rU;rU;rU;rC;rC;rG;rC;rG;rA;rA;3mA2p;3mA2p;mA$ (SEQ ID No. 87179) | rU;rU;rU;rG;rC;rG;rG;rA;rA;rA;rU;rU;rU;rC;3mU2p;3mU2p;3mU2p;mC$ (SEQ ID No. 87180) | 65 | | 3 |
| Q-182 | 3mG2p;3mA2p;3mA2p;rG;rA;rA;rA;rU;rU;rU;rC;rC;rG;rC;rA;rA;rA;rA$ (SEQ ID No. 87179) | rU;rU;rU;rG;rC;rG;rG;rA;rA;rA;rU;rU;rU;rC;3mU2p;3mU2p;mC$ (SEQ ID No. 87180) | 35 | 0.678 | 10 |
| Q-183 | rG;mA;rA;mG;rA;mA;rA;mU;rU;mC;rC;mG;rC;mA;rA;mA;rA$ (SEQ ID No. 87179) | rU;rU;rU;rG;rC;rG;rG;rA;rA;rA;rU;rU;rU;rC;3mU2p;3mU2p;mC$ (SEQ ID No. 87180) | 57 | | 10 |
| Q-184 | rG;rA;rA;rG;rA;rA;rA;rU;rU;rU;rC;rC;rG;rC;rA;3mA2p;3mA2p;mA$ (SEQ ID No. 87179) | 3mU2p;3mU2p;3mU2p;rU;rU;rC;rG;rG;rA;rA;rA;rU;rU;rU;rC$ (SEQ ID No. 87180) | 100 | | |
| Q-185 | 3mG2p;3mA2p;rG;rA;rA;rA;rU;rU;rU;rC;rC;rG;rC;rA;rA;rA$ (SEQ ID No. 87179) | 3mU2p;3mU2p;rU;rU;rG;rC;rG;rG;rA;rA;rA;rU;rU;rU;rC$ (SEQ ID No. 87180) | 100 | | |
| Q-186 | rG;mA;rA;mG;rA;mA;rA;mU;rU;mC;rC;mG;rC;mA;rA;mA;rA$ (SEQ ID No. 87179) | 3mU2p;3mU2p;rU;rU;rG;rC;rG;rG;rA;rA;rA;rU;rU;rU;rC$ (SEQ ID No. 87180) | 100 | | |
| Q-187 | rG;rA;rA;rG;rA;rA;rA;rU;rU;rU;rC;rC;rG;rC;rA;3mA2p;3mA2p;mA$ (SEQ ID No. 87179) | mU;rU;mU;rU;mG;rC;mG;rA;mA;rA;mU;rU;mU;rC;mU;rU;mC$ (SEQ ID No. 87180) | 26 | 0.394 | 10 |
| Q-188 | 3mG2p;3mA2p;rG;rA;rA;rA;rU;rU;rU;rC;rC;rG;rC;rA;rA;rA$ (SEQ ID No. 87179) | mU;rU;mU;rU;mG;rC;mG;rA;mA;rA;mU;rU;mU;rC;mU;rU;mC$ (SEQ ID No. 87180) | 16 | 1.114 | 10 |
| Q-189 | rG;rA;rA;rG;rA;rA;rA;rU;rU;rU;rC;rC;rG;rC;rA;rA;rA$ (SEQ ID No. 87179) | rU;rU;rU;rC;rG;rC;rG;rA;rA;rA;rU;rU;rU;rC;rU;rU;rC$ (SEQ ID No. 87180) | 4 | 0.372 | 8 |
| Q-190 | rA;rC;rC;rU;rG;rA;rA;rA;rC;rC;rU;rG;rA;LdA;LdT (SEQ ID No. 87234) | rA;rU;rU;rC;rC;rA;rG;rC;rA;rA;rU;rU;rC;rA;rG;LdT (SEQ ID No. 87235) | 4 | | 8 |
| Q-191 | rC;rC;rU;rG;rU;rG;rA;rA;rA;rC;rC;rU;rG;rA;LdA;LdT (SEQ ID No. 81956) | rA;rA;rG;rC;rA;rU;rU;rC;rU;rC;rA;rU;rC;rA;rG;LdG (SEQ ID No. 82284) | 32 | | 0 |
| Q-192 | rG;rG;rG;rC;rU;rA;rA;rG;rA;rA;LdA;LdT (SEQ ID No. 13905) | rU;rU;rC;rU;rC;rA;rU;rU;rA;rG;rC;rC;LdC (SEQ ID No. 14108) | 28 | | 0 |
| Q-193 | rG;rU;rG;rC;rC;rA;rA;rC;rC;rU;rG;rC;rA;rA;rG;LdC;LdT (SEQ ID No. 87216) | mA;mG;rC;rU;mG;rC;mA;rU;mC;rA;mG;rG;mC;rA;mC (SEQ ID No. 87217) | 94 | | 24 |
| Q-194 | rG;rU;rG;rC;rC;rU;rG;rA;rU;rG;rC;rA;rG;LdC;LdT (SEQ ID No. 87216) | mA;rG;mC;rU;mG;rC;mA;rU;rC;mA;rG;mG;rC;mA;mC (SEQ ID No. 87217) | 20 | 1.567 | 24 |
| Q-195 | mG;mU;rG;rC;rC;rA;rA;rC;rC;rU;rG;rA;rU;rG;LdC;LdT (SEQ ID No. 87216) | mA;mG;rC;rU;mG;rC;mA;rU;rC;rA;rG;rG;rC;rA;LdC (SEQ ID No. 87217) | 96 | | |
| Q-196 | mG;mU;mG;mC;mC;mA;rA;rC;mC;mU;mG;rA;rU;rG;rC2p;rU2p (SEQ ID No. 87216) | rA;rG;rC;rU;rG;rC;rA;rU;rC;rA;rG;rG;rC;rA;mC (SEQ ID No. 87217) | 49 | | |
| Q-197 | mG;mU;mG;mC;mC;mA;rA;rC;mC;mU;mG;rA;rU;rG;rC2p;rU2p (SEQ ID No. 87216) | mA;mG;rC;rU;mG;rC;mA;rU;rC;rA;rG;rG;rC;rA;LdC (SEQ ID No. 87217) | 114 | | |
| Q-198 | rG;rU;rG;rC;rC;rU;rG;rA;rU;rG;rC;rA;rG;rC2p;rU2p (SEQ ID No. 87216) | mA;rG;mC;rU;mG;rC;mA;rU;mC;rA;mG;rG;mC;rA;mC (SEQ ID No. 87217) | 88 | 0.359 | 10 |

FIG. 23 Continued

| ID | Sense | AntiSense | Activity at 20nM (% of control) | IC50 (nM) | Stability in human serum |
|---|---|---|---|---|---|
| Q-199 | mG;mU;mG;mC;mC;rA;rA;rC;rC;rU;rG;rA;rU;rG;rC;rU;rG;rC;rU (SEQ ID No. 87216) | rA;rG;rC;rU;rG;rC;rA;rU;rC;rA;rG;rU;rU;rG;rG;rU;rU;rG;mC;mA;mC (SEQ ID No. 87217) | 58 | | |
| Q-200 | rG;rU;rG;rC;rC;rA;rA;rC;rC;rA;rU;rG;rA;rU;rG;rC;rA;rG;LdC;LdT (SEQ ID No. 87216) | rA;rG;rC;rU;rG;rC;rA;rU;rC;rA;rG;rU;rU;rG;rG;rU;rU;rG;rC;rA;LdC (SEQ ID No. 87217) | 42 | | |
| Q-201 | mG;mU;mG;mC;mC;rA;rA;rC;rC;rA;rU;rG;rA;rU;rG;rC;rA;rG;LdC;LdT (SEQ ID No. 87216) | rA;rG;rC;rU;rG;rC;rA;rU;rC;rA;rG;rU;rU;rG;rG;rU;rU;rG;mC;mA;mC (SEQ ID No. 87217) | 37 | 5.097 | 10 |
| Q-202 | rG;rA;rG;rA;rG;rA;rA;rA;rA;rU;rU;rU;rC;rG;rC;rA;rA;LdA;LdA (SEQ ID No. 87179) | rU;rU;rU;rU;rG;rC;rG;rA;rA;rA;rU;rU;rU;rC;rU;rU;rC;rU;rU;LdC (SEQ ID No. 87180) | | | |
| Q-203 | LdG;LdA;rA;rG;rA;rA;rA;rA;rU;rU;rU;rC;rG;rC;rA;rA;rA;rA (SEQ ID No. 87179) | rU;rU;rU;rU;rG;rC;rG;rA;rA;rA;rU;rU;rU;rC;rU;rU;rC;rU;rU;LdC (SEQ ID No. 87180) | | | |
| Q-204 | LdG;LdA;rA;rG;rA;rA;rA;rA;rU;rU;rU;rC;rG;rC;rA;rA;rA;LdA;LdA (SEQ ID No. 87179) | rU;rU;rU;rU;rG;rC;rG;rA;rA;rA;rU;rU;rU;rC;rU;rU;rC;rU;rU;LdC (SEQ ID No. 87180) | | | |
| Q-205 | rG;rA;rA;rG;rA;rA;rA;rA;rU;rU;rU;rU;rC;rG;rC;rA;rA;LdA;LdA (SEQ ID No. 87179) | mU;rU;mU;mG;rC;mG;rA;mA;rA;mA;rU;mU;rU;mC;rU;mU;rC;rU;mU;rU;mC (SEQ ID No. 87180) | | | |
| Q-206 | LdG;LdA;rA;rG;rA;rA;rA;rA;rU;rU;rU;rC;rG;rC;rA;rA;rA;rA (SEQ ID No. 87179) | mU;mU;mU;mG;rC;mG;rA;mA;rA;mA;rU;mU;rU;mC;rU;mU;rC;rU;mU;rU;mC (SEQ ID No. 87180) | | | |
| Q-207 | LdG;LdA;rA;rG;rA;rA;rA;rA;rU;rU;rU;rC;rG;rC;rA;rA;rA;LdA;LdA (SEQ ID No. 87179) | mU;mU;mU;mG;rC;mG;rA;mA;rA;mA;rU;mU;rU;mC;rU;mU;rC;rU;mU;rU;mC (SEQ ID No. 87180) | | | |
| Q-208 | rG;rA;rA;rG;rA;rA;rA;rA;rU;rU;rU;rC;rG;rC;rA;rA;rA;rA;LdA (SEQ ID No. 87179) | rU;rU;rU;rU;rG;rC;rG;rA;rA;rA;rU;rU;rU;rC;rU;rU;rC;rU;rU;LdC (SEQ ID No. 87180) | 52 | | 0 |
| Q-209 | rG;rA;rA;rG;rA;rA;rA;rA;rU;rU;rU;rC;rG;rC;rA;rA;rA;LdA (SEQ ID No. 87179) | rU;rU;rU;rU;rG;rC;rG;rA;rA;rA;rU;rU;rU;rC;rU;rU;rC;rU;LdT;LdC (SEQ ID No. 87180) | 73 | | 0 |
| Q-210 | rG;rA;rA;rG;rA;rA;rA;rA;rU;rU;rU;rC;rG;rC;rA;rA;rA;rA;LdA (SEQ ID No. 87179) | rU;rU;rU;rU;rG;rC;rG;rA;rA;rA;rU;rU;rU;rC;rU;rU;rC;LdT;LdT;LdC (SEQ ID No. 87180) | 85 | | 0 |
| Q-211 | rG;rA;rA;rG;rA;rA;rA;rA;rU;rU;rU;rC;rG;rC;rA;rA;rA;LdA;LdA (SEQ ID No. 87179) | rU;rU;rU;rU;rG;rC;rG;rA;rA;rA;rU;rU;rU;rC;rU;rU;rC;rU;rU;LdC (SEQ ID No. 87180) | 50 | | 3 |
| Q-212 | rG;rA;rA;rG;rA;rA;rA;rA;rU;rU;rU;rC;rG;rC;rA;rA;rA;LdA;LdA (SEQ ID No. 87179) | rU;rU;rU;rU;rG;rC;rG;rA;rA;rA;rU;rU;rU;rC;rU;rU;rC;rU;LdU;LdC (SEQ ID No. 87180) | 82 | | 0 |
| Q-213 | rG;rA;rA;rG;rA;rA;rA;rA;rU;rU;rU;rC;rG;rC;rA;rA;rA;LdA;LdA (SEQ ID No. 87179) | rU;rU;rU;rU;rG;rC;rG;rA;rA;rA;rU;rU;rU;rC;rU;rU;rC;LdT;LdT;LdC (SEQ ID No. 87180) | 100 | | 0 |
| Q-214 | rG;rA;rA;rG;rA;rA;rA;rA;rU;rU;rU;rC;rG;rC;rA;rA;LdA;LdA (SEQ ID No. 87179) | rU;rU;rU;rU;rG;rC;rG;rA;rA;rA;rU;rU;rU;rC;rU;rU;rC;LdT;LdT;LdC (SEQ ID No. 87180) | 62 | | 3 |
| Q-215 | rG;rA;rA;rG;rA;rA;rA;rA;rU;rU;rU;rC;rG;rC;rA;rA;LdA;LdA (SEQ ID No. 87179) | rU;rU;rU;rU;rG;rC;rG;rA;rA;rA;rU;rU;rU;rC;rU;rU;rC;rU;LdT;LdC (SEQ ID No. 87180) | 90 | | 0.5 |
| Q-216 | rG;rA;rA;rG;rA;rA;rA;rA;rU;rU;rU;rC;rG;rC;rA;rA;LdA;LdA (SEQ ID No. 87179) | rU;rU;rU;rU;rG;rC;rG;rA;rA;rA;rU;rU;rU;rC;rU;rU;rC;LdT;LdT;LdC (SEQ ID No. 87180) | 90 | | 0 |

FIG. 23 Continued

| ID | Sense | AntiSense | Activity at 20nM (% of control) | IC50 (nM) | Stability in human serum |
|---|---|---|---|---|---|
| Q-217 | rG;rA;rG;rA;rA;rA;rU;rU;rC;rG;rC;rA;rA;LdA (SEQ ID No. 87179) | mU;rU;mU;rU;mG;rC;mG;mA;rA;mA;rU;mU;rC;mU;rU;mC (SEQ ID No. 87180) | 21 | | 24 |
| Q-218 | rG;rA;rA;rG;rA;rA;rA;rU;rU;rC;rG;rC;rA;rA;LdA;LdA (SEQ ID No. 87179) | mU;rU;mU;rU;mG;rC;mG;mA;rA;mA;rU;mU;rC;mU;rU;mC (SEQ ID No. 87180) | 24 | | 24 |
| Q-219 | rG;rA;rA;rG;rA;rA;rA;rU;rU;rC;rG;rC;rA;LdA;LdA;LdA (SEQ ID No. 87179) | mU;rU;mU;rU;mG;rC;mG;mA;rA;mA;rU;mU;rC;mU;rU;mC (SEQ ID No. 87180) | 13 | | 24 |
| Q-220 | rC;rA;rG;rC;rC;rA;rA;rG;rU;rG;rU;rG;rC;rC;rC;rU2p;rC2p;rA2p (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 53 | | 24 |
| Q-221 | mC;mA;mG;mC;mC;mA;rG;rA;rA;rU;rG;rU;rG;rC;rC;rC;rU2p;rC2p;rA2p (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 53 | | 24 |
| Q-222 | mC;mA;mG;mC;mC;mA;rG;rA;rA;rU;rG;rU;rG;rC;rC;rC;rU;rC;rA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 48 | | 10 |
| Q-223 | mC;mA;mG;mC;mC;mA;rG;rA;rA;rU;rG;rU;rG;rC;rC;rC;rU;rC;rC;LdT;LdC;LdA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 31 | | 24 |
| Q-224 | mC;mA;mG;mC;mC;mA;rG;rA;rA;rU;rG;rU;rG;rC;rC;rC;rU;LdC;LdA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 34 | | 24 |
| Q-225 | mC;mA;mG;mC;mC;mA;rG;rA;rA;rU;rG;rU;rG;rC;rC;rC;rU;rC;LdA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 33 | | 24 |
| Q-226 | rC;rA;rG;rC;rC;rA;rA;rU;rG;rU;rG;rC;rC;rC;rU;rC;rC;rU;LdC;LdA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 50 | | 24 |
| Q-227 | rC;rA;rG;rC;rC;rA;rA;rU;rG;rU;rG;rC;rC;rC;rU;rC;rC;rU;LdC;rU;L (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 52 | | 24 |
| Q-228 | rC;rA;rG;rC;rC;rA;rA;rU;rG;rU;rG;rC;rC;rC;rU;rC;rC;rU;rC;LdA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 37 | | 24 |
| Q-229 | mC;rA;rG;rC;rC;rA;rA;rU;rG;rU;rG;rC;rC;rC;rU;rC;rC;rU;LdC;LdA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 32 | | 24 |
| Q-230 | rC;rA;rG;rC;rC;rA;rA;rU;rG;rU;rG;rC;rC;rC;rU;rC;rC;rU;LdC;rA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 26 | | 24 |
| Q-231 | rC;rA;rG;rC;rC;rA;rA;rU;rG;rU;rG;rC;rC;rC;rU;rC;rC;rU;LdC;LdT;LdC;rA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 100 | | 24 |
| Q-232 | mC;rA;rG;mC;rC;mA;rC;mA;rA;mU;rG;mU;rG;rA;mA;rC;mU;rC;mC;rU;mC;rA (SEQ ID No. 38078) | mU;rG;mA;rG;mG;rA;mG;rU;mU;rC;mC;rA;mU;rC;rA;mU;rC;rU;mG;rG;mC;rU;mG (SEQ ID No. 39666) | 73 | | 24 |
| Q-233 | rG;rG;rA;rA;rG;rA;rA;rA;rU;rU;rC;rG;rC;rG;rC;rA;rA;rA;LdA (SEQ ID No. 87181) | rU;rU;rU;rU;rG;rC;rG;rC;rG;rA;rA;rU;rU;rU;rC;rU;rU;rC;rC;LdG (SEQ ID No. 87182) | 3 | | 1 |
| Q-234 | LdG;LdG;rA;rA;rG;rA;rA;rA;rU;rU;rC;rG;rC;rG;rC;rA;rA;rA (SEQ ID No. 87181) | rU;rU;rU;rU;rG;rC;rG;rC;rG;rA;rA;rU;rU;rU;rC;rU;rU;rC;rC;LdG (SEQ ID No. 87182) | 5 | | 1 |

FIG. 23 Continued

| ID | Sense | AntiSense | Activity at 20nM (% of control) | IC50 (nM) | Stability in human serum |
|---|---|---|---|---|---|
| Q-235 | LdG;LdG;rA;rA;rG;rA;rA;rG;rA;rU;rU;rG;rC;rG;rC;rG;rC;rA;rA;LdA;LdA (SEQ ID No. 87181) | rU;rU;rU;rG;rU;rG;rC;rG;rC;rG;rA;rA;rU;rU;rC;rU;rU;rC;rU;rU;rC;Ld C (SEQ ID No. 87182) | 4 | | 1 |
| Q-236 | rG;rG;rA;rA;rG;rA;rA;rG;rA;rA;rU;rU;rC;rG;rC;rG;rC;rG;mC;mA;m A;mA;mA (SEQ ID No. 87181) | rU;rU;rU;rG;rU;rG;rC;rG;rC;rG;rA;LdA;rU;rU;rC;rU;rU;rC;rU;mC;mU; mC;mC (SEQ ID No. 87182) | 53 | | 3 |
| Q-237 | rG;rG;rA;rA;rG;rA;rA;rG;rA;rA;rU;rU;rC;rG;rC;rG;rC;rG;mC;mA;m A;mA;mA (SEQ ID No. 87181) | rU;rU;rU;rG;rU;rG;rC;rG;rC;rG;rA;rA;LdA;rU;rU;rC;rU;rU;rC;mU;mC; mC;mC (SEQ ID No. 87182) | 42 | | 1 |
| Q-238 | rG;rA;rA;rG;rA;rA;rG;rA;rA;rU;rU;rU;rC;rC;rG;mC;mA;mA;mA (SEQ ID No. 87179) | rU;rU;rU;rG;rC;rG;rC;rG;rA;LdA;rA;rU;rU;rC;rU;mU;mU;mU;mU;mC (SEQ ID No. 87180) | 69 | | 6 |
| Q-239 | rG;rA;rA;rG;rA;rA;rG;rA;rA;rU;rU;rU;rC;rC;rG;mC;mA;mA;mA;mA (SEQ ID No. 87179) | rU;rU;rU;rG;rC;rG;rC;rG;rA;LdA;LdA;rU;rU;rU;rU;rU;mU;mU;mU;mC (SEQ ID No. 87180) | 71 | | 0 |
| Q-240 | rG;rA;rA;rG;rA;rA;rG;rA;rA;rU;rU;rU;rU;rC;rC;rG;mC;mA;mA;mA;mA (SEQ ID No. 87179) | rU;rU;rU;rG;rC;rG;rC;rG;rA;rA;LdA;rU;rU;rU;rU;mU;mU;mU;mU;mC (SEQ ID No. 87180) | 100 | | 0 |
| Q-241 | rG;rC;rC;rA;rG;rA;rU;rG;rU;rG;rA;rC;rU;rC2p;rC2p;rC2p;rU2p;rU2p (SEQ ID No. 139) | mA;rG;mG;rA;mG;rA;mU;rC;mC;rA;mC;rA;mU;rC;mG;rG;mC (SEQ ID No. 140) | 11 | 2.45 | 24 |
| Q-242 | mG;mC;mA;mG;rA;rA;rG;rU;rG;rU;rG;rA;rA;rC;rA;rA;rC;rU (SEQ ID No. 139) | mA;rG;mG;rA;mG;rA;mU;rC;mC;rA;mC;rA;mU;rC;mG;rG;mC (SEQ ID No. 140) | 17 | 2 | 24 |
| Q-243 | mG;mC;mC;mA;mG;rA;rA;rG;rU;rG;rU;rG;rA;rC;rU;rC;rU (SEQ ID No. 139) | mA;rG;mG;rA;mG;rA;mU;rC;mC;rA;mC;rA;mU;rC;mG;rG;mC (SEQ ID No. 140) | 17 | 8.8 | 24 |
| Q-244 | mG;mC;mC;mA;mG;rA;rA;rU;rG;rU;rG;rA;rC;rU;LdC;LdC;L dT (SEQ ID No. 139) | mA;rG;mG;rA;mG;rA;mU;rC;mC;rA;mU;rC;rA;mU;rC;mG;rG;mC (SEQ ID No. 140) | 9 | 2.56 | 24 |
| Q-245 | mG;mC;mC;mA;mG;rA;rA;rG;rU;rG;rU;rG;rA;rC;rU;LdC;LdC;LdT (SEQ ID No. 139) | mA;rG;mG;rA;mG;rA;mU;rC;mC;rA;mC;rA;mU;rC;mG;rG;mC (SEQ ID No. 140) | 3 | 1.6 | 24 |
| Q-246 | mG;mC;mC;mA;mG;rA;rA;rG;rU;rG;rU;rG;rA;rA;rC;rU;LdC;LdC;LdT (SEQ ID No. 139) | mA;rG;mG;rA;mG;rA;mU;rC;mC;rA;mC;rA;mU;rC;mG;rG;mC (SEQ ID No. 140) | 6 | 1.13 | 24 |
| Q-247 | rG;rC;rC;rA;rG;rA;rA;rG;rU;rG;rA;rA;rC;rU;rC;LdC;LdT (SEQ ID No. 139) | mA;rG;mG;rA;mG;rA;mU;rC;mC;rA;mC;rA;mU;rC;mG;rG;mC (SEQ ID No. 140) | 10 | 1.3 | 24 |
| Q-248 | rG;rC;rC;rA;rG;rA;rA;rG;rU;rG;rU;rG;rA;rC;rU;rC;rC;LdT (SEQ ID No. 139) | mA;rG;mG;rA;mG;rA;mU;rC;mC;rA;mC;rA;mU;rC;mG;rG;mC (SEQ ID No. 140) | 4 | 2.38 | 24 |
| Q-249 | rG;rC;rC;rA;rG;rA;rA;rG;rU;rG;rU;rG;rA;rC;rU;rC;rC;LdT (SEQ ID No. 139) | mA;rG;mG;rA;mG;rA;mU;rC;mC;rA;mC;rA;mU;rC;mG;rG;mC (SEQ ID No. 140) | 8 | 0.78 | 24 |
| Q-250 | mG;mC;mC;rA;rG;rA;rA;rG;rU;rG;rU;rG;rA;rC;rU;rC;LdT (SEQ ID No. 139) | mA;rG;mG;rA;mG;rA;mU;rC;mC;rA;mC;rA;mU;rC;mG;rG;mC (SEQ ID No. 140) | 7 | | 24 |
| Q-251 | rG;rC;rC;rA;rG;rA;rA;rU;rG;rU;rG;rA;rC;rU;rC;LdC;rU (SEQ ID No. 139) | mA;rG;mG;rA;mG;rA;mU;rC;mC;rA;mC;rA;mU;rC;mG;rG;mC (SEQ ID No. 140) | 6 | 0.46 | 24 |
| Q-252 | rG;rC;rC;rA;rG;rA;rU;rG;rU;rG;rA;rC;rU;LdC;LdC;rU (SEQ ID No. 139) | mA;rG;mG;rA;mG;rA;mU;rC;mC;rA;mC;rA;mU;rC;mG;rG;mC (SEQ ID No. 140) | 18 | 2.48 | 24 |

FIG. 23 Continued

| ID | Sense | AntiSense | Activity at 20nM (% of control) | IC50 (nM) | Stability in ham-serum |
|---|---|---|---|---|---|
| Q-253 | rG;rC;rC;rA;rG;rA;rG;rU;rG;rA;rA;rA;rC;rU2p;rC2p;rC;rU (SEQ ID No. 139) | mA;rG;mG;rA;mG;rU;rU;rC;mC;rA;mC;rA;mU;rU;mC;rU;mG;rG;mC (SEQ ID No. 140) | 15 | 3.78 | 24 |
| Q-254 | rG;mC;rC;mA;rG;mA;rG;mU;rG;mA;rA;mA;rC;mU;rC;mC;rU (SEQ ID No. 139) | mA;rG;mG;rA;mG;rU;mU;rC;mC;rA;mC;rA;mU;rU;mC;rU;mG;rG;mC (SEQ ID No. 140) | 10 | | 24 |
| Q-255 | rG;mC;rC;mA;rG;mA;rA;mA;rG;mA;rA;mA;rC;mU;rC;mC;rU$ (SEQ ID No. 139) | mA;rG;mG;rA;mG;rU;mU;rC;mC;rA;mC;rA;mU;rU;mC;rU;mG;rG;mC (SEQ ID No. 140) | 19 | | |
| Q-256 | rG;rC;rC;rA;rG;rA;rG;rU;rG;rA;rA;rA;rC;rU;rC2p;rC2p;rU$ (SEQ ID No. 139) | mA;rG;mG;rA;mG;rU;mU;rC;mC;rA;mC;rA;mU;rU;mC;rU;mG;rG;mC (SEQ ID No. 140) | 16 | | |
| Q-257 | rG;rC;rC;rA;rG;rA;rG;rU;rG;rA;rA;rA;rC;rU;rC2p;rC2p;rU (SEQ ID No. 139) | mA;rG;mG;rA;mG;rU;mU;rC;mC;rA;mC;rA;mU;rU;mC;rU;mG;rG;mC (SEQ ID No. 140) | 6 | 1.1 | 16 |
| Q-258 | rG;rC;rC;rA;rG;rA;rG;rU;rG;rA;rA;rA;rC;rU;rC2p;rC2p;rU2p (SEQ ID No. 139) | mA;rG;mG;rA;mG;rU;mU;rC;mC;rA;mC;rA;mU;rU;mC;rU;mG;rG;mC (SEQ ID No. 140) | 15 | | |
| Q-259 | rG;rC;rC;rA;rG;rA;rG;rU;rG;rA;rA;rA;rC;rU;rC;LdC;LdT (SEQ ID No. 139) | mA;rG;mG;rA;mG;rU;mU;rC;mC;rA;mC;rA;mU;rU;mC;rU;mG;rG;mC (SEQ ID No. 140) | 5 | | |
| Q-260 | rG;rC;rC;rA;rG;rA;rG;rU;rG;rA;rA;rA;rC;rU;rC;LdC;LdT$ (SEQ ID No. 139) | mA;rG;mG;rA;mG;rU;mU;rC;mC;rA;mC;rA;mU;rU;mC;rU;mG;rG;mC (SEQ ID No. 140) | 6 | | |
| Q-261 | rG;mC;rC;mA;rG;mA;rG;mU;rG;mA;rA;mA;rC;mU;rC;mC;rU (SEQ ID No. 139) | mA;rG;mG;rA;mG;rU;mU;rC;mC;rA;mC;rA;mU;rU;mC;rU;mG;rG;mC$ (SEQ ID No. 140) | 90 | | |
| Q-262 | rG;mC;rC;mA;rG;mA;rA;mA;rG;mU;rG;mU;rG;mA;rA;mA;rC;mU;rC;mC;rU$ (SEQ ID No. 139) | mA;rG;mG;rA;mG;rU;mU;rC;mC;rA;mC;rA;mU;rU;mC;rU;mG;rG;mC$ (SEQ ID No. 140) | 110 | | |
| Q-263 | rG;rC;rC;rA;rG;rA;rG;rU;rG;rA;rA;rA;rC;rU;rC2p;rC2p;rU$ (SEQ ID No. 139) | mA;rG;mG;rA;mG;rU;mU;rC;mC;rA;mC;rA;mU;rU;mC;rU;mG;rG;mC$ (SEQ ID No. 140) | 36 | | |
| Q-264 | rG;rC;rC;rA;rG;rA;rG;rU;rG;rA;rA;rA;rC;rU;rC2p;rC2p;rU (SEQ ID No. 139) | mA;rG;mG;rA;mG;rU;mU;rC;mC;rA;mC;rA;mU;rU;mC;rU;mG;rG;mC$ (SEQ ID No. 140) | 15 | | |
| Q-265 | rG;rC;rC;rA;rG;rA;rG;rU;rG;rA;rA;rA;rC;rU;rC2p;rC2p;rU2p (SEQ ID No. 139) | mA;rG;mG;rA;mG;rU;mU;rC;mC;rA;mC;rA;mU;rU;mC;rU;mG;rG;mC$ (SEQ ID No. 140) | 23 | | |
| Q-266 | rG;rC;rC;rA;rG;rA;rG;rU;rG;rA;rA;rA;rC;rU;rC;LdC;LdT (SEQ ID No. 139) | mA;rG;mG;rA;mG;rU;mU;rC;mC;rA;mC;rA;mU;rU;mC;rU;mG;rG;mC$ (SEQ ID No. 140) | 6 | | |
| Q-267 | rG;rC;rC;rA;rG;rA;rG;rU;rG;rA;rA;rA;rC;rU;rC;LdC;LdT$ (SEQ ID No. 139) | mA;rG;mG;rA;mG;rU;mU;rC;mC;rA;mC;rA;mU;rU;mC;rU;mG;rG;mC$ (SEQ ID No. 140) | 20 | | |
| Q-268 | rG;rA;rA;rU;rU;rG;rU;rG;rA;rA;rC;rU;rC;rU;rA2p;rA2p;rC$ (SEQ ID No. 2449) | mG;rU;mU;rG;mA;rG;mA;rG;mU;rU;rC;mC;rA;mC;rA;mC;rA;mU;rU;mC (SEQ ID No. 2949) | 18 | 1.176 | 3 |
| Q-269 | rG;rA;rA;rU;rG;rU;rG;rA;rA;rC;rU;rC;rU;rA2p;rA2p;rC (SEQ ID No. 2449) | mG;rU;mU;rG;mA;rG;mA;rG;mU;rU;rC;mC;rA;mC;rA;mC;rA;mU;rU;mC (SEQ ID No. 2949) | 10 | 0.263 | 8 |
| Q-270 | mG;mA;mA;mU;mG;rU;rG;rA;rA;rC;rU;rC;rU;rA2p;rA2p;rC2p (SEQ ID No. 2449) | mG;rU;mU;rG;mA;rG;mA;rG;mU;rU;rC;mC;rA;mC;rA;mC;rA;mU;rU;mC (SEQ ID No. 2949) | 11 | 0.1 | 1 |

FIG. 23 Continued

| ID | Sense | AntiSense | Activity at 20nM (% of control) | IC50 (nM) | Stability in human serum |
|---|---|---|---|---|---|
| Q-271 | rG;rA;rA;rU;rG;rU;rG;rG;rA;rA;rC;rU;rC;rU;rC;rA;LdA;LdC (SEQ ID No. 2449) | mG;rU;mU;rG;mA;rG;mG;rA;mG;rU;rU;rC;mC;rA;mC;rA;mU;rU;mC (SEQ ID No. 2949) | 10 | 0.646 | 6 |
| Q-272 | rG;rA;rA;rU;rG;rU;rG;rG;rA;rA;rC;rU;rC;rU;rC;rA;LdA;LdC$ (SEQ ID No. 2449) | mG;rU;mU;rG;mA;rG;mG;rA;mG;rU;rU;rC;mC;rA;mC;rA;mU;rU;mC (SEQ ID No. 2949) | 11 | 0.174 | 6 |
| Q-273 | rG;rA;rA;mU;rG;mU;rG;mG;rA;mA;rC;mU;rC;mU;rC;rA;mA;rC (SEQ ID No. 2449) | mG;rU;mU;rG;mA;rG;mG;rA;mG;rU;rU;rC;mC;rA;mC;rA;mU;rU;mC$ (SEQ ID No. 2949) | 20 | | |
| Q-274 | rG;mA;rA;mU;rG;mU;rG;mG;rA;mA;rC;mU;rC;mU;rC;rA;mA;rC$ (SEQ ID No. 2449) | mG;rU;mU;rG;mA;rG;mG;rA;mG;rU;rU;rC;mC;rA;mC;rA;mU;rU;mC$ (SEQ ID No. 2949) | 44 | | |
| Q-275 | rG;rA;rA;rU;rG;rU;rG;rG;rA;rA;rC;rU;rC;rU;rC;rA;rA2p;rA2p;rC$ (SEQ ID No. 2449) | mG;rU;mU;rG;mA;rG;mG;rA;mG;rU;rU;rC;mC;rA;mC;rA;mU;rU;mC$ (SEQ ID No. 2949) | 88 | | |
| Q-276 | rG;rA;rA;rU;rG;rU;rG;rG;rA;rA;rC;rU;rC;rU;rC;rA2p;rA2p;rC (SEQ ID No. 2449) | mG;rU;mU;rG;mA;rG;mA;rG;mG;rA;mG;rU;rU;rC;mC;rA;mC;rA;mU;rU;mC$ (SEQ ID No. 2949) | 54 | | |
| Q-277 | rG;rA;rA;rU;rG;rU;rG;rG;rA;rA;rC;rU;rC;rU;rC;rA2p;rA2p;rC2p (SEQ ID No. 2449) | mG;rU;mU;rG;mA;rG;mG;rA;mG;rU;rU;rC;mC;rA;mC;rA;mU;rU;mC$ (SEQ ID No. 2949) | 46 | | |
| Q-278 | rG;rA;rA;rU;rG;rU;rG;rG;rA;rA;rC;rU;rC;rU;rC;rA;LdA;LdC (SEQ ID No. 2449) | mG;rU;mU;rG;mA;rG;mG;rA;mG;rU;rU;rC;mC;rA;mC;rA;mU;rU;mC$ (SEQ ID No. 2949) | 16 | 0.329 | 16 |
| Q-279 | rG;rA;rA;rU;rG;rU;rG;rG;rA;rA;rC;rU;rC;rU;rC;rA;LdA;LdC$ (SEQ ID No. 2449) | mG;rU;mU;rG;mA;rG;mG;rA;mG;rU;rU;rC;mC;rA;mC;rA;mU;rU;mC$ (SEQ ID No. 2949) | 28 | | |
| Q-280 | iB;mG;mA;mA;mG;mA;mA;mA;mG;mU;mC;mC;rG;rC;rA;rA;rA (SEQ ID No. 87179) | s;rU;rU;rU;rG;rC;rG;rA;rA;rA;rG;mA;rA;rU;mU;mU;mU;mC (SEQ ID No. 87180) | 10 | | |
| Q-281 | iB;rG;rA;rA;rG;rA;rA;rA;rG;rU;rU;rU;rC;rG;rC;rA;rA;rA (SEQ ID No. 87179) | s;mU;rU;mU;rU;mU;rG;rC;mG;rA;rA;rA;rG;mA;rA;rU;rU;rU;mC (SEQ ID No. 87180) | 4 | | |
| Q-282 | rG2p;rA2p;rA2p;rG;rA;rA;rA;rG;rU;rU;rU;rC;rG;rC;rA;rA;rA (SEQ ID No. 87179) | s;rU2p;rU2p;rU2p;rU;rG;rC;rG;rA;rA;rA;rG;rA;rA;rU;rU;rU;rC (SEQ ID No. 87180) | 24 | | |
| Q-283 | rG;rA;rA;rG;rA;rA;rA;rG;rU;rU;rU;rC;rG;rC;rA;rA2p;rA2p (SEQ ID No. 87179) | s;rU2p;rU2p;rU2p;rU;rG;rC;rG;rA;rA;rA;rG;rA;rA;rU;rU;rU;rC (SEQ ID No. 87180) | 63 | | |
| Q-284 | iB;rG;rA;rA;rG;rA;rA;rA;rG;rU;rU;rU;rC;rG;rC;rA;rA2p;rA2p (SEQ ID No. 87179) | s;rU;rU;rU;rU;rG;rC;rG;rA;rA;rA;rG;rA;rA;rU;rU;rU;rC;rU2p;rC2p (SEQ ID No. 87180) | 19 | | |
| Q-285 | rG;mC;rC;mA;rC;mU;rU;mA;rU;mG;rU;mA (SEQ ID No. 235) | mG;rU;mA;rA;mC;rA;mU;rA;mU;rU;mA;rA;mG;rU;mG;rG;mC (SEQ ID No. 236) | 6.5 | 1.12 | 0 |
| Q-286 | rG;mC;rC;mA;rC;mU;rU;mA;rU;mG;rU;mU;rA (SEQ ID No. 235) | mG;rU;mA;rA;mC;rA;mU;rA;mC;rA;mU;rA;mU;rU;mA;rA;mG;rU;mG;rG;mC (SEQ ID No. 236) | 5.1 | | 0 |
| Q-287 | rG;rC;rC;rA;rC;rU;rU;rA;rU;rG;rU;rA2p;rC$ (SEQ ID No. 235) | mG;rU;mA;rA;mC;rA;mU;rA;mC;rA;mU;rA;mU;rU;mA;rA;mG;rU;mG;rG;mC (SEQ ID No. 236) | 10 | | 1 |
| Q-288 | rG;rC;rC;rA;rC;rU;rU;rA;rU;rA;rU;rG;rU;rA2p;rC (SEQ ID No. 235) | mG;rU;mA;rA;mC;rA;mU;rA;mC;rA;mU;rA;mU;rU;mA;rA;mG;rU;mG;rG;mC (SEQ ID No. 236) | 8 | | 1 |

FIG. 23 Continued

| ID | Sense | AntiSense | Activity at 20nM (% of control) | IC50 (nM) | Stability in human serum |
|---|---|---|---|---|---|
| Q-289 | rG;rC;rC;rA;rC;rU;rA;rA;rU;rG;rU;rG;rU;rU2p;rA2p;rC2p (SEQ ID No. 235) | mG;rU;mA;rA;mC;rA;mU;rA;mC;rA;mU;rU;mA;rA;mG;rU;mG;mC (SEQ ID No. 236) | 8.8 | | 1 |
| Q-290 | rG;rC;rC;rA;rC;rU;rA;rA;rU;rG;rU;rG;rU;rU;LdA;LdC (SEQ ID No. 235) | mG;rU;mA;rA;mC;rA;mU;rA;mC;rA;mU;rU;mA;rA;mG;rU;mG;mC (SEQ ID No. 236) | 5.8 | | 1 |
| Q-291 | rG;rC;rC;rA;rC;rU;rA;rA;rU;rG;rU;rG;rU;rU;LdA;LdC$ (SEQ ID No. 235) | mG;rU;mA;rA;mC;rA;mU;rA;mC;rA;mU;rU;mA;rA;mG;rU;mG;mC (SEQ ID No. 236) | 4.9 | | 1 |
| Q-292 | rG;mC;rC;mA;rC;mU;rA;mA;rU;mG;rU;mG;rU;mU;rA; rC (SEQ ID No. 235) | mG;rU;mA;rA;mC;rA;mU;rA;mC;rA;mU;rU;mA;rA;mG;rU;mG;mC$ (SEQ ID No. 236) | 6.7 | | 0 |
| Q-293 | rG;mC;rC;mA;rC;mU;rA;mA;rU;mG;rU;mG;rU;mU;rA; rC$ (SEQ ID No. 235) | mG;rU;mA;rA;mC;rA;mU;rA;mC;rA;mU;rU;mA;rA;mG;rU;mG;mC$ (SEQ ID No. 236) | 6.9 | | 0 |
| Q-294 | rG;rC;rC;rA;rC;rU;rA;rA;rU;rG;rU;rG;rU;rU2p;rA2p;rC$ (SEQ ID No. 235) | mG;rU;mA;rA;mC;rA;mU;rA;mC;rA;mU;rU;mA;rA;mG;rU;mG;mC$ (SEQ ID No. 236) | 26.5 | | 1 |
| Q-295 | rG;rC;rC;rA;rC;rU;rA;rA;rU;rG;rU;rG;rU;rU2p;rA2p;rC (SEQ ID No. 235) | mG;rU;mA;rA;mC;rA;mU;rA;mC;rA;mU;rU;mA;rA;mG;rU;mG;mC$ (SEQ ID No. 236) | 12.9 | | 1 |
| Q-296 | rG;rC;rC;rA;rC;rU;rA;rA;rU;rG;rU;rG;rU;rU2p;rA2p;rC2p (SEQ ID No. 235) | mG;rU;mA;rA;mC;rA;mU;rA;mC;rA;mU;rU;mA;rA;mG;rU;mG;mC$ (SEQ ID No. 236) | 14.5 | | 1 |
| Q-297 | rG;rC;rC;rA;rC;rU;rA;rA;rU;rG;rU;rG;rU;rU;LdA;LdC (SEQ ID No. 235) | mG;rU;mA;rA;mC;rA;mU;rA;mC;rA;mU;rU;mA;rA;mG;rU;mG;mC$ (SEQ ID No. 236) | 8.9 | | 1 |
| Q-298 | rG;rC;rC;rA;rC;rU;rA;rA;rU;rG;rU;rG;rU;rU;LdA;LdC$ (SEQ ID No. 235) | mG;rU;mA;rA;mC;rA;mU;rA;mC;rA;mU;rU;mA;rA;mG;rU;mG;mC$ (SEQ ID No. 236) | 11.9 | | 1 |
| Q-299 | rC;mG;rG;mA;rU;mU;rG;mA;rU;mG;rA;mC;rC;mA;rC;mA; rA (SEQ ID No. 13729) | mU;rU;mG;rU;mG;rU;mG;rU;mG;rC;mA;rU;mC;rA;mU;rC;mC;rC;mG (SEQ ID No. 13932) | 11 | | 6 |
| Q-300 | rC;mG;rG;mA;rU;mU;rG;mA;rU;mG;rA;mC;rC;mA;rC;mA; rA$ (SEQ ID No. 13729) | mU;rU;mG;rU;mG;rU;mG;rU;mG;rC;mA;rU;mC;rA;mU;rC;mC;rC;mG (SEQ ID No. 13932) | 4 | | 6 |
| Q-301 | rC;rG;rG;rA;rU;rU;rG;rA;rU;rG;rA;rC;rA;rC;rA;rC2p;rA2p;rA$ (SEQ ID No. 13729) | mU;rU;mG;rU;mG;rU;mG;rU;mG;rC;mA;rU;mC;rA;mU;rC;mC;rC;mG (SEQ ID No. 13932) | 3 | | 6 |
| Q-302 | rC;rG;rG;rA;rU;rU;rG;rA;rU;rG;rA;rC;rA;rC;rA;rC2p;rA2p;rA (SEQ ID No. 13729) | mU;rU;mG;rU;mG;rU;mG;rU;mG;rC;mA;rU;mC;rA;mU;rC;mC;rC;mG (SEQ ID No. 13932) | 2 | | 6 |
| Q-303 | rC;rG;rG;rA;rU;rU;rG;rA;rU;rG;rA;rC;rA;rC;rA;rC2p;rA2p;rA2p (SEQ ID No. 13729) | mU;rU;mG;rU;mG;rU;mG;rU;mG;rC;mA;rU;mC;rA;mU;rC;mC;rC;mG (SEQ ID No. 13932) | 2 | | 6 |
| Q-304 | rC;rG;rG;rA;rU;rU;rG;rA;rU;rG;rA;rC;rA;rC;rA;rC;LdA;LdA (SEQ ID No. 13729) | mU;rU;mG;rU;mG;rU;mG;rU;mG;rC;mA;rU;mC;rA;mU;rC;mC;rC;mG (SEQ ID No. 13932) | 2 | | 6 |
| Q-305 | rC;rG;rG;rA;rU;rU;rG;rA;rU;rG;rA;rC;rA;rC;rA;rC;LdA;LdA$ (SEQ ID No. 13729) | mU;rU;mG;rU;mG;rU;mG;rU;mG;rC;mA;rU;mC;rA;mU;rC;mC;rC;mG (SEQ ID No. 13932) | 2 | | 3 |
| Q-306 | rC;mG;rG;mA;rU;mU;rG;mA;rU;mG;rA;mC;rC;mA;rC;mA; rA (SEQ ID No. 13729) | mU;rU;mG;rU;mG;rU;mG;rU;mG;rC;mA;rU;mC;rA;mU;rC;mC;rC;mG$ (SEQ ID No. 13932) | 5 | | 6 |

FIG. 23 Continued

| ID | Sense | AntiSense | Activity at 20nM (% of control) | IC50 (aM) | Stability in human serum |
|---|---|---|---|---|---|
| Q-307 | rC;rG;rG;mA;rA;mU;rG;mA;rU;mG;mA;rU;mG;rA;mG;rC;mA;rC;mA;rC;mA;rA$ (SEQ ID No. 13729) | mU;rU;mG;rU;mG;rU;mG;rU;mG;rA;mU;rC;mA;rU;mC;rA;mU;rU;mC;rC;mG$ (SEQ ID No. 13932) | 5 | | 3 |
| Q-308 | rC;rG;rG;rA;rA;rU;rG;rA;rU;rG;rA;rU;rG;rA;rG;rC;rA;rC;rA;rC2p;rA2p;rA$ (SEQ ID No. 13729) | mU;rU;mG;rU;mG;rU;mG;rU;mG;rA;mU;rC;mA;rU;mC;rA;mU;rU;mC;rC;mG$ (SEQ ID No. 13932) | 5 | | 8 |
| Q-309 | rC;rG;rG;rA;rA;rU;rG;rA;rU;rG;rA;rU;rG;rA;rG;rC;rA;rC;rA;rC2p;rA2p;rA (SEQ ID No. 13729) | mU;rU;mG;rU;mG;rU;mG;rU;mG;rA;mU;rC;mA;rU;mC;rA;mU;rU;mC;rC;mG$ (SEQ ID No. 13932) | 3 | | 8 |
| Q-310 | rC;rG;rG;rA;rA;rU;rG;rA;rU;rG;rA;rU;rG;rA;rG;rC;rA;rC;rA;rC2p;rA2p;rU (SEQ ID No. 13729) | mU;rU;mG;rU;mG;rU;mG;rU;mG;rA;mU;rC;mA;rU;mC;rA;mU;rU;mC;rC;mG$ (SEQ ID No. 13932) | 2 | | 1 |
| Q-311 | rC;rG;rG;rA;rA;rU;rG;rA;rU;rG;rA;rU;rG;rC;rA;rC;rA;rC;LdA;LdA (SEQ ID No. 13729) | mU;rU;mG;rU;mG;rU;mG;rU;mG;rA;mU;rC;mA;rU;mC;rA;mU;rU;mC;rC;mG$ (SEQ ID No. 13932) | 2 | | 1 |
| Q-312 | rC;rG;rG;rA;rA;rU;rG;rA;rU;rG;rA;rU;rG;rC;rA;rC;rA;rC;LdA;LdA$ (SEQ ID No. 13729) | mU;rU;mG;rU;mG;rU;mG;rU;mG;rA;mU;rC;mA;rU;mC;rA;mU;rU;mC;rC;mG$ (SEQ ID No. 13932) | 3 | | 3 |
| Q-313 | rG;mA;rA;mG;rG;mA;rU;mC;rU;mC;mG;mA;rA;mU;rG;mA;rU (SEQ ID No. 13750) | mA;rU;mC;rA;mU;rU;mC;rA;mG;mA;rG;mA;rU;mC;mU;rU;mC (SEQ ID No. 13953) | 1.7 | | 24 |
| Q-314 | mA;rA;mG;rG;mA;rU;mC;rU;mC;mG;mA;rA;mU;rG;mA;rU$ (SEQ ID No. 13750) | mA;rU;mC;rA;mU;rU;mC;rA;mG;mA;rG;mA;rU;mC;mU;rU;mC (SEQ ID No. 13953) | 2.1 | | 24 |
| Q-315 | rG;rA;rA;rG;rG;rA;rU;rC;rU;rC;rG;rA;rA;rU;rG2p;rA2p;rU$ (SEQ ID No. 13750) | mA;rU;mC;rA;mU;rU;mC;rA;mG;mA;rG;mA;rU;mC;mU;rU;mC (SEQ ID No. 13953) | 3.4 | | 1 |
| Q-316 | rG;rA;rA;rG;rG;rA;rU;rC;rU;rC;rG;rA;rA;rU;rG2p;rA2p;rU (SEQ ID No. 13750) | mA;rU;mC;rA;mU;rU;mC;rA;mG;mA;rG;mA;rU;mC;mU;rU;mC (SEQ ID No. 13953) | 3.2 | | 10 |
| Q-317 | rG;rA;rA;rG;rG;rA;rU;rC;rU;rC;rG;rA;rA;rU;rG2p;rA2p;rU2p (SEQ ID No. 13750) | mA;rU;mC;rA;mU;rU;mC;rA;mG;mA;rG;mA;rU;mC;mU;rU;mC (SEQ ID No. 13953) | 3.2 | | 24 |
| Q-318 | rG;rA;rA;rG;rG;rA;rU;rC;rU;rC;rG;rA;rA;rU;LdA;LdT (SEQ ID No. 13750) | mA;rU;mC;rA;mU;rU;mC;rA;mG;mA;rG;mA;rU;mC;mU;rU;mC (SEQ ID No. 13953) | 2.2 | | 6 |
| Q-319 | rG;rA;rA;rG;rG;rA;rU;rC;rU;rC;rG;rA;rA;rU;rG;LdA;LdT$ (SEQ ID No. 13750) | mA;rU;mC;rA;mU;rU;mC;rA;mG;mA;rG;mA;rU;mC;mU;rU;mC (SEQ ID No. 13953) | 2.5 | | 6 |
| Q-320 | rG;mA;rA;mG;rG;mA;rU;mC;rU;mC;mG;mA;rA;mU;rG;mA;rU (SEQ ID No. 13750) | mA;rU;mC;rA;mU;rU;mC;rA;mG;mA;rG;mA;rU;mC;mU;rU;mC$ (SEQ ID No. 13953) | 3 | | 24 |
| Q-321 | rG;mA;rA;mG;rG;mA;rU;mC;rU;mC;mG;mA;rA;mU;rG;mA;rU$ (SEQ ID No. 13750) | mA;rU;mC;rA;mU;rU;mC;rA;mG;mA;rG;mA;rU;mC;mU;rU;mC$ (SEQ ID No. 13953) | 6 | | 24 |
| Q-322 | rG;rA;rA;rG;rA;rU;rC;rU;rC;rG;rA;rA;rU;rG2p;rA2p;rU$ (SEQ ID No. 13750) | mA;rU;mC;rA;mU;rU;mC;rA;mG;mA;rG;mA;rU;mC;mU;rU;mC (SEQ ID No. 13953) | 6 | | 10 |
| Q-323 | rG;rA;rA;rG;rG;rA;rU;rC;rU;rC;rG;rA;rA;rU;rG2p;rA2p;rU (SEQ ID No. 13750) | mA;rU;mC;rA;mU;rU;mC;rA;mG;mA;rG;mA;rU;mC;mU;rU;mC$ (SEQ ID No. 13953) | 4 | | 10 |
| Q-324 | rG;rA;rA;rG;rG;rA;rU;rC;rU;rC;rG;rA;rA;rU;rG2p;rA2p;rU2p (SEQ ID No. 13750) | mA;rU;mC;rA;mU;rU;mC;rA;mG;mA;rG;mA;rU;mC;mU;rU;mC$ (SEQ ID No. 13953) | 5 | | 16 |

FIG. 23 Continued

| ID | Sense | AntiSense | Activity at 20nM (% of control) | IC50 (nM) | Stability in human serum |
|---|---|---|---|---|---|
| Q-325 | rG;rA;rG;rA;rG;rA;rU;rC;rU;rC;rG;rA;rA;rU;rG;LdA;LdT (SEQ ID No. 13750) | mA;rU;mC;rA;mU;rU;mC;rC;mG;rA;mA;rU;mC;rC;mU;rU;mC$ (SEQ ID No. 13953) | 4 | | 3 |
| Q-326 | rG;rA;rA;rG;rG;rA;rU;rC;rU;rU;rC;rG;rA;rA;rU;rG;LdA;LdT$ (SEQ ID No. 13750) | mA;rU;mC;rA;mU;rU;mC;rC;mG;rA;mA;rU;mC;rC;mU;rU;mC$ (SEQ ID No. 13953) | 4 | | 10 |
| Q-327 | rU;mC;rG;mA;rC;mA;rG;mC;rC;mC;rU;mG;rA;mU;rA;mG;rU;mU;rU (SEQ ID No. 13798) | mA;rA;mA;rC;mU;rA;mU;rC;mA;rG;mG;rG;mC;rU;mG;rU;mC;rG;mA (SEQ ID No. 14001) | | | 24 |
| Q-328 | rU;mC;rG;mA;rC;mA;rG;mC;rC;mC;rU;mG;rA;mU;rA;mG;rU;mU;rU$ (SEQ ID No. 13798) | mA;rA;mA;rC;mU;rA;mU;rC;mA;rG;mG;rG;mC;rU;mG;rU;mC;rG;mA (SEQ ID No. 14001) | | | 24 |
| Q-329 | rU;rC;rG;rA;rC;rA;rG;rC;rC;rC;rU;rG;rA;rU;rA;rG;rU;rU;rU$ (SEQ ID No. 13798) | mA;rA;mA;rC;mU;rA;mU;rC;mA;rG;mG;rG;mC;rU;mG;rU;mC;rG;mA (SEQ ID No. 14001) | | | 0 |
| Q-330 | rU;rC;rG;rA;rC;rA;rG;rC;rC;rC;rU;rG;rA;rU;rA;rG;rU2p;rU2p;rU (SEQ ID No. 13798) | mA;rA;mA;rC;mU;rA;mU;rC;mA;rG;mG;rG;mC;rU;mG;rU;mC;rG;mA (SEQ ID No. 14001) | | | 0 |
| Q-331 | rU;rC;rG;rA;rC;rA;rG;rC;rC;rC;rU;rG;rA;rU;rA;rG;rU2p;rU2p;rU2p (SEQ ID No. 13798) | mA;rA;mA;rC;mU;rA;mU;rC;mA;rG;mG;rG;mC;rU;mG;rU;mC;rG;mA (SEQ ID No. 14001) | | | 0 |
| Q-332 | rU;rC;rG;rA;rC;rA;rG;rC;rC;rC;rU;rG;rA;rU;rA;rG;rU;LdT;LdT (SEQ ID No. 13798) | mA;rA;mA;rC;mU;rA;mU;rC;mA;rG;mG;rG;mC;rU;mG;rU;mC;rG;mA (SEQ ID No. 14001) | | | 0 |
| Q-333 | rU;rC;rG;rA;rC;rA;rG;rC;rC;rC;rU;rG;rA;rU;rA;rG;rU;LdT;LdT$ (SEQ ID No. 13798) | mA;rA;mA;rC;mU;rA;mU;rC;mA;rG;mG;rG;mC;rU;mG;rU;mC;rG;mA (SEQ ID No. 14001) | | | 24 |
| Q-334 | rU;mC;rG;mA;rC;mA;rG;mC;rC;mC;rU;mG;rA;mU;rA;mG;rU;mU;rU (SEQ ID No. 13798) | mA;rA;mA;rC;mU;rA;mU;rC;mA;rG;mG;rG;mC;rU;mG;rU;mC;rG;mA$ (SEQ ID No. 14001) | | | 24 |
| Q-335 | rU;mC;rG;mA;rC;mA;rG;mC;rC;mC;rU;mG;rA;mU;rA;mG;rU;mU;rU$ (SEQ ID No. 13798) | mA;rA;mA;rC;mU;rA;mU;rC;mA;rG;mG;rG;mC;rU;mG;rU;mC;rG;mA$ (SEQ ID No. 14001) | | | 0 |
| Q-336 | rU;rC;rG;rA;rC;rA;rG;rC;rC;rC;rU;rG;rA;rU;rA;rG;rU2p;rU2p;rU$ (SEQ ID No. 13798) | mA;rA;mA;rC;mU;rA;mU;rC;mA;rG;mG;rG;mC;rU;mG;rU;mC;rG;mA$ (SEQ ID No. 14001) | | | 0 |
| Q-337 | rU;rC;rG;rA;rC;rA;rG;rC;rC;rC;rU;rG;rA;rU;rA;rG;rU2p;rU2p;rU (SEQ ID No. 13798) | mA;rA;mA;rC;mU;rA;mU;rC;mA;rG;mG;rG;mC;rU;mG;rU;mC;rG;mA$ (SEQ ID No. 14001) | | | 0 |
| Q-338 | rU;rC;rG;rA;rC;rA;rG;rC;rC;rC;rU;rG;rA;rU;rA;rG;rU2p;rU2p;rU2p (SEQ ID No. 13798) | mA;rA;mA;rC;mU;rA;mU;rC;mA;rG;mG;rG;mC;rU;mG;rU;mC;rG;mA$ (SEQ ID No. 14001) | | | 0 |
| Q-339 | rU;rC;rG;rA;rC;rA;rG;rC;rC;rC;rU;rG;rA;rU;rA;rG;rU;LdT;LdT (SEQ ID No. 13798) | mA;rA;mA;rC;mU;rA;mU;rC;mA;rG;mG;rG;mC;rU;mG;rU;mC;rG;mA$ (SEQ ID No. 14001) | | | 0 |
| Q-340 | rU;rC;rG;rA;rC;rA;rG;rC;rC;rC;rU;rG;rA;rU;rA;rG;rU;LdT;LdT$ (SEQ ID No. 13798) | mA;rA;mA;rC;mU;rA;mU;rC;mA;rG;mG;rG;mC;rU;mG;rU;mC;rG;mA$ (SEQ ID No. 14001) | | | 0 |
| Q-341 | rC;mU;rA;mC;rA;mG;rA;mA;rC;mA;rC;mA;rA;rC;mC;rA;mA;rA;mA;r A (SEQ ID No. 2210) | mU;rU;mU;rU;mU;rG;mG;rU;mU;rG;rU;mG;rU;mU;rC;mU;rG;mU;rA;mG (SEQ ID No. 2710) | 11 | | 24 |
| Q-342 | rC;mU;rA;mC;rA;mG;rA;mA;rC;mA;rC;mA;rA;mC;mC;rA;mA;rA;mA;r A$ (SEQ ID No. 2210) | mU;rU;mU;rU;mU;rG;mG;rU;mU;rG;rU;mG;rU;mU;rC;mU;rG;mU;rA;mG (SEQ ID No. 2710) | 10 | | 24 |

FIG. 23 Continued

| ID | Sense | AntiSense | Activity at 20nM (% of control) | IC50 (nM) | Stability in human serum |
|---|---|---|---|---|---|
| Q-343 | rC;rU;rA;rC;rA;rG;rA;rA;rC;rA;rA;rA;rC;rA;rA;rA2p;rA2p;rA$ (SEQ ID No. 2210) | mU;rU;mU;rU;mU;rG;mG;rU;mU;rU;mU;rC;mU;rG;mU;rA;mG (SEQ ID No. 2710) | 14 | | 1 |
| Q-344 | rC;rU;rA;rC;rA;rG;rA;rA;rC;rA;rA;rA;rC;rA;rA;rA2p;rA2p;rA (SEQ ID No. 2210) | mU;rU;mU;rU;mU;rG;mG;rU;mU;rU;mU;rC;mU;rG;mU;rA;mG (SEQ ID No. 2710) | 11 | | 1 |
| Q-345 | rC;rU;rA;rC;rA;rG;rA;rA;rC;rA;rA;rA;rC;rA;rA;rA2p;rA2p;rA2p (SEQ ID No. 2210) | mU;rU;mU;rU;mU;rG;mG;rU;mU;rU;mU;rC;mU;rG;mU;rA;mG (SEQ ID No. 2710) | 8 | | 1 |
| Q-346 | rC;rU;rA;rC;rA;rG;rA;rA;rC;rA;rA;rA;rC;rA;rA;rA;LdA;LdA (SEQ ID No. 2210) | mU;rU;mU;rU;mU;rG;mG;rU;mU;rU;mU;rC;mU;rG;mU;rA;mG (SEQ ID No. 2710) | 13 | | 1 |
| Q-347 | rC;rU;rA;rC;rA;rG;rA;rA;rC;rA;rA;rA;rC;rA;rA;rA;LdA;LdA$ (SEQ ID No. 2210) | mU;rU;mU;rU;mU;rG;mG;rU;mU;rU;mU;rC;mU;rG;mU;rA;mG$ (SEQ ID No. 2710) | 11 | | 1 |
| Q-348 | rC;mU;rA;mC;rA;mG;rA;mA;rC;rA;mA;rA;mC;rA;mA;rA (SEQ ID No. 2210) | mU;rU;mU;rU;mU;rG;mG;rU;mU;rU;mU;rC;mU;rG;mU;rA;mG$ (SEQ ID No. 2710) | 5 | | 24 |
| Q-349 | rC;mU;rA;mC;rA;mG;rA;mA;rC;rA;mA;rA;mC;rA;mA;rA$ (SEQ ID No. 2210) | mU;rU;mU;rU;mU;rG;mG;rU;mU;rU;mU;rC;mU;rG;mU;rA;mG$ (SEQ ID No. 2710) | 6 | | 24 |
| Q-350 | rC;rU;rA;rC;rA;rG;rA;rA;rC;rA;rA;rA;rC;rA;rA;rA;rA2p;rA2p;rA$ (SEQ ID No. 2210) | mU;rU;mU;rU;mU;rG;mG;rU;mU;rU;mU;rC;mU;rG;mU;rA;mG$ (SEQ ID No. 2710) | 16 | | 0 |
| Q-351 | rC;rU;rA;rC;rA;rG;rA;rA;rC;rA;rA;rA;rC;rA;rA;rA;rA2p;rA2p;rA (SEQ ID No. 2210) | mU;rU;mU;rU;mU;rG;mG;rU;mU;rU;mU;rC;mU;rG;mU;rA;mG$ (SEQ ID No. 2710) | 12 | | 0 |
| Q-352 | rC;rU;rA;rC;rA;rG;rA;rA;rC;rA;rA;rA;rC;rA;rA;rA;rA2p;rA2p;rA2p (SEQ ID No. 2210) | mU;rU;mU;rU;mU;rG;mG;rU;mU;rU;mU;rC;mU;rG;mU;rA;mG$ (SEQ ID No. 2710) | 11 | | 0 |
| Q-353 | rC;rU;rA;rC;rA;rG;rA;rA;rC;rA;rA;rA;rC;rA;rA;rA;LdA;LdA (SEQ ID No. 2210) | mU;rU;mU;rU;mU;rG;mG;rU;mU;rU;mU;rC;mU;rG;mU;rA;mG$ (SEQ ID No. 2710) | 14 | | 1 |
| Q-354 | rC;rU;rA;rC;rA;rG;rA;rA;rC;rA;rA;rA;rC;rA;rA;rA;LdA;LdA$ (SEQ ID No. 2210) | mU;rU;mU;rU;mU;rG;mG;rU;mU;rU;mU;rC;mU;rG;mU;rA;mG$ (SEQ ID No. 2710) | 12 | | 1 |
| Q-355 | rG;mG;rA;mU;rU;rC;mA;rU;mG;rC;mA;rU;mG;rC;mA;rU;mG;rC;mA; rA (SEQ ID No. 2101) | mU;rU;mU;rU;mG;rA;mG;rC;mA;rU;mG;rA;mU;rC;mA;rU;mG;rA;mU;rC;mC (SEQ ID No. 2601) | 39 | | 10 |
| Q-356 | rG;mG;rA;mU;rC;mA;rU;mG;rU;mA;rA;mG;rU;mA;rU;mG;rC;mA; rA$ (SEQ ID No. 2101) | mU;rU;mU;rU;mG;rA;mG;rC;mA;rU;mG;rA;mU;rC;mA;rU;mG;rA;mU;rC;mC (SEQ ID No. 2601) | 25 | | 10 |
| Q-357 | rG;rG;rA;rU;rC;rA;rU;rG;rU;rA;rU;rA;rU;rU;rC;rC2p;rU;rC2p;rA2p;rA$ (SEQ ID No. 2101) | mU;rU;mU;rU;mG;rA;mG;rC;mA;rU;mG;rA;mU;rC;mA;rU;mG;rA;mU;rC;mC (SEQ ID No. 2601) | 100 | | 0 |
| Q-358 | rG;rG;rA;rU;rC;rA;rU;rG;rU;rA;rU;rA;rU;rU;rC;rC2p;rU;rC2p;rA2p;rA (SEQ ID No. 2101) | mU;rU;mU;rU;mG;rA;mG;rC;mA;rU;mG;rA;mU;rC;mA;rU;mG;rA;mU;rC;mC (SEQ ID No. 2601) | 100 | | 0 |
| Q-359 | rG;rG;rA;rU;rC;rA;rU;rG;rU;rA;rU;rA;rU;rU;rC;rC2p;rU;rC2p;rA2p;rA2p (SEQ ID No. 2101) | mU;rU;mU;rU;mG;rA;mG;rC;mA;rU;mG;rA;mU;rC;mA;rU;mG;rA;mU;rC;mC (SEQ ID No. 2601) | 100 | | 0 |
| Q-360 | rG;rG;rA;rU;rC;rA;rU;rG;rU;rA;rU;rA;rU;rU;rC;rC;LdA;LdA (SEQ ID No. 2101) | mU;rU;mU;rU;mG;rA;mG;rC;mA;rU;mG;rA;mU;rC;mA;rU;mG;rA;mU;rC;mC (SEQ ID No. 2601) | 91 | | 1 |

FIG. 23 Continued

| ID | Sense | AntiSense | Activity at 20nM (% of control) | IC50 (nM) | Stability in human serum |
|---|---|---|---|---|---|
| Q-361 | rG;rG;rU;rC;rA;rU;rG;rU;rA;rA;rA;rU;rG;rU;rC;LdA;LdA$ (SEQ ID No. 2101) | mU;rU;mG;rA;mG;rC;mA;rU;mU;rU;mA;rC;mA;rU;mG;rA;mU;rC;mC (SEQ ID No. 2601) | 68 | | 0 |
| Q-362 | rG;mG;rA;mU;rC;mA;rU;mG;rU;mA;rA;mA;rU;mG;rC;mU;rC;mA;rA (SEQ ID No. 2101) | mU;rU;mG;rA;mG;rC;mA;rU;mU;rU;mA;rC;mA;rU;mG;rA;mU;rC;mC$ (SEQ ID No. 2601) | 32 | | 10 |
| Q-363 | rG;mG;rA;mU;rC;mA;rU;mG;rU;mA;rA;mA;rU;mG;rC;mU;rC;mA;rA$ (SEQ ID No. 2101) | mU;rU;mG;rA;mG;rC;mA;rU;mU;rU;mA;rC;mA;rU;mG;rA;mU;rC;mC$ (SEQ ID No. 2601) | 45 | | 10 |
| Q-364 | rG;rG;rA;rU;rC;rA;rU;rG;rU;rA;rA;rA;rU;rG;rC;rU;rC;C2p;rA$ (SEQ ID No. 2101) | mU;rU;mG;rA;mG;rC;mA;rU;mU;rU;mA;rC;mA;rU;mG;rA;mU;rC;mC$ (SEQ ID No. 2601) | 100 | | 0 |
| Q-365 | rG;rG;rA;rU;rC;rA;rU;rG;rU;rA;rA;rA;rU;rG;rC;rU;rC;C2p;rA2p;rA (SEQ ID No. 2101) | mU;rU;mG;rA;mG;rC;mA;rU;mU;rU;mA;rC;mA;rU;mG;rA;mU;rC;mC$ (SEQ ID No. 2601) | 67 | | 0 |
| Q-366 | rG;rG;rA;rU;rC;rA;rU;rG;rU;rA;rA;rA;rU;rG;rC;rU;rC;C2p;rA2p;rA2p (SEQ ID No. 2101) | mU;rU;mG;rA;mG;rC;mA;rU;mU;rU;mA;rC;mA;rU;mG;rA;mU;rC;mC$ (SEQ ID No. 2601) | 73 | | 0 |
| Q-367 | rG;rG;rA;rU;rC;rA;rU;rG;rU;rA;rA;rA;rU;rG;rC;rU;rC;LdA (SEQ ID No. 2101) | mU;rU;mG;rA;mG;rC;mA;rU;mU;rU;mA;rC;mA;rU;mG;rA;mU;rC;mC$ (SEQ ID No. 2601) | 88 | | 1 |
| Q-368 | rG;rG;rA;rU;rC;rA;rU;rG;rU;rA;rA;rA;rU;rG;rC;rU;rC;LdA;LdA (SEQ ID No. 2101) | mU;rU;mG;rA;mG;rC;mA;rU;mU;rU;mA;rC;mA;rU;mG;rA;mU;rC;mC$ (SEQ ID No. 2601) | 71 | | 0.5 |
| Q-369 | rG;rA;rG;rU;rC;rC;rU;rG;rC;rA;rU;rU;rU;rG;rA2p;rA2p$ (SEQ ID No. 211) | mU;rU;mC;rA;mA;rA;mU;rG;mC;rA;mG;rG;mA;rC;mU;rC;mC$ (SEQ ID No. 212) | 52 | | 0 |
| Q-370 | rG;rA;rG;rU;rC;rC;rU;rG;rC;rA;rU;rU;rU;rG;rA2p;rA2p;rA2p (SEQ ID No. 211) | mU;rU;mC;rA;mA;rA;mU;rG;mC;rA;mG;rG;mA;rC;mU;rC;mC$ (SEQ ID No. 212) | 55 | | 0 |
| Q-371 | rG;rA;rG;rU;rC;rC;rU;rG;rC;rA;rU;rU;rU;rG;LdA;LdA (SEQ ID No. 211) | mU;rU;mC;rA;mA;rA;mU;rG;mC;rA;mG;rG;mA;rC;mU;rC;mC$ (SEQ ID No. 212) | 40 | | 0 |
| Q-372 | rG;rA;rG;rU;rC;rC;rU;rG;rC;rA;rU;rU;rU;rG;LdA;LdA$ (SEQ ID No. 211) | mU;rU;mC;rA;mA;rA;mU;rG;mC;rA;mG;rG;mA;rC;mU;rC;mC$ (SEQ ID No. 212) | 40 | | 0 |
| Q-373 | mG;mA;mG;mU;mC;rC;rU;rG;rC;rA;rU;rU;rU;rG;LdA;LdA (SEQ ID No. 211) | mU;rU;mC;rA;mA;rA;mU;rG;mC;rA;mG;rG;mA;rC;mU;rC;mC$ (SEQ ID No. 212) | 53 | | 0 |
| Q-374 | mG;mA;mG;mU;mC;rC;rU;rG;rC;rA;rU;rU;rU;rG;LdA;LdA$ (SEQ ID No. 211) | mU;rU;mC;rA;mA;rA;mU;rG;mC;rA;mG;rG;mA;rC;mU;rC;mC$ (SEQ ID No. 212) | 39 | | 0 |
| Q-375 | rU;rC;rC;rC;rU;rG;rU;rU;rU;rG;rA;rU;rG;rA;rU;rC;rA2p;rA2p$ (SEQ ID No. 87232) | mU;rU;mG;rA;mU;rC;mA;rU;mC;rA;mA;rA;mC;rA;mG;rG;mA$ (SEQ ID No. 87233) | 12 | | 0 |
| Q-376 | rU;rC;rC;rC;rU;rG;rU;rU;rU;rG;rA;rU;rG;rA;rU;rC;rA2p (SEQ ID No. 87232) | mU;rU;mG;rA;mU;rC;mA;rU;mC;rA;mA;rA;mC;rA;mG;rG;mA$ (SEQ ID No. 87233) | 15 | | 8 |
| Q-377 | rU;rC;rC;rC;rU;rG;rU;rU;rU;rG;rA;rU;rG;rA;rU;rC;LdA;LdA (SEQ ID No. 87232) | mU;rU;mG;rA;mU;rC;mA;rU;mC;rA;mA;rA;mC;rA;mG;rG;mA$ (SEQ ID No. 87233) | 13 | | 0 |
| Q-378 | rU;rC;rC;rC;rU;rG;rU;rU;rU;rG;rA;rU;rG;rA;rU;rC;LdA;LdA$ (SEQ ID No. 87232) | mU;rU;mG;rA;mU;rC;mA;rU;mC;rA;mA;rA;mC;rA;mG;rG;mA$ (SEQ ID No. 87233) | 9 | | 0 |

FIG. 23 Continued

| ID | Sense | AntiSense | Activity at 20nM (% of control) | IC50 (nM) | Stability in human serum |
|---|---|---|---|---|---|
| Q-379 | rU;mC;mC;mC;mG;rU;rU;rU;rA;rA;rG;rA;rU;rG;rA;rC;LdA;Ld A (SEQ ID No. 87232) | mU;rU;mG;rU;rU;rC;mU;rA;mC;rA;mA;rA;mC;rA;mC;rG;mG;rG;mA$ (SEQ ID No. 87233) | 13 | | 1 |
| Q-380 | mU;mC;mC;mC;mG;rU;rU;rU;rG;rU;rG;rA;rA;rG;rA;rU;rG;rA;rC;LdA;Ld A$ (SEQ ID No. 87232) | mU;rU;mG;rU;rU;rC;mU;rA;mC;rA;mA;rA;mC;rA;mC;rG;mG;rG;mA$ (SEQ ID No. 87233) | 21 | | 1 |
| Q-381 | rU;rC;rC;rC;rG;rU;rU;rU;rG;rU;rG;rA;rU;rG;rA;dCpac;dApac;rA$ (SEQ ID No. 87232) | mU;rU;mG;rU;rU;rC;mU;rA;mC;rA;mA;rA;mC;rA;mC;rG;mG;rG;mA$ (SEQ ID No. 87233) | 5 | | 0 |
| Q-382 | dTpac;dCpac;rC;rC;rG;rU;rU;rU;rG;rU;rA;rG;rA;rU;rG;rA;rC;rA;rA (SEQ ID No. 87232) | mU;rU;mG;rU;rU;rC;mU;rA;mC;rA;mA;rA;mC;rA;mC;rG;mG;rG;mA$ (SEQ ID No. 87233) | 22 | | 0 |
| Q-383 | dTpac;dCpac;rC;rG;rU;rU;rU;rG;rU;rA;rG;rA;rU;rG;rG;rA;dCpac;d Apac;rA$ (SEQ ID No. 87232) | mU;rU;mG;rU;rU;rC;mU;rA;mC;rA;mA;rA;mC;rA;mC;rG;mG;rG;mA$ (SEQ ID No. 87233) | 8 | | 1 |
| Q-384 | rU;rC;rC;rC;rG;rU;rU;rU;rG;rU;rA;rG;rA;rU;rG;rA;dApac;dCpac;rA;rA$ (SEQ ID No. 87232) | mU;rU;mG;rU;rU;rC;mU;rA;mC;rA;mA;rA;mC;rA;mC;rG;mG;rG;mA$ (SEQ ID No. 87233) | 7 | | 1 |
| Q-385 | mU;mC;mC;mC;mG;rU;rU;rU;rG;rU;rA;rG;rA;rU;rG;rA;rC;rA;rA$ (SEQ ID No. 87232) | mU;rU;mG;rU;rU;rC;mU;rA;mC;rA;mA;rA;mC;rA;mC;rG;mG;rG;mA$ (SEQ ID No. 87233) | 9 | | 1 |
| Q-386 | rU;rC;rC;rC;rG;rU;rU;rU;rG;rU;rA;rG;rA;rU;rG;rA;rC;dApac;rA;rA$ (SEQ ID No. 87232) | mU;rU;mG;rU;rU;rC;mU;rA;mC;rA;mA;rA;mC;rA;mC;rG;mG;rG;mA$ (SEQ ID No. 87233) | 7 | | 1 |
| Q-387 | dTpac;dCpac;rC;rG;rU;rU;rU;rG;rU;rA;rG;rA;rU;rC;rA;dCpac;dApac;rA$ (SEQ ID No. 87232) | rU;rU;rG;rU;rU;rC;rU;rA;rC;rA;rA;rA;rC;rA;rC;rG;dGpac;dGpac;rA$ (SEQ ID No. 87233) | 15 | | 0 |
| Q-388 | dTpac;dCpac;rC;rC;rG;rU;rG;rU;rA;rG;rA;rU;rG;rA;rC;rA;rA$ (SEQ ID No. 87232) | rU;rU;rG;rU;rU;rC;rU;rA;rC;rA;rA;rA;rC;rA;rC;rG;dGpac;dGpac;rA$ (SEQ ID No. 87233) | 16 | | 1 |
| Q-389 | dTpac;dCpac;rC;rG;rU;rU;rU;rG;rU;rA;rG;rA;rU;rG;rA;dCpac;dApac;rA$ (SEQ ID No. 87232) | rU;rU;rG;rU;rU;rC;rU;rA;rC;rA;rA;rA;rC;rA;rC;rG;dGpac;dGpac;rA$ (SEQ ID No. 87233) | 49 | | 0 |
| Q-390 | rU;rC;rC;rC;rG;rU;rU;rU;rG;rU;rA;rG;rA;rU;rG;dApac;dCpac;rA;rA$ (SEQ ID No. 87232) | rU;rU;rG;rU;rU;rC;rU;rA;rC;rA;rA;rA;rC;rA;rC;rG;dGpac;dGpac;rA$ (SEQ ID No. 87233) | 25 | | 0 |
| Q-391 | rU;rC;rC;rC;rG;rU;rU;rG;rU;rA;rG;rA;rU;rG;rA;rC;dApac;rA$ (SEQ ID No. 87232) | rU;rU;rG;rU;rU;rC;rU;rA;rC;rA;rA;rA;rC;rA;rC;rG;dGpac;dGpac;rA$ (SEQ ID No. 87233) | 49 | | 0 |
| Q-392 | rU;rC;rC;rC;rG;rU;rU;rU;rG;rU;rA;rG;rA;rC;dCpac;rA;rA$ (SEQ ID No. 87232) | rU;rU;rG;rU;rU;rC;rU;rA;rC;rA;rA;rA;rC;rA;rC;rG;dGpac;dGpac;rA$ (SEQ ID No. 87233) | 49 | | 1 |
| Q-393 | rG;rC;rC;rA;rG;rA;rA;rU;rG;rU;rG;dG;dA;dC;dT;dC;dC;dT$ (SEQ ID No. 139) | dA;dG;dG;dA;dG;dT;dT;dC;rC;rA;rC;rA;rU;rU;rC;rU;rG;rG;rC$ (SEQ ID No. 140) | 93 | | 10 |
| Q-394 | rG;rC;rC;rA;rG;rA;rA;rU;rG;rU;rG;rG;dA;dC;dT;dC;dC;dT$ (SEQ ID No. 139) | dA;dG;dG;dA;dG;dT;rC;rC;rA;rC;rA;rU;rU;rC;rU;rG;rG;rC$ (SEQ ID No. 140) | 121 | | 10 |
| Q-395 | rG;rC;rC;rA;rG;rA;rA;rU;rG;rU;rG;rG;rA;dC;dT;dC;dC;dT$ (SEQ ID No. 139) | dA;dG;dG;dA;dG;dT;dT;rC;rA;rC;rA;rU;rU;rC;rU;rG;rG;rC$ (SEQ ID No. 140) | 74 | | 10 |
| Q-396 | rG;rC;rC;rA;rG;rA;rA;rU;rG;rU;rG;rG;dA;dC;dC;dC;dT$ (SEQ ID No. 139) | dA;dG;dG;dA;dG;rU;rC;rC;rA;rC;rA;rU;rU;rC;rU;rG;rG;rC$ (SEQ ID No. 140) | 83 | | 10 |

FIG. 23 Continued

| ID | Sense | AntiSense | Activity at 20nM (% of control) | IC50 (nM) | Stability in human serum |
|---|---|---|---|---|---|
| Q-397 | rG;rC;rC;rA;rG;rA;rG;rU;rG;dA;dG;dA;dC;dT;dC;dC;dT$ (SEQ ID No. 139) | dA;dG;dG;dA;dG;rU;rC;rU;rC;rA;rC;rU;rC;rU;rG;dG;dG;dC$ (SEQ ID No. 140) | 85 | | 3 |
| Q-398 | rG;rC;rC;rA;rG;rA;rG;rU;rG;dA;dA;dG;dA;dC;dT;dC;dC;dT$ (SEQ ID No. 139) | dA;dG;dG;dA;dG;rU;rC;rU;rU;rC;rA;rC;rU;rC;rU;rG;rG;rC$ (SEQ ID No. 140) | 83 | | 16 |
| Q-399 | rG;rC;rC;rA;rG;rA;rG;rU;rG;dA;dA;dG;dA;dC;dT;dC;dC;dT$ (SEQ ID No. 139) | dA;dG;dG;dA;dG;dT;dT;rC;rU;rC;rA;rC;rU;rC;rU;rG;rG;rC$ (SEQ ID No. 140) | 127 | | 10 |
| Q-400 | rG;rC;rC;rA;rG;rA;rG;rU;rG;dA;dA;dG;dA;dC;dT;dC;dC;dT$ (SEQ ID No. 139) | dA;dG;dG;dA;dG;dT;rU;rC;rU;rC;rA;rC;rU;rC;rU;rG;rG;rC$ (SEQ ID No. 140) | 151 | | 10 |
| Q-401 | rG;rC;rC;rA;rG;rA;rG;rU;rG;dA;dA;dG;dA;dC;dT;dC;dC;dT$ (SEQ ID No. 139) | dA;dG;dG;dA;dG;rU;rC;rU;rC;rA;rC;rU;rC;rU;rG;rG;rC$ (SEQ ID No. 140) | 73 | | 10 |
| Q-402 | rG;rC;rC;rA;rG;rA;rG;rU;rG;rA;dA;dA;dC;dA;dC;dT;dC;dC;dT$ (SEQ ID No. 139) | dA;dG;dG;dA;dG;rU;rC;rU;rC;rA;rC;rU;rC;rU;dG;dG;dC$ (SEQ ID No. 140) | 27 | | 10 |
| Q-403 | rG;rC;rC;rA;rG;rA;rG;rU;rG;rA;dA;dG;dA;dC;dT;dC;dC;dT$ (SEQ ID No. 139) | dA;dG;dG;dA;dG;rU;rC;rU;rC;rA;rC;rU;rC;rU;rG;rG;rC$ (SEQ ID No. 140) | 35 | | 10 |
| Q-404 | rG;rC;rC;rA;rG;rA;rG;rU;rG;rA;rA;dG;dA;dC;dT;dC;dC;dT$ (SEQ ID No. 139) | dA;dG;dG;dA;dG;rU;rC;rU;rC;rA;rC;rU;rC;rU;rG;rG;rC$ (SEQ ID No. 140) | 15 | | 10 |
| Q-405 | rG;rC;rC;rA;rG;rA;rG;rU;rG;rA;rA;rG;dA;dC;dT;dC;dC;dT$ (SEQ ID No. 139) | dA;dG;dG;dA;dG;rU;rC;rU;rC;rA;rC;rU;rC;rU;rG;rG;rC$ (SEQ ID No. 140) | 23 | | 10 |
| Q-406 | rG;rC;rC;rA;rG;rA;rG;rU;rG;rA;rA;rG;rA;dC;dT;dC;dC;dT$ (SEQ ID No. 139) | dA;dG;dG;dA;dG;rU;rC;rU;rC;rA;rC;rU;rC;rU;rG;rG;rC$ (SEQ ID No. 140) | 21 | | 10 |
| Q-407 | rG;rC;rC;rA;rG;rA;rG;rU;rG;rA;rA;rG;rA;rC;dT;dC;dC;dT$ (SEQ ID No. 139) | dA;dG;dG;dA;dG;rU;rC;rU;rC;rA;rC;rU;rC;dT;dG;dG;dC$ (SEQ ID No. 140) | 28 | | 1 |
| Q-408 | dG;dC;dC;dA;dG;dA;dG;dA;rA;rU;rG;rC;rU;rC;rU$ (SEQ ID No. 139) | dA;dG;dG;dA;dG;rU;rU;rC;rU;rC;rA;rU;rU;rC;rU;rG;rG;rC$ (SEQ ID No. 140) | 39 | | 1 |
| Q-409 | dG;dC;dC;dC;dA;dG;dA;dG;dA;rA;rU;rG;rC;rU;rC;rU$ (SEQ ID No. 139) | dA;dG;dG;dA;dG;dT;dT;rC;rU;rC;rA;rC;rU;rC;rU;rG;rG;rC$ (SEQ ID No. 140) | 56 | | 0.5 |
| Q-410 | dG;dC;dC;dA;dG;dA;dG;dA;rA;rU;rG;rC;rU;rC;rU$ (SEQ ID No. 139) | dA;dG;dG;dA;dG;dT;rU;rC;rU;rC;rA;rC;rU;rC;rU;rG;rG;rC$ (SEQ ID No. 140) | 51 | | 10 |
| Q-411 | dG;dC;dC;dA;dG;dA;dG;dA;rA;rU;rG;rC;rU;rC;rU$ (SEQ ID No. 139) | dA;dG;dG;dA;dG;rU;rC;rU;rC;rA;rC;rU;rC;rU;rG;rG;rC$ (SEQ ID No. 140) | 50 | | 0 |
| Q-412 | dG;dC;dC;dA;dG;dA;dG;rA;rA;rU;rG;rC;rU;rC;rU$ (SEQ ID No. 139) | dA;dG;dG;dA;dG;dT;rA;rC;rU;rC;rA;rC;rU;rU;rG;rG;rC$ (SEQ ID No. 140) | 109 | | 3 |
| Q-413 | dG;dC;dC;dA;dG;dA;rG;rA;rA;rU;rG;rG;rA;dC;dT;dC;dC;dT$ (SEQ ID No. 139) | dA;dG;dG;dA;dG;dT;dT;rC;rU;rC;rA;rC;rU;rU;rG;rG;rC$ (SEQ ID No. 140) | 94 | | 0.5 |
| Q-414 | dG;dC;dC;dA;dG;dA;rG;rU;rG;rA;rA;dC;dA;dC;dT;dC;dC;dT$ (SEQ ID No. 139) | dA;dG;dG;dA;dG;dT;dT;rC;rU;rC;rA;rC;rU;rU;rC;rG;rG;rC$ (SEQ ID No. 140) | 118 | | 0.5 |

FIG. 23 Continued

| ID | Sense | AntiSense | Activity at 20nM (% of control) | IC50 (nM) | Stability in human serum |
|---|---|---|---|---|---|
| Q-415 | dG;dC;dC;dA;dG;dA;rA;rU;rG;rA;rU;rG;rA;dA;dC;dT;dC;dC;dT$ (SEQ ID No. 139) | dA;dG;dG;dA;dG;dT;rU;rC;rC;rA;rC;rA;rU;rC;rA;rU;rC;rU;rG;rG;rC$ (SEQ ID No. 140) | 100 | | 0 |
| Q-416 | dG;dC;dC;dC;dA;dG;dA;rA;rU;rG;rA;rU;rG;rA;dA;dC;dT;dC;dC;dT$ (SEQ ID No. 139) | dA;dG;dG;dA;dG;dG;rU;rU;rC;rC;rA;rC;rA;rU;rC;rA;rU;rC;rU;rG;rC$ (SEQ ID No. 140) | 73 | | 0 |
| Q-417 | dG;dC;dC;dC;dA;dG;dA;rA;rU;rG;rA;rU;rG;rA;dA;dC;dT;dC;dC;dT$ (SEQ ID No. 139) | dA;dG;dG;dA;dG;dG;rU;rU;rC;rC;rA;rC;rA;rU;rU;rC;dT;dG;dG;dC$ (SEQ ID No. 140) | 94 | | 10 |
| Q-418 | dG;dC;dC;dC;dA;dG;dA;rA;rU;rG;rA;rU;rG;rA;dA;dA;dC;dT;dC;dC;dT$ (SEQ ID No. 139) | dA;dG;dG;dA;dG;dG;dT;dC;dC;rA;rC;rA;rU;rC;rA;rU;rC;rU;rG;rG;rC$ (SEQ ID No. 140) | 122 | | 8 |
| Q-419 | dG;dC;dC;dC;dA;dG;dA;rA;rU;rG;rA;rU;rG;rG;dA;dA;dC;dT;dC;dC;dT$ (SEQ ID No. 139) | dA;dG;dG;dA;dG;dG;dT;dT;rC;rC;rA;rC;rA;rU;rC;rA;rU;rC;rU;rG;rG;rC$ (SEQ ID No. 140) | 76 | | 10 |
| Q-420 | dG;dC;dC;dC;dA;dG;dA;dG;rA;rA;rU;rG;rA;rU;rG;rG;dA;dA;dC;dT;dC;dC;dT$ (SEQ ID No. 139) | dA;dG;dG;dG;dG;dA;dT;rU;rC;rC;rA;rC;rA;rU;rC;rA;rU;rC;rU;rG;rG;rC$ (SEQ ID No. 140) | 106 | | 10 |
| Q-421 | dG;dC;dC;dC;dA;dG;rA;rA;rU;rG;rA;rU;rG;rA;dA;dA;dC;dT;dC;dC;dT$ (SEQ ID No. 139) | dA;dG;dG;dA;dG;dA;rU;rU;rC;rC;rA;rC;rA;rU;rC;rA;rU;rC;rU;rG;rG;rC$ (SEQ ID No. 140) | 109 | | 0 |
| Q-422 | dG;dC;dC;dC;dA;dG;dA;rA;rU;rG;rA;rU;rG;rA;dA;dA;dC;dT;dC;dC;dT$ (SEQ ID No. 139) | dA;dG;dG;dA;dG;dG;rU;rU;rU;rC;rC;rA;rC;rA;rU;rC;rA;rU;rC;rU;dT;dG;dG;dC$ (SEQ ID No. 140) | 134 | | 16 |
| Q-423 | enaT;rC;rC;rC;rU;rU;rU;rU;rG;rA;rU;rA;rG;rA;rC;rU;rG;rA;rC;rA;rA$ (SEQ ID No. 87232) | mU;rU;mG;rU;mC;rA;mU;rC;mU;rC;mU;rA;mC;rA;mA;rA;mC;rA;mC;rG;mG;rG$ (SEQ ID No. 87233) | 30 | | 0.5 |
| Q-424 | enaT;enaC;rC;rC;rG;rU;rU;rU;rU;rG;rA;rU;rA;rG;rA;rC;rU;rG;rA;rC;rA;rA$ (SEQ ID No. 87232) | mU;rU;mG;rU;mC;rA;mU;rC;mU;rC;mU;rA;mC;rA;mA;rA;mC;rA;mC;rG;mG;rG$ (SEQ ID No. 87233) | 36 | | 0.5 |
| Q-425 | enaT;enaC;enaC;rC;rG;rU;rU;rU;rU;rG;rA;rU;rA;rG;rA;rC;rU;rG;rA;rC;rA;r A$ (SEQ ID No. 87232) | mU;rU;mG;rU;mC;rA;mU;rC;mU;rC;mU;rA;mC;rA;mA;rA;mC;rA;mC;rG;mG;rG;mA$ (SEQ ID No. 87233) | 45 | | 0.5 |
| Q-426 | enaT;enaC;enaC;rC;rG;rU;rU;rU;rU;rG;rA;rU;rA;rG;rA;rU;rG;rA;rC;LdA;LdA$ (SEQ ID No. 87232) | mU;rU;mG;rU;mC;rA;mU;rC;mU;rC;mU;rA;mC;rA;mA;rA;mC;rA;mC;rG;mG;rG;mA$ (SEQ ID No. 87233) | 6 | | 0.5 |
| Q-427 | enaT;enaC;enaC;rC;rG;rU;rU;rU;rU;rG;rA;rU;rA;rG;rA;rU;rG;rA;LdC;Ld A;rA$ (SEQ ID No. 87232) | mU;rU;mG;rU;mC;rA;mU;rC;mU;rC;mU;rA;mC;rA;mA;rA;mC;rA;mC;rG;mG;rG;mA$ (SEQ ID No. 87233) | 24 | | 6 |
| Q-428 | enaT;enaC;enaC;rC;rG;rU;rU;rU;rU;rG;rU;rA;rG;rA;rU;rG;rA;rC2p; A2p;rA$ (SEQ ID No. 87232) | mU;rU;mG;rU;mC;rA;mU;rC;mU;rC;mU;rA;mC;rA;mA;rA;mC;rA;mC;rG;mG;rG;mA$ (SEQ ID No. 87233) | 11 | | 6 |
| Q-429 | enaT;enaC;enaC;rC;rG;rU;rU;rU;rU;rG;rU;rA;rG;rA;rU;rA;rC;rU;rG;rA2p;rC2p ;rA;rA$ (SEQ ID No. 87232) | mU;rU;mG;rU;mC;rA;mU;rC;mU;rC;mU;rA;mC;rA;mA;rA;mC;rA;mC;rG;mG;rG;mA$ (SEQ ID No. 87233) | 31 | | 6 |
| Q-430 | enaT;rC;rC;rC;rG;rU;rU;rU;rU;rG;rU;rA;rG;rA;rU;rG;rA;rC;rA;rA$ (SEQ ID No. 87232) | rU;rU;rG;rU;rC;rA;rU;rC;rU;rC;rU;rA;rC;rA;rA;rA;rC;rG;rG;enaG;enaA$ (SEQ ID No. 87233) | 41 | | 1 |
| Q-431 | enaT;enaC;rC;rC;rG;rU;rU;rU;rU;rG;rU;rA;rG;rA;rU;rG;rA;rC;rA;rA$ (SEQ ID No. 87232) | rU;rU;rG;rU;rC;rA;rU;rC;rU;rC;rU;rA;rA;rA;rA;rC;rG;enaG;enaA$ (SEQ ID No. 87233) | 35 | | 1 |
| Q-432 | enaT;enaC;enaC;rC;rG;rU;rU;rU;rU;rG;rU;rA;rG;rA;rU;rG;rA;rC;rA;r A$ (SEQ ID No. 87232) | rU;rU;rG;rU;rC;rA;rU;rC;rU;rC;rU;rA;rC;rA;rA;rA;rC;rG;enaG;enaA$ (SEQ ID No. 87233) | 50 | | 1 |

FIG. 23 Continued

| ID | Sense | AntiSense | Activity at 20 nM (% of control) | IC50 (nM) | Stability in human serum |
|---|---|---|---|---|---|
| Q-433 | enaT;enaC;enaC;rC;rG;rU;rU;rG;rU;rU;rA;rU;rA;rU;rG;rA;rU;rG;rA;rC;LdA;LdAS (SEQ ID No. 87232) | rU;rU;rG;rU;rC;rA;rU;rC;rU;rU;rA;rU;rA;rC;rA;rA;rC;rG;enaG;enaG;enaA$ (SEQ ID No. 87233) | 32 | | 1 |
| Q-434 | enaT;enaC;enaC;rC;rG;rU;rU;rG;rU;rU;rA;rU;rA;rU;rG;rA;rU;rG;rA;rU;rG;rA;rC;LdA;LdC;LdA;rA$ (SEQ ID No. 87232) | rU;rU;rG;rU;rC;rA;rU;rC;rU;rU;rA;rU;rA;rC;rA;rA;rC;rG;enaG;enaG;enaA$ (SEQ ID No. 87233) | 49 | | 0 |
| Q-435 | enaT;enaC;enaC;rC;rG;rU;rU;rG;rU;rU;rA;rU;rA;rU;rG;rA;rU;rG;rA;rC;rA;A2p;rA$ (SEQ ID No. 87232) | rU;rU;rG;rU;rC;rA;rU;rC;rU;rU;rA;rU;rA;rC;rA;rA;rC;rG;enaG;enaG;enaA$ (SEQ ID No. 87233) | 38 | | 1 |
| Q-436 | enaT;enaC;enaC;rC;rG;rU;rU;rG;rU;rU;rA;rU;rA;rU;rG;rA;rU;rG;rA2p;rC2p;rA;rA$ (SEQ ID No. 87232) | rU;rU;rG;rU;rC;rA;rU;rC;rU;rU;rA;rU;rA;rC;rA;rA;rC;rG;enaG;enaG;enaA$ (SEQ ID No. 87233) | 58 | | 1 |
| Q-437 | rG;LdC;rC;rA;rG;rA;rA;rU;rG;rU;rG;rA;rA;rA;rU;rC;rU;LdC;LdC;rU$ (SEQ ID No. 139) | mA;rG;mG;rA;mG;rU;mU;rC;mC;rA;mC;rA;mC;rA;mU;rU;mC;rU;mG;rG;mC$ (SEQ ID No. 140) | 45 | | |
| Q-438 | rG;LdC;rC;rA;rG;rA;rA;rU;rG;rU;rG;rA;rA;rA;rU;rC;rU;LdC;rU$ (SEQ ID No. 139) | mA;rG;mG;rA;mG;rU;mU;rC;mC;rA;mC;rA;mC;rA;mU;rU;mC;rU;mG;rG;mC$ (SEQ ID No. 140) | 13 | | |
| Q-439 | rG;rC;rC;rA;rG;rA;rA;rU;rG;rU;rG;rA;rA;rA;rU;rC;rU;rC;rU$ (SEQ ID No. 139) | mA;rG;mG;rA;mG;rU;mU;rC;mC;rA;mC;rA;mC;rA;mU;rU;mC;rU;mG;rG;mC$ (SEQ ID No. 140) | 8 | | |
| Q-440 | rG;rC;rC;rA;rG;rA;rA;rU;rG;rU;rG;rA;rA;rA;rU;rC;rU;LdC;LdC;rU$ (SEQ ID No. 139) | mA;rG;mG;rA;mG;rU;mU;rC;mC;rA;mC;rA;mC;rA;mU;rU;mC;rU;mG;rG;mC$ (SEQ ID No. 140) | 23 | | |
| Q-441 | rC;rC;rU;rG;rA;rG;rU;rG;rU;rG;rU;rU;rU;rC;rA;rA;rA;LdG;rA$ (SEQ ID No. 87236) | mU;rC;mU;rG;mU;rU;mU;rG;mA;rC;mA;rC;mU;rC;mA;rG;mG$ (SEQ ID No. 87237) | 8 | | |
| Q-442 | rC;rC;rU;rG;rA;rG;rU;rG;rU;rC;rA;rA;rC;LdG;LdG;rA$ (SEQ ID No. 87236) | mU;rC;mU;rG;mU;rU;mU;rG;mA;rC;mA;rC;mU;rC;mA;rG;mG$ (SEQ ID No. 87237) | 23 | | |
| Q-443 | rC;rC;rU;rG;rA;rG;rU;rG;rU;rC;rA;rA;rC;rA;LdA;rU$ (SEQ ID No. 87236) | mA;rU;mA;rU;mG;rG;mA;rG;mA;rG;mA;rC;rU;mU;rU;rG;mC;rC;mC$ (SEQ ID No. 87237) | 20 | | |
| Q-444 | rG;rG;rC;rA;rA;rA;rG;rU;rC;rU;rC;rU;rC;rC;rA;LdA;LdA;rU$ (SEQ ID No. 87236) | mA;rU;mA;rU;mG;rG;mA;rG;mA;rG;mA;rC;rU;mU;rU;rG;mC;rC;mC$ (SEQ ID No. 87237) | 41 | | |
| Q-445 | rG;rA;rA;rG;rA;rU;rC;rU;rU;rC;rG;rG;rA;rA;rU;rG;LdA;rU$ (SEQ ID No. 13750) | mA;rU;mC;rA;mU;rU;mC;rC;mG;rA;mA;rG;mA;rU;rC;mU;rU;rC$ (SEQ ID No. 13953) | 10 | | |
| Q-446 | rG;rA;rA;rG;rA;rU;rC;rU;rU;rC;rG;rG;rA;rA;LdA;LdA;rG;LdA;rU$ (SEQ ID No. 13750) | mA;rU;mC;rA;mU;rU;mC;rC;mG;rA;mA;rG;mA;rU;rC;mU;rU;rC$ (SEQ ID No. 13953) | 10 | | |
| Q-447 | lB;rG;rA;rA;rG;rA;rU;rC;rU;rU;rC;rG;rG;rA;rA;rU;rG;LdA;rU$ (SEQ ID No. 13750) | mA;rU;mC;rA;mU;rU;mC;rC;mG;rA;mA;rG;mA;rU;rC;mU;rU;rC$ (SEQ ID No. 13953) | 10 | | |
| Q-448 | lB;rG;rA;rA;rG;rA;rU;rC;rU;rU;rC;rG;rG;rA;rA;LdA;LdA;rG;LdA;rU$ (SEQ ID No. 13750) | mA;rU;mC;rA;mU;rU;mC;rC;mG;rA;mA;rG;mA;rU;rC;mU;rU;rC$ (SEQ ID No. 13953) | 46 | | |
| Q-449 | LdA;rG;rA;rA;rG;rA;rU;rC;rU;rU;rC;rG;rG;rA;rA;LdA;LdA;rG;LdA;rU$ (SEQ ID No. 13750) | mA;rU;mC;rA;mU;rU;mC;rC;mG;rA;mA;rG;mA;rU;rC;mU;rU;rC$ (SEQ ID No. 13953) | 10 | | |
| Q-450 | LdA;rG;rA;rA;rG;rA;rU;rC;rU;rU;rC;rG;rG;rA;rdA;rA;rG;LdA;rU$ (SEQ ID No. 13750) | mA;rU;mC;rA;mU;rU;mC;rC;mG;rA;mA;rG;mA;rU;rC;mU;rU;rC$ (SEQ ID No. 13953) | 65 | | |

FIG. 23 Continued

| ID | Sense | AntiSense | Activity at 20nM (% of control) | IC50 (nM) | Stability in human serum |
|---|---|---|---|---|---|
| Q-451 | C6Np;rG;rA;rA;rG;rG;rA;rA;rU;rC;rU;rU;rC;rG;rA;rA;rU;rG;LdA;r US (SEQ ID No. 13750) | mA;rU;mC;rA;mU;rC;mG;rA;rA;mG;rA;mU;rC;mC;rU;mU;rC$ (SEQ ID No. 13953) | 8 | | |
| Q-452 | C6Np;rG;rA;rA;rG;rA;rG;rA;rU;rU;rC;rG;rG;rA;rA;LdA;LdA;rG;LdA;r US (SEQ ID No. 13750) | mA;rU;mC;rA;mU;rC;mG;rA;rA;mG;rA;rA;mC;rU;mU;rC$ (SEQ ID No. 13953) | 0 | | |
| Q-453 | rG;rA;rA;rG;rG;rA;rU;rC;rU;rU;rC;rG;rA;rA;rU;rG;LdA;rU$ (SEQ ID No. 13750) | mA;rU;mC;rA;mU;rC;mG;rA;rA;mG;rA;mU;rC;mC;rU;mU;rC$ (SEQ ID No. 13953) | 7 | | |
| Q-454 | rG;rA;rA;rG;rG;rA;rU;rU;rC;rG;rA;rA;LdA;LdA;rG;LdA;rU$ (SEQ ID No. 13750) | mA;rU;mC;rA;mU;rC;mG;rA;rA;mG;rA;rA;mC;rU;mU;rC$ (SEQ ID No. 13953) | 50 | | |
| Q-455 | iB;rG;rA;rA;rG;rG;rA;rU;rC;rU;rU;rC;rG;rA;rA;rU;rG;LdA;rU$ (SEQ ID No. 13750) | mA;rU;mC;rA;mU;rC;mG;rA;rA;mG;rA;mU;rC;mC;rU;mU;rC$ (SEQ ID No. 13953) | 6 | | |
| Q-456 | iB;rG;rA;rA;rG;rG;rA;rU;rU;rC;rG;rG;rA;rA;LdA;LdA;rG;LdA;rU$ (SEQ ID No. 13750) | mA;rU;mC;rA;mU;rC;mG;rA;rA;mG;rA;rA;mC;rU;mU;rC$ (SEQ ID No. 13953) | 46 | | |
| Q-457 | LdA;rG;rA;rA;rG;rG;rA;rU;rC;rU;rU;rC;rG;rA;rA;rU;rG;LdA;rU$ (SEQ ID No. 13750) | mA;rU;mC;rA;mU;rC;mG;rA;rA;mG;rA;mU;rC;mC;rU;mU;rC$ (SEQ ID No. 13953) | 10 | | |
| Q-458 | LdA;rG;rA;rA;rG;rG;rA;rU;rU;rC;rG;rG;rA;rA;LdA;LdA;rG;LdA;r U$ (SEQ ID No. 13750) | mA;rU;mC;rA;mU;rC;mG;rA;rA;mG;rA;rA;mC;rU;mU;rC$ (SEQ ID No. 13953) | 65 | | |
| Q-459 | C6Np;rG;rA;rA;rG;rG;rA;rU;rC;rU;rU;rC;rG;rA;rA;rU;rG;LdA;rU$ (SEQ ID No. 13750) | mA;rU;mC;rA;mU;rC;mG;rA;rA;mG;rA;mU;rC;mC;rU;mU;rC$ (SEQ ID No. 13953) | 5 | | |
| Q-460 | C6Np;rG;rA;rA;rG;rA;rG;rA;rU;rU;rC;rG;rG;rA;rA;LdA;LdA;rG;LdA;r US (SEQ ID No. 13750) | mA;rU;mC;rA;mU;rC;mG;rA;rA;mG;rA;rA;mC;rU;mU;rC$ (SEQ ID No. 13953) | 62 | | |
| Q-461 | rC;rG;rU;rG;rA;rA;rC;rU;rU;rG;rG;rA;rA;rA;rA;rdT;rU;rG;LdA;rA$ (SEQ ID No. 87239) | mU;rU;mC;rA;mA;rU;mU;mU;rU;rC;mA;rA;mG;rU;mU;rC;mA;rC;mG$ (SEQ ID No. 87239) | 39 | | |
| Q-462 | rC;rG;rU;rG;rA;rA;rC;rU;rU;rG;rG;rA;rA;rA;rA;rdT;rU;rG;LdA;rA$ (SEQ ID No. 87239) | mU;rU;mC;rA;mA;rU;mU;mU;rU;rC;mA;rA;mG;rU;mU;rC;mA;rC;mG$ (SEQ ID No. 87239) | 75 | | |
| Q-463 | iB;rC;rG;rU;rG;rA;rA;rC;rU;rU;rG;rG;rA;rA;rA;rA;rdT;rU;rG;LdA;rA$ (SEQ ID No. 87239) | mU;rU;mC;rA;mA;rU;mU;mU;rU;rC;mA;rA;mG;rU;mU;rC;mA;rC;mG$ (SEQ ID No. 87239) | 70 | | |
| Q-464 | LdA;rC;rG;rU;rG;rA;rA;rC;rU;rU;rG;rG;rA;rA;rA;rA;rdT;LdA;rG;LdA;rA (SEQ ID No. 87239) | mU;rU;mC;rA;mA;rU;mU;mU;rU;rC;mA;rA;mG;rU;mU;rC;mA;rC;mG$ (SEQ ID No. 87239) | 58 | | |
| Q-465 | C6Np;rC;rG;rU;rG;rA;rA;rC;rA;rU;rU;rG;rG;rA;rA;rA;rA;rdT;rU;rG;LdA;rA $ (SEQ ID No. 87239) | mU;rU;mC;rA;mA;rU;mU;mU;rU;rC;mA;rA;mG;rU;mU;rC;mA;rC;mG$ (SEQ ID No. 87239) | 53 | | |
| Q-466 | C6Np;rC;rG;rU;rG;rA;rA;rC;rU;rU;rG;rG;rA;rA;rA;rA;rdT;rU;rG;LdA; rA$ (SEQ ID No. 87239) | mU;rU;mC;rA;mA;rU;mU;mU;rU;rC;mA;rA;mG;rU;mU;rC;mA;rC;mG$ (SEQ ID No. 87239) | 99 | | |
| Q-467 | rC;LdA;rU;rG;rA;rA;rC;rU;rU;rG;rG;rA;rA;rA;rA;rdT;rU;rG;LdA;rA$ (SEQ ID No. 87239) | mU;rU;mC;rA;mA;rU;mU;mU;rU;rC;mA;rA;mG;rU;mU;rC;mA;rC;mG$ (SEQ ID No. 87239) | 80 | | |
| Q-468 | rC;LdA;rU;rG;rA;rA;rC;rU;rU;rG;rG;rA;rA;rA;rA;rdT;LdA;rG;LdA;rA$ (SEQ ID No. 87239) | mU;rU;mC;rA;mA;rU;mU;mU;rU;rC;mA;rA;mG;rU;mU;rC;mA;rC;mG$ (SEQ ID No. 87239) | 121 | | |

FIG. 23 Continued

| ID | Sense | AntiSense | Activity at 20nM (% of control) | IC50 (nM) | Stability in human serum |
|---|---|---|---|---|---|
| Q-469 | rC;rG;rU;rG;rA;rA;rC;rU;rG;rA;rA;rA;dT;rU;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-470 | rC;rG;rU;rG;rA;rA;rC;rU;rG;rA;rA;rA;dT;LdA;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-471 | iB;rC;rG;rU;rG;rA;rA;rC;rU;rA;rA;rA;dT;rU;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-472 | LdA;rC;rG;rU;rG;rA;rA;rC;rU;rG;rA;rA;rA;dT;LdA;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-473 | C6Np;rC;rG;rU;rG;rA;rA;rC;rU;rG;rA;rA;rA;dT;rU;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-474 | C6Np;rC;rG;rU;rG;rA;rA;rC;rU;rG;rA;rA;rA;dT;LdA;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-475 | rC;LdA;rU;rG;rA;rC;rU;rG;rU;rU;rG;rA;rA;rA;dT;rU;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-476 | rC;LdA;rU;rG;rA;rC;rU;rG;rU;rU;rG;rA;rA;rA;dT;LdA;rG;LdA;rA$ (SEQ ID No. 87238) | rU;mU;rC;mA;rA;mU;rC;rC;mA;rA;mG;rU;mU;rC;mA;rC;mG$ (SEQ ID No. 87239) | | | |
| Q-477 | rG;rC;rC;rA;rG;rU;rG;rA;rA;rA;rC;rA;dC;rU;rC;LdC;rU$ (SEQ ID No. 139) | mA;rG;mG;rA;mG;rU;mU;rC;rA;mU;rC;mC;rU;mG;rG;mC$ (SEQ ID No. 140) | 13 | | |
| Q-478 | rG;rC;rC;rA;rG;rU;rG;rA;rA;rA;rC;rA;dC;LdC;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 35 | | |
| Q-479 | iB;rC;rC;rA;rG;rU;rG;rA;rA;rA;rC;rA;dC;rU;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 18 | | |
| Q-480 | LdC;rG;rC;rC;rA;rG;rA;rU;rU;rG;rG;rA;dC;LdC;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 33 | | |
| Q-481 | C6Np;rG;rC;rC;rA;rG;rU;rG;rA;rA;rA;rC;rA;dC;rU;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 14 | | |
| Q-482 | C6Np;rG;rC;rC;rA;rG;rU;rG;rA;rA;rA;rC;rA;dC;LdC;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 40 | | |
| Q-483 | rG;LdC;rC;rA;rG;rA;rG;rA;rA;rU;rG;rA;dC;rU;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 17 | | |
| Q-484 | rG;LdC;rC;rA;rG;rA;rG;rA;rA;rU;rG;rA;dC;LdC;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 76 | | |
| Q-485 | rG;rC;rC;rA;rG;rA;rG;rA;rA;rU;rG;rA;dC;rU;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 13 | | |
| Q-486 | rG;rC;rC;rA;rG;rA;rG;rA;rA;rU;rG;rA;dC;LdC;rC;LdC;rU$ (SEQ ID No. 139) | mA;rG;mG;rA;mG;rU;mU;rC;rA;mC;rA;mU;rC;mC;rU;mG;rG;mC$ (SEQ ID No. 140) | 42 | | |

FIG. 23 Continued

| ID | Sense | AntiSense | Activity at 20nM (% of control) | IC50 (nM) | Stability in human serum |
|---|---|---|---|---|---|
| Q-487 | iB;rG;rC;rC;rA;rG;rA;rA;rG;rU;rG;rA;rA;dC;rU;rC;LdC;rU$ (SEQ ID No. 139) | mA;rG;mG;rA;mG;rU;mU;rC;mC;rA;rA;rC;mA;rU;mU;rG;rG;mG;rC$ (SEQ ID No. 140) | 17 | | |
| Q-488 | LdC;rG;rC;rC;rA;rG;rA;rA;rG;rU;rG;rA;rA;dC;LdC;rC;LdC;rU$ (SEQ ID No. 139) | mA;rG;mG;rA;mG;rU;mU;rC;mC;rA;rC;mA;rU;mU;rG;rG;mG;rC$ (SEQ ID No. 140) | 39 | | |
| Q-489 | C6N;rG;rC;rC;rA;rG;rA;rA;rG;rU;rG;rG;rA;rA;dC;rU;rC;LdC;rC;LdC;rU$ (SEQ ID No. 139) | mA;rG;mG;rA;mG;rU;mU;rC;mC;rA;rC;mA;rU;mU;rG;rG;mG;rC$ (SEQ ID No. 140) | 11 | | |
| Q-490 | C6Np;rG;rC;rC;rA;rG;rA;rA;rG;rU;rG;rG;rA;rA;dC;rU;rC;LdC;rC;rU$ (SEQ ID No. 139) | mA;rG;mG;rA;mG;rU;mU;rC;mC;rA;rC;mA;rU;mU;rG;rG;mG;rC$ (SEQ ID No. 140) | 39 | | |
| Q-491 | rG;LdC;rC;rA;rG;rA;rA;rU;rG;rA;rA;dC;rU;rC;LdC;rU$ (SEQ ID No. 139) | mA;rG;mG;rA;mG;rU;mU;rC;mC;rA;rC;mA;rU;mU;rG;rG;mG;rC$ (SEQ ID No. 140) | 17 | | |
| Q-492 | rG;LdC;rC;rA;rG;rA;rA;rU;rG;rA;rA;dC;LdC;rC;LdC;rU$ (SEQ ID No. 139) | mA;rG;mG;rA;mG;rU;mU;rC;mC;rA;rC;mA;rU;mU;rG;rG;mG;rC$ (SEQ ID No. 140) | 94 | | |
| Q-493 | rG;rC;rC;rA;rG;rA;rA;rU;rG;rA;rA;rC;rU;rC;LdC;rU (SEQ ID No. 139) | rA;mG;rG;mA;rG;dB;mU;rC;rA;mC;rA;mC;rA;mU;rU;mC;rU;mG;rG;mC (SEQ ID No. 140) | | | |
| Q-494 | rG;rC;rC;rA;rG;rA;rA;rU;rG;rA;rA;rC;rU;rC;LdC;rU (SEQ ID No. 139) | rA;mG;rG;mA;rG;dB;mU;rC;rA;mC;rA;mU;rU;mC;rU;mG;rG (SEQ ID No. 140) | | | |
| Q-495 | rG;rC;rC;rA;rG;rA;rA;rU;rG;rA;rA;rC;rU;rC;LdC;rU (SEQ ID No. 139) | rA;mG;rG;mA;rG;mU;rU;mC;rC;rA;mC;rA;mU;rU;dB;rU;mG;rG;mC (SEQ ID No. 140) | | | |
| Q-496 | rG;rC;rC;rA;rG;rA;rA;rU;rG;rA;rA;rC;rU;rC;LdC;rU (SEQ ID No. 139) | rA;mG;rG;mA;rG;mU;rU;mC;rC;rA;mC;rA;mU;dB;mC;rU;mG;r G;mC (SEQ ID No. 140) | | | |
| Q-497 | rG;rC;rC;rA;rG;rA;rA;rU;rG;rA;rA;rC;rU;LdC;LdC;LdC (SEQ ID No. 139) | rA;mG;rG;mA;rG;mU;rU;mC;rC;rA;mC;rA;mU;rU;mC;rU;mG;rG (SEQ ID No. 140) | | | |
| Q-498 | rG;rC;rC;rA;rG;rA;rA;rU;rG;rA;rA;rC;rU;LdC;LdC;rU (SEQ ID No. 139) | rA;mG;rG;mA;rG;dB;mU;rC;rA;mC;rA;mU;rU;mC;rU;mG;rG (SEQ ID No. 140) | | | |
| Q-499 | rG;rC;rC;rA;rG;rA;rA;rU;rG;rA;rA;rC;rU;LdC;LdC (SEQ ID No. 139) | rA;mG;rG;mA;rG;mU;rU;mC;rC;rA;mC;rA;mU;rU;dB;rU;mG;rG (SEQ ID No. 140) | | | |
| Q-500 | rG;rC;rC;rA;rG;rA;rA;rU;rG;rA;rA;rC;rU;LdC;LdC (SEQ ID No. 139) | rA;mG;rG;mA;rG;mU;rU;mC;rC;rA;mC;rA;mU;dB;mC;rU;mG;r (SEQ ID No. 140) | | | |
| Q-501 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;rA;mC;rA;mU;rU;mC;rU;mG;r G;mC (SEQ ID No. 140) | | | |
| Q-502 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;rA;mC;rA;mU;rU;mC;rU;mG;r (SEQ ID No. 140) | | | |
| Q-503 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;rA;mC;rA;mU;rU;dB;rU;mG;rG (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-504 | 5medG;rC;rC;rA;rG;rA;rA;rU;rG;rU;rG;rG;rA;rA;rC;rU;rC;LdC;rU (SEQ ID No. 139) | rA;mG;rG;mA;rG;mU;rC;rU;mC;rA;mC;rA;mU;rdB;mC;rU;mG;rG;mC (SEQ ID No. 140) | | | |
| Q-505 | 5medG;rC;rC;rA;rG;rA;rA;rU;rG;rU;rG;rG;rA;rA;rC;rU;LdC; LdC;rU (SEQ ID No. 139) | rA;mG;rG;mA;dB;mU;rC;mC;rA;mC;rA;mU;rU;mC;rU;mG;r G;mC (SEQ ID No. 140) | | | |
| Q-506 | 5medG;rC;rC;rA;rG;rA;rA;rU;rG;rU;rG;rG;rA;rA;rC;rU;LdC; LdC;rU (SEQ ID No. 139) | rA;mG;rG;mA;rG;dB;rU;mC;rA;mU;rA;mU;rU;mC;rU;mG;rG ;mC (SEQ ID No. 140) | | | |
| Q-507 | 5medG;rC;rC;rA;rG;rA;rA;rU;rG;rU;rG;rG;rA;rA;rC;rU;LdC; LdC;rU (SEQ ID No. 139) | rA;mG;rG;mA;rG;mU;rC;mC;rA;mC;rA;mU;rU;dB;rU;mG;rG ;mC (SEQ ID No. 140) | | | |
| Q-508 | 5medG;rC;rC;rA;rG;rA;rA;rU;rG;rU;rG;rG;rA;rA;rC;rU;LdC; LdC;rU (SEQ ID No. 139) | rA;mG;rG;mA;rG;mU;rU;mC;rA;mC;rA;mU;dB;mC;rU;mG;r G;mC (SEQ ID No. 140) | | | |
| Q-509 | iB;rG;rC;rC;rA;rG;rA;rA;rU;rG;rU;rG;rG;rA;rA;rC;rU;rC;LdC ;rU (SEQ ID No. 139) | rA;mG;rG;mA;dB;mU;rC;mC;rA;mC;rA;mU;rU;mC;rU;mG;r G;mC (SEQ ID No. 140) | | | |
| Q-510 | iB;rG;rC;rC;rA;rG;rA;rA;rU;rG;rU;rG;rG;rA;rA;rC;rU;rC;LdC ;rU (SEQ ID No. 139) | rA;mG;rG;mA;rG;dB;rU;mC;rA;mC;rA;mU;rU;mC;rU;mG;rG ;mC (SEQ ID No. 140) | | | |
| Q-511 | iB;rG;rC;rC;rA;rG;rA;rA;rU;rG;rU;rG;rG;rA;rA;rC;rU;rC;LdC ;rU (SEQ ID No. 139) | rA;mG;rG;mA;rG;mU;rC;mC;rA;mC;rA;mU;rU;dB;rU;mG;rG ;mC (SEQ ID No. 140) | | | |
| Q-512 | iB;rG;rC;rC;rA;rG;rA;rA;rU;rG;rU;rG;rG;rA;rA;rC;rU;rC;LdC ;rU (SEQ ID No. 139) | rA;mG;rG;mA;rG;mU;rU;mC;rA;mC;rA;mU;dB;mC;rU;mG;r G;mC (SEQ ID No. 140) | | | |
| Q-513 | iB;rG;rC;rC;rA;rG;rA;rA;rU;rG;rU;rG;rG;rA;rA;rC;rU;LdC;Ld C;rU (SEQ ID No. 139) | rA;mG;rG;mA;dB;mU;rC;mC;rA;mC;rA;mU;rU;mC;rU;mG;r G;mC (SEQ ID No. 140) | | | |
| Q-514 | iB;rG;rC;rC;rA;rG;rA;rA;rU;rG;rU;rG;rG;rA;rA;rC;rU;LdC;Ld C;rU (SEQ ID No. 139) | rA;mG;rG;mA;rG;dB;rU;mC;rA;mC;rA;mU;rU;mC;rU;mG;rG ;mC (SEQ ID No. 140) | | | |
| Q-515 | iB;rG;rC;rC;rA;rG;rA;rA;rU;rG;rU;rG;rG;rA;rA;rC;rU;LdC;Ld C;rU (SEQ ID No. 139) | rA;mG;rG;mA;rG;mU;rC;mC;rA;mC;rA;mU;rU;dB;rU;mG;rG ;mC (SEQ ID No. 140) | | | |
| Q-516 | iB;rG;rC;rC;rA;rG;rA;rA;rU;rG;rU;rG;rG;rA;rA;rC;rU;LdC;Ld C;rU (SEQ ID No. 139) | rA;mG;rG;mA;rG;mU;rU;mC;rA;mC;rA;mU;dB;mC;rU;mG;r G;mC (SEQ ID No. 140) | | | |
| Q-517 | iB;rC;rC;rA;rG;rA;rA;rU;rG;rU;rG;rG;rA;rA;rC;dB;dB;dB;dB (SEQ ID No. 139) | mA;mG;mG;rA;mG;rU;mU;rC;mC;rA;mU;rU;mC;rU;mG ;rG;mC (SEQ ID No. 140) | | | |
| Q-518 | iB;rC;rC;rA;rG;rA;rA;rU;rG;rU;rG;rG;rA;rA;rC;dB;dB;dB;dB (SEQ ID No. 139) | rA;mG;rG;mA;rG;mU;rU;rC;mC;rA;mC;rA;mU;rU;mC;rU;mG ;rG;mC (SEQ ID No. 140) | | | |
| Q-519 | 5medG;rC;rC;rA;rG;rA;rA;rU;rG;rU;rG;rG;rA;rA;rC;dB;dB; dB;dB (SEQ ID No. 139) | mA;mG;mA;mG;rU;mU;rC;mC;rA;mC;rA;mU;rU;rU;mC;rU;mG ;rG;mC (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-520 | 5medG;rC;rC;rA;rG;rA;rA;rU;rG;rU;rG;rG;rA;rA;dB;dB;dB;dB;dB (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-521 | iB;dB;rC;rA;rG;rA;rA;rU;rG;rG;rA;rA;rC;rA;rC;rU;dB;dB;dB (SEQ ID No. 139) | mA;mG;mG;rA;mG;rU;mU;rC;mC;rA;mC;rA;mU;mC;rU;mC;rU;mG (SEQ ID No. 140) | | | |
| Q-522 | iB;dB;rC;rA;rG;rA;rA;rU;rG;rG;rA;rA;rC;rA;rC;rU;dB;dB;dB (SEQ ID No. 139) | rA;mG;rG;mA;rG;mU;rU;mC;mC;rA;mC;rA;mU;rU;mC;rU;mG;rG;mC (SEQ ID No. 140) | | | |
| Q-523 | iB;dB;dB;rA;rG;rA;rA;rU;rG;rG;rA;rA;rC;rU;dB;dB (SEQ ID No. 139) | mA;mG;mG;rA;mG;rU;mU;rC;mC;rA;mC;rA;mU;mC;rU;mC;rU;mG;rG;mC (SEQ ID No. 140) | | | |
| Q-524 | iB;dB;dB;rA;rA;rU;rG;rG;rA;rA;rC;rU;dB;dB;dB (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-525 | iB;dB;dB;rG;rA;rA;rU;rG;rG;rA;rA;rC;rA;rC;rU;rC;rC;dB (SEQ ID No. 139) | mA;mG;mG;rA;mG;rU;mU;rC;mC;rA;mC;rA;mU;mC;rU;mC;rU;mG;rG;mC (SEQ ID No. 140) | | | |
| Q-526 | iB;dB;dB;dB;rG;rA;rA;rA;rU;rC;rU;rC;dB (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-527 | iB;dB;dB;dB;rA;rA;rA;rU;rG;rU;rG;rA;rA;rC;rU;rC;rC;rU (SEQ ID No. 139) | mA;mG;mG;rA;mG;rU;mU;rC;mC;rA;mC;rA;mU;mC;rU;mC;rU;mG (SEQ ID No. 140) | | | |
| Q-528 | iB;dB;dB;dB;rA;rA;rA;rU;rG;rU;rG;rA;rA;rC;rU;rC;rC;rU (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-529 | 5medG;rC;rC;rA;rG;lnaA;rA;rU;rG;rU;rG;rA;lnaA;dB;dB;dB;dB;dB (SEQ ID No. 139) | mA;mG;mG;rA;mG;rU;mU;rC;mC;rA;mC;rA;mU;mC;rU;mC;rU;mG (SEQ ID No. 140) | | | |
| Q-530 | 5medG;rC;rC;rA;rG;lnaA;rA;rU;rG;rU;rG;rA;lnaA;dB;dB;dB;dB;dB (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-531 | iB;dB;dB;dB;dB;lnaA;rA;rU;rG;rU;rG;rA;lnaA;rC;rU;rC;rU (SEQ ID No. 139) | mA;mG;mG;rA;mG;rU;mU;rC;mC;rA;mC;rA;mU;mC;rU;mC;rU;mG (SEQ ID No. 140) | | | |
| Q-532 | iB;dB;dB;dB;dB;lnaA;rA;rU;rG;rU;rG;rA;lnaA;rC;rU;rC;rU (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-533 | iB;rG;rC;rC;rA;rG;rA;rA;rU;rG;rU;rG;rA;rA;rC;rU;rU;rC;LdC;rU (SEQ ID No. 139) | rA;mG;rG;mA;rA;rA;rU;mC;rC;rA;mC;rA;mU;rU;mC;rU;mG;rG;mC (SEQ ID No. 140) | | | |
| Q-534 | iB;rG;rC;rC;rA;rG;rA;rA;rU;rG;rU;rG;rA;rA;rU;rU;LdC;LdC;rU (SEQ ID No. 139) | rA;mG;rG;mA;rA;rA;mC;rU;mC;rC;rA;mC;rA;mU;rU;mC;rU;mG;rG;mC (SEQ ID No. 140) | | | |
| Q-535 | iB;rG;rC;rC;rA;rG;rA;rA;rU;rG;rG;rA;rG;rA;rG;rU;rC;LdC;rU (SEQ ID No. 139) | rA;mG;rG;mA;rG;mC;rU;mC;rU;mC;rC;rA;mC;rA;mU;rU;mC;rU;mG;rG;mC (SEQ ID No. 140) | | | |

FIG. 23 Continued

| ID | Sense | AntiSense | Activity at 20nM (% of control) | IC50 (aM) | Stability in human serum |
|---|---|---|---|---|---|
| Q-536 | iB;rG;rC;rC;;rA;rG;rA;;rA;rU;rG;rA;;rU;rG;rA;;rG;rC;rU;LdC;L dC;rU (SEQ ID No. 139) | rA;mG;rG;mA;rG;mC;rU;mC;rC;rA;mC;rA;mU;rU;mC;rU;mG;r G;mC (SEQ ID No. 140) | | | |
| Q-537 | iB;rG;rC;rC;;rA;rG;rG;rA;rU;rG;rA;;rA;rC;rA;rC;rU;LdC;rU (SEQ ID No. 139) | rA;mG;rG;mA;rG;mU;rU;mC;rC;;rA;mC;rA;mU;rC;mC;rU;mG;r G;mC (SEQ ID No. 140) | | | |
| Q-538 | iB;rG;rC;rC;;rA;rG;rA;;rU;rG;rA;;rA;rA;rC;rA;rC;rU;LdC;L dC;rU (SEQ ID No. 139) | rA;mG;rG;mA;rG;mU;rU;mC;rC;rA;mC;rA;mU;rC;mC;rU;mG;r G;mC (SEQ ID No. 140) | | | |
| Q-539 | rG;rC;rC;;rA;rG;rA;;rU;rG;rA;;rA;rA;rC;rU;rC;rU;LdC;rU (SEQ ID No. 139) | mA;mG;mG;rA;dB;rU;mU;rC;rA;mC;rA;mU;rC;mC;rU;mG;r G;mC (SEQ ID No. 140) | | | |
| Q-540 | rG;rC;rC;rA;rG;rA;rU;rG;rA;;rA;rA;rC;rU;rC;rU;LdC;r U (SEQ ID No. 139) | mA;mG;mG;rA;mG;dB;mU;rC;mC;rA;mC;rA;mU;rC;mC;rU;mG ;rG;mC (SEQ ID No. 140) | | | |
| Q-541 | rG;rC;rC;;rA;rG;rA;rU;rG;rA;rA;rA;rC;rU;rC;rU;LdC;r U (SEQ ID No. 139) | mA;mG;mG;rA;mG;rU;mU;rC;mC;rA;mC;rA;mU;rU;dB;rU;mG; rG;mC (SEQ ID No. 140) | | | |
| Q-542 | rG;rC;rC;;rA;rG;rA;rU;rG;rA;rA;rA;rC;rU;rC;rU;LdC;r U (SEQ ID No. 139) | mA;mG;mG;rA;mG;rU;mU;rC;mC;rA;mC;rA;mU;dB;mC;rU;mG ;rG;mC (SEQ ID No. 140) | | | |
| Q-543 | rG;rC;rC;;rA;rG;rA;rU;rG;rA;rA;rA;rC;rU;rC;rU;LdC;r U (SEQ ID No. 139) | rA;mG;mG;mA;dB;mU;mU;rC;mC;rA;mC;rA;mU;rC;mC;rU;mG;r G;mC (SEQ ID No. 140) | | | |
| Q-544 | rG;rC;rC;;rA;rG;rA;rU;rG;rA;;rA;rA;rC;rU;rC;rU;LdC;r U (SEQ ID No. 139) | mA;mG;rG;mA;mG;dB;mU;mU;rC;mC;rA;mC;rA;mU;rC;rU;mG;r G;mC (SEQ ID No. 140) | | | |
| Q-545 | rG;rC;rC;;rA;rG;rA;rU;rG;rA;rA;rA;rC;rU;rC;rU;LdC;r U (SEQ ID No. 139) | rA;mG;rG;mA;rG;mU;rU;mC;rC;rA;mC;rA;mU;mC;mU;dB;mU; rG;mC (SEQ ID No. 140) | | | |
| Q-546 | rG;rC;rC;;rA;rG;rA;rU;rG;rA;rA;rA;rC;rU;rC;rU;LdC;r U (SEQ ID No. 139) | mA;mG;mG;mG;rA;rG;mU;rU;mC;rC;rA;mC;rA;mU;mU;dB;mU; mG;rG;mC (SEQ ID No. 140) | | | |
| Q-547 | rG;rC;rC;;rA;rG;rA;rU;rG;rA;rA;rA;rC;rU;LdC;LdC; rU (SEQ ID No. 139) | mA;mG;mG;rA;dB;rU;mU;rC;mC;rA;mC;rA;mU;rU;dB;rU;mG; G;mC (SEQ ID No. 140) | | | |
| Q-548 | rG;rC;rC;;rA;rG;rA;rU;rG;rA;rA;rA;rC;rU;LdC;LdC; rU (SEQ ID No. 139) | mA;mG;mG;rA;mG;dB;mU;rC;mC;rA;mC;rA;mU;rC;mC;rU;mG; rG;mC (SEQ ID No. 140) | | | |
| Q-549 | rG;rC;rC;;rA;rG;rA;rU;rG;rA;rA;rA;rC;rU;LdC;LdC; rU (SEQ ID No. 139) | mA;mG;mG;rA;mG;rU;mU;rC;mC;rA;mC;rA;mU;rU;dB;rU;mG; rG;mC (SEQ ID No. 140) | | | |
| Q-550 | rG;rC;rC;;rA;rG;rA;rU;rG;rA;rA;rA;rC;rU;LdC;LdC; rU (SEQ ID No. 139) | mA;mG;mG;rA;mG;rU;mU;rC;mC;rA;mC;rA;mU;dB;mC;rU;mG; rG;mC (SEQ ID No. 140) | | | |
| Q-551 | rG;rC;rC;;rA;rU;rG;rA;rA;rC;rA;rC;rU;LdC;LdC; rU (SEQ ID No. 139) | rA;mG;rG;mA;dB;mU;mU;rC;mC;rA;mC;rA;mU;rC;mC;rU;mG;r G;mC (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-552 | rG;rC;rC;rA;rG;rA;rA;rG;rA;rA;rU;rG;rG;rA;rA;rC;rU;LdC;LdC;rU (SEQ ID No. 139) | mA;mG;rG;mA;dB;rU;mU;rC;mC;rA;mC;rA;mU;rU;mC;rU;mG;rG;mC (SEQ ID No. 140) | | | |
| Q-553 | rG;rC;rC;rA;rG;rA;rA;rG;rA;rA;rU;rG;rG;rA;rA;rC;rU;LdC;LdC;rU (SEQ ID No. 139) | rA;mG;rG;mA;rG;mU;rU;mC;rC;rA;mC;rA;mU;rU;mC;rU;mG;rG;mC (SEQ ID No. 140) | | | |
| Q-554 | rG;rC;rC;rA;rG;rA;rA;rG;rA;rA;rU;rG;rG;rA;rA;rC;rU;LdC;LdC;rU (SEQ ID No. 139) | mA;mG;mG;rA;mG;rU;mC;mC;rA;mC;rA;mU;mU;dB;mU;mG;rG;mC (SEQ ID No. 140) | | | |
| Q-555 | 5medG;rC;rC;rA;rG;rA;rA;rG;rA;rA;rU;rG;rG;rA;rA;rC;rU;rC;L dC;rU (SEQ ID No. 139) | mA;mG;mG;rA;dB;rU;mU;rC;mC;rA;mC;rA;mU;rU;mC;rU;mG;rG;mC (SEQ ID No. 140) | | | |
| Q-556 | 5medG;rC;rC;rA;rG;rA;rA;rG;rA;rA;rU;rG;rG;rA;rA;rC;rU;rC;L dC;rU (SEQ ID No. 139) | mA;mG;mG;rA;mG;dB;mU;rC;mC;rA;mC;rA;mU;rU;mC;rU;mG;rG;mC (SEQ ID No. 140) | | | |
| Q-557 | 5medG;rC;rC;rA;rG;rA;rA;rG;rA;rA;rU;rG;rG;rA;rA;rC;rU;rC;L dC;rU (SEQ ID No. 139) | mA;mG;mG;rA;mG;rU;mU;rC;mC;rA;mC;rA;mU;rU;dB;rU;mG;rG;mC (SEQ ID No. 140) | | | |
| Q-558 | 5medG;rC;rC;rA;rG;rA;rA;rG;rA;rA;rU;rG;rG;rA;rA;rC;rU;rC;L dC;rU (SEQ ID No. 139) | mA;mG;mG;rA;mG;rU;rC;mC;rA;mC;rA;mU;dB;mC;rU;mG;rG;mC (SEQ ID No. 140) | | | |
| Q-559 | 5medG;rC;rC;rA;rG;rA;rA;rG;rA;rA;rU;rG;rG;rA;rA;rC;rU;rC;L dC;rU (SEQ ID No. 139) | rA;mG;mG;mA;dB;mU;mU;rC;mC;rA;mC;rA;mU;rU;mC;rU;mG;rG;mC (SEQ ID No. 140) | | | |
| Q-560 | 5medG;rC;rC;rA;rG;rA;rA;rG;rA;rA;rU;rG;rG;rA;rA;rC;rU;rC;L dC;rU (SEQ ID No. 139) | mA;mG;mG;mA;dB;mU;mU;rC;mC;rA;mC;rA;mU;rU;mC;rU;mG;rG;mC (SEQ ID No. 140) | | | |
| Q-561 | 5medG;rC;rC;rA;rG;rA;rA;rG;rA;rA;rU;rG;rG;rA;rA;rC;rU;rC;L dC;rU (SEQ ID No. 139) | rA;mG;mG;mA;mG;rU;mU;mC;mC;rA;mC;rA;mU;mU;dB;mU;mG;rG;mC (SEQ ID No. 140) | | | |
| Q-562 | 5medG;rC;rC;rA;rG;rA;rA;rG;rA;rA;rU;rG;rG;rA;rA;rC;rU;rC;L dC;rU (SEQ ID No. 139) | mA;mG;mG;rA;mG;rU;mU;rC;mC;rA;mU;mU;dB;mU;m G;rG;mC (SEQ ID No. 140) | | | |
| Q-563 | 5medG;rC;rC;rC;rA;rG;rA;rA;rG;rA;rA;rU;rG;rG;rA;rA;rC;rU;LdC; LdC;rU (SEQ ID No. 139) | mA;mG;mG;rA;mG;rA;dB;rU;mU;rC;mC;rA;mC;rA;mU;rU;mC;rU;mG;r G;mC (SEQ ID No. 140) | | | |
| Q-564 | 5medG;rC;rC;rC;rA;rG;rA;rA;rG;rA;rA;rU;rG;rG;rA;rA;rC;rU;LdC; LdC;rU (SEQ ID No. 139) | mA;mG;mG;rA;mG;rA;mG;dB;mU;rC;mC;rA;mC;rA;mU;rU;mC;rU;mG; rG;mC (SEQ ID No. 140) | | | |
| Q-565 | 5medG;rC;rC;rC;rA;rG;rA;rA;rG;rA;rA;rU;rG;rG;rA;rA;rC;rU;LdC; LdC;rU (SEQ ID No. 139) | mA;mG;mG;rA;mG;rA;mG;rU;mU;rC;mC;rA;mC;rA;mU;rU;rU;mC;rU;mG; rG;mC (SEQ ID No. 140) | | | |
| Q-566 | 5medG;rC;rC;rC;rA;rG;rA;rA;rG;rA;rA;rU;rG;rG;rA;rA;rC;rU;LdC; LdC;rU (SEQ ID No. 139) | mA;mG;mG;rA;mG;rA;mG;rU;mC;mC;rA;mC;rA;mU;rU;dB;mC;rU;mG; rG;mC (SEQ ID No. 140) | | | |
| Q-567 | 5medG;rC;rC;rC;rA;rG;rA;rA;rG;rA;rA;rU;rG;rG;rA;rA;rC;rU;LdC; LdC;rU (SEQ ID No. 139) | rA;mG;rG;mA;mG;mA;dB;mU;mU;rC;mC;rA;mC;rA;mU;mC;rU;mG;r G;mC (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-568 | 5medG;rC;rC;rA;G;rA;rA;rU;rG;rG;rU;rG;rA;rA;rC;rU;LdC;LdC;rU (SEQ ID No. 139) | mA;mG;rG;mA;dB;mU;mU;rC;mC;rA;mC;rA;mU;rU;mC;rU;mG;rG;mC (SEQ ID No. 140) | | | |
| Q-569 | 5medG;rC;rC;rA;G;rA;rA;rU;rG;rG;rU;rG;rA;rA;rC;rU;LdC;LdC;rU (SEQ ID No. 139) | rA;mG;rG;mA;rG;mU;mU;rC;rC;rA;mC;rA;mU;mU;dB;mU;mG;rG;mC (SEQ ID No. 140) | | | |
| Q-570 | 5medG;rC;rC;rA;G;rA;rA;rU;rG;rG;rU;rG;rA;rA;rC;rU;LdC;LdC;rU (SEQ ID No. 139) | mA;mG;mG;rA;mG;rU;rU;rC;mC;rA;mC;rA;mU;mU;dB;mU;mG;rG;mC (SEQ ID No. 140) | | | |
| Q-571 | iB;rG;rC;rC;rA;rG;rA;rA;rU;rG;rG;rU;rG;rA;rA;rC;rU;rC;LdC;rU (SEQ ID No. 139) | mA;mG;mG;rA;dB;rU;mU;rC;mC;rA;mC;rA;mU;rU;mC;rU;mG;rG;mC (SEQ ID No. 140) | | | |
| Q-572 | iB;rG;rC;rC;rA;rG;rA;rA;rU;rG;rG;rU;rG;rA;rA;rC;rU;rC;LdC;rU (SEQ ID No. 139) | mA;mG;mG;rA;mG;dB;mU;rC;mU;rC;mC;rA;mC;rA;mU;rU;mC;rU;mG;rG;mC (SEQ ID No. 140) | | | |
| Q-573 | iB;rG;rC;rC;rA;rG;rA;rA;rU;rG;rG;rU;rG;rA;rA;rC;rU;rC;LdC;rU (SEQ ID No. 139) | mA;mG;mG;rA;mG;rU;mU;rC;mC;rA;mC;rA;mU;rU;dB;rU;mG;rG;mC (SEQ ID No. 140) | | | |
| Q-574 | iB;rG;rC;rC;rA;rG;rA;rA;rU;rG;rG;rU;rG;rA;rA;rC;rU;rC;LdC;rU (SEQ ID No. 139) | mA;mG;mG;rA;mG;rU;mU;rC;mC;rA;mC;rA;mU;mU;dB;mC;mU;rG;mC (SEQ ID No. 140) | | | |
| Q-575 | iB;rG;rC;rC;rA;rG;rA;rA;rU;rG;rG;rU;rG;rA;rA;rC;rU;rC;LdC;rU (SEQ ID No. 139) | rA;mG;rG;mA;dB;mU;mU;rC;mC;rA;mC;rA;mU;rU;mC;rU;mG;rG;mC (SEQ ID No. 140) | | | |
| Q-576 | iB;rG;rC;rC;rA;rG;rA;rA;rU;rG;rG;rU;rG;rA;rA;rC;rU;rC;LdC;rU (SEQ ID No. 139) | mA;mG;mG;rA;mA;dB;mU;mU;rC;mC;rA;mC;rA;mU;mU;dB;mU;mG;mC (SEQ ID No. 140) | | | |
| Q-577 | iB;rG;rC;rC;rA;rG;rA;rA;rU;rG;rG;rU;rG;rA;rA;rC;rU;rC;LdC;rU (SEQ ID No. 139) | rA;mG;rG;mA;rG;mU;mU;rC;mC;rA;mC;rA;mU;mU;dB;mU;mG;rG;mC (SEQ ID No. 140) | | | |
| Q-578 | iB;rG;rC;rC;rA;rG;rA;rA;rU;rG;rG;rU;rG;rA;rA;rC;rU;rC;LdC;rU (SEQ ID No. 139) | mA;mG;mG;rA;mG;rA;mG;rU;mU;rC;mC;rA;mC;rA;mU;mU;dB;mU;mG;mC (SEQ ID No. 140) | | | |
| Q-579 | iB;rG;rC;rC;rA;rG;rA;rA;rU;rG;rG;rU;rG;rA;rA;rC;rU;rC;LdC;Ld C;rU (SEQ ID No. 139) | mA;mG;mG;rA;dB;rU;mU;rC;mC;rA;mC;rA;mU;rU;mC;rU;mG;rG;mC (SEQ ID No. 140) | | | |
| Q-580 | iB;rG;rC;rC;rA;rG;rA;rA;rU;rG;rG;rU;rG;rA;rA;rC;rU;rC;LdC;Ld C;rU (SEQ ID No. 139) | mA;mG;mG;rA;mG;dB;mU;rC;mC;rA;mC;rA;mU;rU;mC;rU;mG;rG;mC (SEQ ID No. 140) | | | |
| Q-581 | iB;rG;rC;rC;rA;rG;rA;rA;rU;rG;rG;rU;rG;rA;rA;rC;rU;rC;LdC;Ld C;rU (SEQ ID No. 139) | mA;mG;mG;rA;mG;rU;mU;rC;mC;rA;mC;rA;mU;rU;dB;rU;mG;rG;mC (SEQ ID No. 140) | | | |
| Q-582 | iB;rG;rC;rC;rA;rG;rA;rA;rU;rG;rG;rU;rG;rA;rA;rC;rU;rC;LdC;Ld C;rU (SEQ ID No. 139) | mA;mG;mG;rA;mG;rU;mU;rC;mC;rA;mC;rA;mU;mU;dB;mC;mU;rG;mC (SEQ ID No. 140) | | | |
| Q-583 | iB;rG;rC;rC;rA;rG;rA;rA;rU;rG;rG;rU;rG;rA;rA;rC;rU;rC;LdC;Ld C;rU (SEQ ID No. 139) | rA;mG;mG;mA;dB;mU;mU;rC;mC;rA;mC;rA;mU;rU;mC;rU;mG;rG;mC (SEQ ID No. 140) | | | |

FIG. 23 Continued

| ID | Sense | AntiSense | Activity at 20 nM (% of control) | IC50 (nM) | Stability in human serum |
|---|---|---|---|---|---|
| Q-584 | iB;rG;rC;rC;rA;rG;rA;rA;rU;rG;rG;rA;rA;rC;rU;LdC;Ld C;rU (SEQ ID No. 139) | mA;mG;rG;mA;dB;mU;rU;rC;mC;rA;mC;rA;mU;rU;mC;rU;mG ;rG;mC (SEQ ID No. 140) | | | |
| Q-585 | iB;rG;rC;rC;rA;rG;rA;rA;rU;rG;rG;rA;rA;rC;rU;LdC;Ld C;rU (SEQ ID No. 139) | rA;mG;rG;mA;rG;mU;rU;mC;rC;rA;mC;rA;mU;mU;dB;mU;mG; rG;mC (SEQ ID No. 140) | | | |
| Q-586 | iB;rG;rC;rC;rA;rG;rA;rA;rU;rG;rG;rA;rA;rC;rU;LdC;Ld C;rU (SEQ ID No. 139) | mA;mG;mG;rA;mG;rU;mU;rC;mC;rA;mC;rA;mC;rA;mU;mU;dB;mU;m G;rG;mC (SEQ ID No. 140) | | | |
| Q-587 | rG;rC;rC;rA;rG;rA;rA;rU;rG;rG;rA;rA;rC;rU;rC;LdC;r U (SEQ ID No. 139) | rA;mG;rG;mA;rG;mU;dB;mC;rC;rA;mC;rA;mU;rU;mC;rU;mG;r G;mC (SEQ ID No. 140) | | | |
| Q-588 | rG;rC;rC;rA;rG;rA;rA;rU;rG;rG;rA;rA;rC;rU;rC;LdC;r U (SEQ ID No. 139) | rA;mG;rG;mA;rG;mU;rU;dB;rC;rA;mC;rA;mC;rA;mU;rU;mC;rU;mG;rG ;mC (SEQ ID No. 140) | | | |
| Q-589 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;dB;rA;mC;rA;mU;rU;mC;rU;mG;r G;mC (SEQ ID No. 140) | | | |
| Q-590 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;dB;mC;rA;mU;rU;mC;rU;mG;r G;mC (SEQ ID No. 140) | | | |
| Q-591 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;rA;dB;rA;mU;rU;mC;rU;mG;r G;mC (SEQ ID No. 140) | | | |
| Q-592 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;rA;mC;dB;mU;rU;mC;rU;mG;r G;mC (SEQ ID No. 140) | | | |
| Q-593 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;rA;mC;rA;dB;rU;mC;rU;mG;r G;mC (SEQ ID No. 140) | | | |
| Q-594 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;dB;mC;rC;rA;mC;rA;mU;rU;mC;rU;mG;r G;mC (SEQ ID No. 140) | | | |
| Q-595 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;rA;mC;rA;mU;rU;mC;rU;mG;r G;mC (SEQ ID No. 140) | | | |
| Q-596 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;dB;rA;mC;rA;mU;rU;mC;rU;mG;r G;mC (SEQ ID No. 140) | | | |
| Q-597 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;dB;mC;rA;mU;rU;mC;rU;mG;r G;mC (SEQ ID No. 140) | | | |
| Q-598 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;rA;dB;rA;mU;rU;mC;rU;mG;r G;mC (SEQ ID No. 140) | | | |
| Q-599 | rG;rC;rC;rA;rG;rA;rA;rU;rG;rG;rA;rA;rC;rU;rC;LdC;r U (SEQ ID No. 139) | rA;mG;rG;mA;rG;mU;rU;mC;rC;rA;mC;dB;mU;rU;mC;rU;mG;r G;mC (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-600 | rG;rC;rC;rA;rG;rA;rA;rU;rG;rA;rA;rC;rU;LdC;LdC;rU (SEQ ID No. 139) | rA;mG;rG;mA;rG;mU;rU;mC;rC;rA;mC;rA;dB;rU;mC;rU;mG;rG;mC (SEQ ID No. 140) | | | |
| Q-601 | 5medG;rC;rC;rA;rG;rA;rA;rU;rG;rA;rA;rC;rU;rC;L dC;rU (SEQ ID No. 139) | rA;mG;rG;mA;rG;mU;mU;dB;mC;rC;rA;mC;rA;mU;rU;mC;rU;mG;r G;mC (SEQ ID No. 140) | | | |
| Q-602 | 5medG;rC;rC;rA;rG;rA;rA;rU;rG;rA;rA;rC;rU;rC;L dC;rU (SEQ ID No. 139) | rA;mG;rG;mA;rG;mU;rU;dB;rC;rA;mC;rA;mU;rU;mC;rU;mG;rG;mC (SEQ ID No. 140) | | | |
| Q-603 | 5medG;rC;rC;rA;rG;rA;rA;rU;rG;rA;rA;rC;rU;rC;L dC;rU (SEQ ID No. 139) | rA;mG;rG;mA;rG;mU;rU;mC;dB;rA;mC;rA;mU;rU;mC;rU;mG;r G;mC (SEQ ID No. 140) | | | |
| Q-604 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;dB;mC;rA;mU;rU;mC;rU;mG;r G;mC (SEQ ID No. 140) | | | |
| Q-605 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;rA;dB;rA;mU;rU;mC;rU;mG;rG;mC (SEQ ID No. 140) | | | |
| Q-606 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;rA;mC;dB;mU;rU;mC;rU;mG;r G;mC (SEQ ID No. 140) | | | |
| Q-607 | 5medG;rC;rC;rA;rG;rA;rA;rU;rG;rA;rA;rC;rU;rC;L dC;rU (SEQ ID No. 139) | rA;mG;rG;mA;rG;mU;rU;mC;rC;rA;mC;rA;dB;rU;mC;rU;mG;rG;mC (SEQ ID No. 140) | | | |
| Q-608 | 5medG;rC;rC;rA;rG;rA;rA;rU;rG;rA;rA;rC;rU;LdC; LdC;rU (SEQ ID No. 139) | rA;mG;rG;mA;rG;mU;rU;mC;dB;mC;rA;mC;rA;mU;rU;mC;rU;mG;r G;mC (SEQ ID No. 140) | | | |
| Q-609 | 5medG;rC;rC;rA;rG;rA;rA;rU;rG;rA;rA;rC;rU;rC;U LdC; (SEQ ID No. 139) | rA;mG;rG;mA;rG;mU;rU;dB;rC;rA;mC;dB;rA;mC;rA;mU;rU;mC;rU;mG;rG;mC (SEQ ID No. 140) | | | |
| Q-610 | 5medG;rC;rC;rA;rG;rA;rA;rU;rG;rA;rA;rC;rU;rC;U LdC; (SEQ ID No. 139) | rA;mG;rG;mA;rG;mU;rU;mC;dB;rA;mC;dB;rA;mC;rA;mU;rU;mC;rU;mG;r G;mC (SEQ ID No. 140) | | | |
| Q-611 | 5medG;rC;rC;rA;rG;rA;rA;rU;rG;rA;rA;rC;rU;rC;U LdC; (SEQ ID No. 139) | rA;mG;rG;mA;rG;mU;rU;mC;rC;mC;rC;dB;mC;rA;mU;rU;mC;rU;mG;r G;mC (SEQ ID No. 140) | | | |
| Q-612 | 5medG;rC;rC;rA;rG;rA;rA;rU;rG;rU;rG;rA;rC;rU;LdC; LdC;rU (SEQ ID No. 139) | rA;mG;rG;mA;rG;mU;rU;mC;rC;rA;mC;rC;dB;rA;dB;rA;mU;rU;mC;rU;mG;rG;mC (SEQ ID No. 140) | | | |
| Q-613 | 5medG;rC;rC;rA;rG;rA;rA;rU;rG;rA;rA;rC;rU;rC;U LdC; (SEQ ID No. 139) | rA;mG;rG;mA;rG;mU;rU;mC;rC;rA;mC;rA;mC;dB;mU;rU;mC;rU;mG;r G;mC (SEQ ID No. 140) | | | |
| Q-614 | 5medG;rC;rC;rA;rG;rA;rA;rU;rG;rA;rA;rC;rU;rC;U LdC; (SEQ ID No. 139) | rA;mG;rG;mA;rG;mU;rU;mC;dB;mC;rA;mC;rC;rA;dB;rU;mC;rU;mG;r G;mC (SEQ ID No. 140) | | | |
| Q-615 | iB;rG;rC;rC;rA;rG;rA;rA;rU;rG;rA;rA;rC;rU;rC;LdC;rU (SEQ ID No. 139) | rA;mG;rG;mA;rG;mU;mU;dB;mC;rC;rA;mC;rA;mU;rU;mC;rU;mG;r G;mC (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-616 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;dB;rC;rA;mC;rA;mU;rU;mC;rU;mG;rG;mC (SEQ ID No. 140) | | | |
| Q-617 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;dB;rA;mC;rA;mU;rU;mC;rU;mG;rG;mC (SEQ ID No. 140) | | | |
| Q-618 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;dB;rA;mU;rU;mC;rU;mG;rG;mC (SEQ ID No. 140) | | | |
| Q-619 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;dB;rA;mU;rU;mC;rU;mG;rG;mC (SEQ ID No. 140) | | | |
| Q-620 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;mC;dB;mU;rU;mC;rU;mG;rG;mC (SEQ ID No. 140) | | | |
| Q-621 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;mC;rA;dB;rU;mC;rU;mG;rG;mC (SEQ ID No. 140) | | | |
| Q-622 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;mC;rA;mU;dB;mC;rU;mG;rG;mC (SEQ ID No. 140) | | | |
| Q-623 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;dB;rC;rA;mC;rA;mU;rU;mC;rU;mG;rG;mC (SEQ ID No. 140) | | | |
| Q-624 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;dB;mC;rA;mU;rU;mC;rU;mG;rG;mC (SEQ ID No. 140) | | | |
| Q-625 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;mC;rC;dB;mC;rU;mG;rG;mC (SEQ ID No. 140) | | | |
| Q-626 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;dB;rA;mC;rA;dB;rU;mG;rG;mC (SEQ ID No. 140) | | | |
| Q-627 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;mC;rC;rA;dB;rU;mG;rG;mC (SEQ ID No. 140) | | | |
| Q-628 | iB;rG;rC;rC;rA;rG;rA;rA;rU;rG;rG;rA;rA;rC;rU;rC;rU;LdC;rU (SEQ ID No. 139) | rA;mG;rG;mA;rG;mU;rU;mC;rC;rA;mC;rA;dB;rU;mC;rU;mG;rG;mC (SEQ ID No. 140) | | | |
| Q-629 | rG;rC;rC;rA;rG;rA;rA;rU;rG;rG;rA;rA;rC;rU;rC;rU;rU (SEQ ID No. 139) | rA;rG;rG;mA;rG;rU;rU;rC;rC;rA;rC;rA;rU;rU;rC;rU;rG;rG;rC (SEQ ID No. 140) | | | |
| Q-630 | rG;rC;rC;rA;rG;rA;rA;rU;rG;rG;rA;rA;rC;rU;rC;rU;rU (SEQ ID No. 139) | rA;mG;rG;mA;rG;mU;rU;dB;rC;rA;mC;rA;mU;rU;mC;rU;mG;rG;mC (SEQ ID No. 140) | | | |
| Q-631 | rG;rC;rC;rA;rG;rA;rA;rU;rG;rG;rA;rA;rC;rU;rC;rU;rU (SEQ ID No. 139) | rA;mG;rG;mA;rG;mU;rU;mC;rC;rA;mC;rA;mU;rU;mC;rU;mG;rG;mC (SEQ ID No. 140) | | | |

FIG. 23 Continued

| ID | Sense | AntiSense | Activity at 20nM (% of control) | IC50 (nM) | Stability in human serum |
|---|---|---|---|---|---|
| Q-632 | rG;rC;rC;rA;rG;rA;rA;rU;rG;rG;rA;rA;rC;rU;rC;rC;rU (SEQ ID No. 139) | rA;mG;rG;mA;rG;mU;rU;mC;rC;rA;mC;rA;mU;rU;dB;rU;mG;rG;mC (SEQ ID No. 140) | | | |
| Q-633 | rG;rC;rC;rA;rG;rA;rA;rU;rG;rG;rA;rA;rC;rU;rC;rC;rU (SEQ ID No. 139) | rA;mG;rG;mA;rG;mU;rU;mC;rC;rA;mC;rA;mU;dB;mC;rU;mG;rG;mC (SEQ ID No. 140) | | | |
| Q-634 | rG;rC;rC;rA;rG;rA;rA;rU;rG;rG;rA;rA;rC;rU;rC;rC;rU (SEQ ID No. 139) | rA;mG;rG;mA;rG;mU;rU;mC;dB;mC;rC;rA;mC;rA;mU;rU;mG;rG;mC (SEQ ID No. 140) | | | |
| Q-635 | rG;rC;rC;rA;rG;rA;rA;rU;rG;rG;rA;rA;rC;rU;rC;rC;rU (SEQ ID No. 139) | rA;mG;rG;mA;rG;mU;rU;dB;rC;rA;mC;rA;mU;rU;mC;rU;mG;rG;mC (SEQ ID No. 140) | | | |
| Q-636 | rG;rC;rC;rA;rG;rA;rA;rU;rG;rG;rA;rA;rC;rU;rC;rC;rU (SEQ ID No. 139) | rA;mG;rG;mA;rG;mU;rU;mC;mC;dB;rA;mC;rA;mU;rU;mC;rU;mG;rG;mC (SEQ ID No. 140) | | | |
| Q-637 | rG;rC;rC;rA;rG;rA;rA;rU;rG;rG;rA;rA;rC;rU;rC;rC;rU (SEQ ID No. 139) | rA;mG;rG;mA;rG;mU;rU;mC;rC;rC;dB;mC;rA;mU;rU;mC;rU;mG;rG;mC (SEQ ID No. 140) | | | |
| Q-638 | rG;rC;rC;rA;rG;rA;rA;rU;rG;rG;rA;rA;rC;rU;rC;rC;rU (SEQ ID No. 139) | rA;mG;rG;mA;rG;mU;rU;mC;rC;rA;dB;rA;mU;rU;mC;rU;mG;rG;mC (SEQ ID No. 140) | | | |
| Q-639 | rG;rC;rC;rA;rG;rA;rA;rU;rG;rG;rA;rA;rC;rU;rC;rC;rU (SEQ ID No. 139) | rA;mG;rG;mA;rG;mU;rU;mC;rC;rA;mC;dB;mU;rU;mC;rU;mG;rG;mC (SEQ ID No. 140) | | | |
| Q-640 | rG;rC;rC;rA;rG;rA;rA;rU;rG;rG;rA;rA;rC;rU;rC;rC;rU (SEQ ID No. 139) | rA;mG;rG;mA;rG;mU;rU;mC;rC;rA;mC;rA;dB;rU;mC;rU;mG;rG;mC (SEQ ID No. 140) | | | |
| Q-641 | rG;rC;rC;rA;rG;rA;rA;rU;rG;rG;rA;rA;rC;rU;rC;LdC;rU (SEQ ID No. 139) | rA;rG;rG;rA;rG;rU;rU;rC;rC;rA;rC;rA;rU;rU;rC;rU;rG;rG;rC (SEQ ID No. 140) | | | |
| Q-642 | rG;rC;rC;rA;rG;rA;rA;rU;rG;rG;rA;rA;rC;rU;rC;LdC;LdC;rU (SEQ ID No. 139) | rA;rG;rG;rA;rG;rU;rU;rC;rC;rA;rC;rA;rU;rU;rC;rU;rG;rG;rC (SEQ ID No. 140) | | | |
| Q-643 | 5medG;rC;rC;rA;rG;rA;rA;rU;rG;rA;rA;rC;rU;rC;L;dC;rU (SEQ ID No. 139) | rA;rG;rG;rA;rG;rU;rU;rC;rC;rA;rC;rA;rU;rU;rC;rU;rG;rG;rC (SEQ ID No. 140) | | | |
| Q-644 | 5medG;rC;rC;rA;rG;rA;rA;rU;rG;rG;rA;rA;rC;rU;rC;rU;LdC;LdC;rU (SEQ ID No. 139) | rA;rG;rG;rA;rG;rU;rU;rC;rC;rA;rC;rA;rU;rU;rC;rU;rG;rG;rC (SEQ ID No. 140) | | | |
| Q-645 | iB;rG;rC;rC;rA;rG;rA;rG;rA;rA;rU;rG;rG;rA;rA;rC;rU;rC;LdC;rU (SEQ ID No. 139) | rA;rG;rG;rA;rG;rU;rU;rC;rC;rA;rC;rA;rU;rU;rC;rU;rG;rG;rC (SEQ ID No. 140) | | | |
| Q-646 | iB;rG;rC;rC;rA;rG;rA;rA;rU;rG;rG;rA;rA;rC;rU;rC;rU;LdC;Ld;C;rU (SEQ ID No. 139) | rA;rG;rG;rA;rG;rU;rU;rC;rC;rA;rC;rA;rU;rU;rC;rU;rG;rG;rC (SEQ ID No. 140) | | | |

DOUBLE-STRANDED RNA DIRECTED TO CASP2 AND METHODS OF USE THEREOF

This application is a §371 national stage of PCT International Application No. PCT/IL2008/01197, filed Sep. 4, 2008, and claims the benefit of U.S. Provisional Applications Nos. 61/189,035, filed Aug. 15, 2008; 61/134,638, filed Jul. 10, 2008; 61/128,519, filed May 22, 2008; 61/010,040, filed Jan. 4, 2008; 61/003,535, filed Nov. 15, 2007; 61/000,664, filed Oct. 25, 2007; and 60/997,576, filed Oct. 3, 2007, the contents of all of which are hereby incorporated by reference into this application.

This application incorporates-by-reference nucleotide and/or amino acid sequences which are present in the file named "120520_2094_77602-A-PCT-US_Substitute_Sequence_Listing_NJC.txt," which is 15.9 megabytes in size, and which was created May 15, 2012, in the IBM-PCT machine format, having an operating system compatibility with MS-Windows, which is contained in the text file filed May 15, 2012 as part of this application.

Throughout this application various patent and scientific publications are cited. The disclosures for these publications in their entireties are hereby incorporated by reference into this application to more fully describe the state of the art to which this invention pertains.

FIELD OF THE INVENTION

The present invention relates to novel compounds, pharmaceutical compositions comprising same and methods of use thereof for the inhibition of certain mammalian genes including TP53BP2, LRDD, CYBA, CASP2, NOX3, HRK, RAC1, RHOA and DUOX1. The compounds and compositions are thus useful in the treatment of subjects suffering from diseases or conditions and or symptoms associated with such diseases or conditions in which gene expression has adverse consequences. In particular embodiments, the invention provides, compositions comprising same and methods of use thereof. The present invention also provides novel structural motifs useful in the preparation of chemically modified siRNA oligonucleotides, compositions comprising same and methods of use thereof.

BACKGROUND OF THE INVENTION siRNAs and RNA Interference

RNA interference (RNAi) is a phenomenon involving double-stranded (ds) RNA-dependent gene specific posttranscriptional silencing. Initial attempts to study this phenomenon and to manipulate mammalian cells experimentally were frustrated by an active, non-specific antiviral defense mechanism which was activated in response to long dsRNA molecules (Gil et al. Apoptosis, 2000. 5:107-114). Later, it was discovered that synthetic duplexes of 21 nucleotide RNAs could mediate gene specific RNAi in mammalian cells, without stimulating the generic antiviral defense mechanisms (see Elbashir et al. Nature 2001, 411:494-498 and Caplen et al. PNAS USA 2001, 98:9742-9747). As a result, small interfering RNAs (siRNAs) have become powerful tools in attempting to understand gene function.

RNA interference (RNAi) in mammals is mediated by small interfering RNAs (siRNAs) (Fire et al, Nature 1998, 391:806) or microRNAs (miRNAs) (Ambros, Nature 2004, 431(7006):350-355; Bartel, Cell 2004, 116(2): 281-97). The corresponding process in plants is commonly referred to as specific post-transcriptional gene silencing (PTGS) or RNA silencing and is also referred to as quelling in fungi.

An siRNA is a double-stranded RNA or modified RNA molecule which down-regulates or silences (prevents) the expression of a gene/mRNA of its endogenous (cellular) counterpart. The mechanism of RNA interference is detailed infra.

Several studies have revealed that siRNA therapeutics are effective in vivo in both mammals and in humans. Bitko et al., have shown that specific siRNA molecules directed against the respiratory syncytial virus (RSV) nucleocapsid N gene are effective in treating mice when administered intranasally (Nat. Med. 2005, 11(1):50-55). Recent reviews discussing siRNA therapeutics are available (Barik, et al., J. Mol. Med. 2005, 83:764-773; Dallas and Vlassov, Med. Sci. Monitor 2006, 12(4):RA67-74; Chakraborty, Current Drug Targets 2007, 8(3):469-82; Dykxhoorn et al., Gene Therapy 2006. 13:541-552).

Mucke (IDrugs 2007 10(1):37-41) presents a review of current therapeutics, including siRNA to various targets, for the treatment of ocular diseases, for example age related macular degeneration (AMD) and glaucoma.

siRNA Structures

The selection and synthesis of siRNA corresponding to known genes has been widely reported; (see for example Ui-Tei et al., J Biomed Biotech. 2006; 2006: 65052; Chalk et al., BBRC. 2004, 319(1): 264-74; Sioud & Leirdal, Met. Mol. Biol.; 2004, 252:457-69; Levenkova et al., Bioinform. 2004, 20(3):430-2; Ui-Tei et al., NAR. 2004, 32(3):936-48).

For examples of the use of, and production of, modified siRNA see, for example, Braasch et al., Biochem. 2003, 42(26):7967-75; Chiu et al., RNA, 2003, 9(9):1034-48; PCT publications WO 2004/015107 (atugen AG) and WO 02/44321 (Tuschl et al). U.S. Pat. Nos. 5,898,031 and 6,107, 094, teach chemically modified oligomers. US Patent Publication Nos. 2005/0080246 and 2005/0042647 relate to oligomeric compounds having an alternating motif and dsRNA compounds having chemically modified internucleoside linkages, respectively.

Other modifications have been disclosed. The inclusion of a 5'-phosphate moiety was shown to enhance activity of siRNAs in *Drosophila* embryos (Boutla, et al., Curr. Biol. 2001, 11:1776-1780) and is required for siRNA function in human HeLa cells (Schwarz et al., Mol. Cell, 2002, 10:537-48). Amarzguioui et al., (NAR, 2003, 31(2):589-95) showed that siRNA activity depended on the positioning of the 2'-O-methyl modifications. Holen et al (NAR. 2003, 31(9):2401-07) report that an siRNA having small numbers of 2'-O-methyl modified nucleosides gave good activity compared to wild type but that the activity decreased as the numbers of 2'-O-methyl modified nucleosides was increased. Chiu and Rana (RNA. 2003, 9:1034-48) teach that incorporation of 2'-O-methyl modified nucleosides in the sense or antisense strand (fully modified strands) severely reduced siRNA activity relative to unmodified siRNA. The placement of a 2'-O-methyl group at the 5'-terminus on the antisense strand was reported to severely limit activity whereas placement at the 3'-terminus of the antisense and at both termini of the sense strand was tolerated (Czauderna et al., NAR. 2003, 31(11):2705-16; WO 2004/015107). The molecules of the present invention offer an advantage in that they are non-toxic and are useful in the preparation of pharmaceutical compositions for treatment of various diseases.

Pro-Apoptotic Genes

Pro-apoptotic genes are generally defined as genes that play a role in apoptotic cell death. A non-limiting list of pro-apoptotic genes, useful in the present invention is as follows: tumor protein p53 binding protein 2 (TP53BP2); leucine-rich repeats and death domain containing (LRDD);

cytochrome b-245, alpha polypeptide (CYBA, p22phox); activating transcription factor 3 (ATF3); caspase 2, apoptosis-related cysteine peptidase (CASP2); NADPH oxidase 3 (NOX3); harakiri, BCL2 interacting protein (HRK, BID3); complement component 1, q subcomponent binding protein (C1QBP); BCL2/adenovirus E1B 19 kDa interacting protein 3 (BNIP3); mitogen-activated protein kinase 8 (MAPK8, JNK1); mitogen-activated protein kinase 14 (MAPK14, p38); ras-related C3 botulinum toxin substrate 1 (rho family, small GTP binding protein RAC1); glycogen synthase kinase 3 beta (GSK3B); purinergic receptor P2X, ligand-gated ion channel, 7 (P2RX7); transient receptor potential cation channel, subfamily M, member 2 (TRPM2); poly (ADP-ribose) glycohydrolase (PARG); CD38 molecule (CD38); STEAP family member 4 (STEAP4); bone morphogenetic protein 2 (BMP2); gap junction protein, alpha 1, 43 kDa (connexin 43, GJA1); TYRO protein tyrosine kinase binding protein (TYROBP); connective tissue growth factor (CTGF); secreted phosphoprotein 1 (osteopontin, SPP1); ras homolog gene family, member A (RHOA); and dual oxidase 1 (DUOX1).

PCT Patent Application No. PCT/IL2007/001278 (PCT Publication No. WO 2008/050329) and U.S. Ser. No. 11/978,089 to the assignee of the present invention relate to inhibitors of the above-mentioned genes, and are incorporated by reference in their entirety.

Hearing Loss

Chemical-Induced Ototoxicity

The ototoxic effects of various therapeutic drugs on auditory cells and spiral ganglion neurons are often the factor limiting their therapeutic usefulness. Commonly used ototoxic drugs include the widely used chemotherapeutic agent cisplatin and its analogs, aminoglycoside antibiotics, e.g. gentamycin, quinine and its analogs, salicylate and its analogs, and loop-diuretics.

For example, antibacterial aminoglycosides such as gentamycin, streptomycin, kanamycin, tobramycin, and the like are known to have serious toxic side effects, particularly ototoxicity and nephrotoxicity, which reduce their value as therapeutic agents (see Goodman and Gilman's The Pharmacological Basis of Therapeutics, 6th ed., A. Goodman Gilman et al., eds; Macmillan Publishing Co., Inc., 1980. New York, pp. 1169-71). Thus, ototoxicity is a recognized dose-limiting side-effect of antibiotic administration. Studies have shown that from 4 to 15% of patients receiving one gram per day for greater than one week develop measurable hearing loss, which gradually worsens and can lead to permanent deafness if treatment continues.

Ototoxicity is also a serious dose-limiting side-effect for cisplatin, a platinum coordination complex that has proven effective on a variety of human cancers including testicular, ovarian, bladder, and head and neck cancer. Cisplatin (Platinol®) has been shown to damage auditory and vestibular systems. Salicylates, such as aspirin, are the most commonly used therapeutic drugs for their anti-inflammatory, analgesic, anti-pyretic and anti-thrombotic effects. Unfortunately, they too have ototoxic side effects and can lead to tinnitus ("ringing in the ears") and temporary hearing loss. Moreover, if the drug is used at high doses for a prolonged time, chronic and irreversible hearing impairment can arise.

Without being bound by theory, cisplatin drugs and other potentially ototoxic drugs induce the ototoxic effects via apoptosis in inner ear tissue, particularly inner ear hair cells (Zhang et al., Neuroscience 2003, 120(1):191-205; Wang et al., 2003, J. Neuroscience, 23(24):8596-8607). Prolonged use of high doses of ototoxic drugs leads to persistent and irreversible hearing impairment. In mammals, auditory hair cells are produced only during embryonic development and do not regenerate if lost during postnatal life. Therefore, a loss of hair cells will result in profound and irreversible deafness.

Unfortunately, there are presently no effective therapies to treat the cochlea to reverse deafness. Thus, an effective therapy to prevent cell death of auditory hair cells would be of great therapeutic value. U.S. Ser. No. 11/655,610, assigned to the applicant of the present invention relates to methods for treating hearing impairment in a subject comprising administering to the subject a composition comprising an effective amount of a p53 polynucleotide inhibitor, and optionally an inhibitor of a pro-apoptotic gene.

Presbycusis

Another type of hearing loss is presbycusis, which is hearing loss that gradually occurs in aging individuals. About 30-35% of adults between the ages of 65 and 75 years and 40-50% of people 75 and older experience hearing loss. Accordingly, there exists a need for means to prevent, reduce or treat the incidence and/or severity of inner ear disorders and hearing impairments involving inner ear tissue, particularly inner ear hair cells.

Acoustic Trauma

Acoustic trauma is a type of hearing loss that is caused by prolonged exposure to loud noises. Without wishing to be bound to theory, exposure to loud noise causes the hair cells on the cochlea to become less sensitive. With more severe exposure, injury can proceed from a loss of adjacent supporting cells to complete disruption of the organ of Corti. Death of the sensory cell can lead to progressive Wallerian degeneration and loss of primary auditory nerve fibers.

Accordingly, there exists a need for means to prevent, reduce or treat the incidence and/or severity diseases or disorders resulting from chemical toxicity including inner ear disorders and hearing impairment, renal damage (nephrotoxicity) and neural damage (neurotoxicity).

Acute Renal Failure

Acute renal failure (ARF) is a clinical syndrome characterized by rapid deterioration of renal function that occurs within days. The principal feature of ARF is an abrupt decline in glomerular filtration rate (GFR), resulting in the retention of nitrogenous wastes (urea, creatinine). Worldwide, severe ARF occurs in about 170-200 persons per million annually. Today, there is no specific treatment for established ARF. Several drugs have been found to ameliorate toxic and ischemic experimental ARF in animal models, as manifested by lower serum creatinine levels, reduced histological damage and faster recovery of renal function. These include antioxidants, calcium channel blockers, diuretics, vasoactive substances, growth factors, anti-inflammatory agents and more. However, when these drugs were tested in clinical trials no benefit was shown and their use for treating ARF has not been approved.

In the majority of hospitalized ARF patients, ARF is caused by acute tubular necrosis (ATN), which results from ischemic and/or nephrotoxic insults. Renal hypoperfusion is caused by hypovolemic, cardiogenic and septic shock, by administration of vasoconstrictive drugs or renovascular injury. Nephrotoxins include exogenous toxins such as contrast media and aminoglycosides as well as endogenous toxin such as myoglobin. Recent studies suggest that apoptosis in renal tissues is prominent in most human cases of ARF. The principal site of apoptotic cell death is the distal nephron. During the initial phase of ischemic injury, loss of integrity of the actin cytoskeleton leads to flattening of the epithelium, with loss of the brush border, loss of focal cell contacts, and subsequent disengagement of the cell from the underlying substratum. It has been suggested that apoptotic tubule cell death may be more predictive of functional changes than necrotic cell death (Komarov et al. 1999, Science. 285(5434):1733-7; Supavekin et al. 2003, Kidney Int. 63(5):1714-24). In conclusion, there are no currently satisfactory modes of therapy for the prevention and/or treatment of acute renal failure, and there is a clear need to develop novel compounds for this purpose.

Renal Transplant

Delayed Graft Function

Delayed graft function (DGF) is the most common complication of the immediate postoperative period in renal transplantation and results in poor graft outcome (Moreso et al. Nephrol. Dial. Transplant. 1999. 14(4):930-35). Although the incidence and definition of DGF vary among transplant centers, the consequences are invariable and include prolonged hospital stay, additional invasive procedures, and additional cost to the patient and health-care system.

Acute Transplant Rejection

Graft rejection has been categorized into three subsets depending on the onset of graft destruction. Hyperacute rejection is the term applied to very early graft destruction, usually within the first 48 hours. Acute rejection has an onset of several days to months or even years after transplantation and can involve humoral and/or cellular mechanisms. Chronic rejection relates to chronic alloreactive immune response.

Glaucoma

Glaucoma is one of the leading causes of blindness in the world. It affects approximately 66.8 million people worldwide. At least 12,000 Americans are blinded by this disease each year (Kahn and Milton, Am J. Epidemiol. 1980, 111(6): 769-76). Glaucoma is characterized by the degeneration of axons in the optic nerve head, primarily due to elevated intraocular pressure (IOP). One of the most common forms of glaucoma, known as primary open-angle glaucoma (POAG), results from the increased resistance of aqueous humor outflow in the trabecular meshwork (TM), causing IOP elevation and eventual optic nerve damage. Mucke (IDrugs 2007, 10(1):37-41) reviews current therapeutics, including siRNA to various targets for the treatment of ocular diseases, for example, age-related macular degeneration (AMD) and glaucoma.

Acute Respiratory Distress Syndrome

Acute respiratory distress syndrome (ARDS), also known as respiratory distress syndrome (RDS) or adult respiratory distress syndrome (in contrast with infant respiratory distress syndrome, IRDS) is a serious reaction to various forms of injuries to the lung. This is the most important disorder resulting in increased permeability pulmonary edema.

ARDS is a severe lung disease caused by a variety of direct and indirect insults. It is characterized by inflammation of the lung parenchyma leading to impaired gas exchange with concomitant systemic release of inflammatory mediators which cause inflammation, hypoxemia and frequently result in failure of multiple organs. This condition is life threatening and often lethal, usually requiring mechanical ventilation and admission to an intensive care unit. A less severe form is called acute lung injury (ALI).

Ischemia-Reperfusion Injury Following Organ Transplantation

Ischemia reperfusion injury (IRI) is one of the leading causes of death in organ allograft recipients. Significant IRI occurs in every organ transplant from a deceased donor and in some from live donors. It contributes to increased acute rejection and impaired long-term allograft function. Lung transplantation, the only definitive therapy for many patients with end stage lung disease, has poor survival rates in all solid allograft recipients.

Acute Lung Transplant Rejection

Acute allograft rejection remains a significant problem in lung transplantation despite advances in immunosuppressive medication. Rejection, and ultimately early morbidity and mortality may result from ischemia-reperfusion (I/R) injury and hypoxic injury.

Spinal Cord Injury

Spinal cord injury, is a disturbance of the spinal cord that results in loss of sensation and/or mobility, also known as myelopathy. The two most common types of spinal cord injury are due to trauma and disease. Traumatic injuries are often due to automobile accidents, falls, gunshots diving accidents, and the like. Diseases that can affect the spinal cord include polio, spina bifida, tumors, and Friedreich's ataxia.

Pressure Sores

Pressure sores, often known as bedsores or pressure ulcers, are areas of damaged skin and tissue. With unrelieved pressure, tissue ischemia can develop resulting in the accumulation of metabolic waste in the interstitial tissue, resulting in anoxia and cellular death. This pressure-induced ischemia also leads to excessive tissue hypoxia, further promoting bacterial proliferation and tissue destruction.

Age-Related Macular Degeneration

The most common cause of decreased best-corrected vision in individuals over 65 years of age in the United States is the retinal disorder known as age-related macular degeneration (AMD). The area of the eye affected by AMD is the macula, a small area in the center of the retina, composed primarily of photoreceptor cells. As AMD progresses, the disease is characterized by loss of sharp, central vision. So-called "dry" AMD accounts for about 85%-90% of AMD patients and involves alterations in eye pigment distribution, loss of photoreceptors and diminished retinal function due to overall atrophy of cells. "Wet" AMD involves proliferation of abnormal choroidal vessels leading to clots or scars in the sub-retinal space. Thus, the onset of "wet" AMD occurs because of the formation of an abnormal choroidal neovascular network (choroidal neovascularization, CNV) beneath the neural retina. The newly formed blood vessels are excessively leaky, leading to accumulation of subretinal fluid and blood leading to loss of visual acuity. Eventually, there is total loss of functional retina in the involved region, as a large disciform scar involving choroids and retina forms. While dry AMD patients may retain vision of decreased quality, wet AMD often results in blindness (Hamdi & Kenney, Frontiers in Bioscience, e305-314, May 2003).

Diabetic Retinopathy

Diabetic retinopathy (DR) is recognized as a retinal vascular disorder exhibiting excess capillary permeability, vascular closure, and proliferation of new vessels. DR occurs in two stages: nonproliferative and proliferative. In the nonproliferative stage the disease is characterized by a loss of retinal capillary pericytes, thickening of the basement membrane and development of microaneurysms, dot-blot hemorrhages, and hard exudates. In the proliferative stage the disease is characterized by extensive neovascularization, vessel intrusion into the vitreous, bleeding and fibrosis with subsequent retinal traction, which leads to severe vision impairment. U.S. Pat. No. 6,740,738 and related patents and applications to the assignee of the present invention are directed to methods of inhibiting the RTP801 gene and protein, for treating, inter alia, retinopathy.

Oral Mucositis

Oral mucositis, also referred to as a stomatitis, is a common and debilitating side effect of chemotherapy and radiotherapy regimens, which manifests itself as erythema and painful ulcerative lesions of the mouth and throat. Routine activities such as eating, drinking, swallowing, and talking may be difficult or impossible for subjects with severe oral mucositis. Palliative therapy includes administration of analgesics and topical rinses.

Dry-Eye Syndrome

Dry eye syndrome is a common problem usually resulting from a decrease in the production of tear film that lubricates the eyes. Most patients with dry eye experience discomfort, and no vision loss; although in severe cases, the cornea may become damaged or infected. Wetting drops (artificial tears) may be used for treatment while lubricating ointments may help more severe cases.

Ischemic Ocular Conditions

Ischemic optic neuropathy (ION) includes a variety of disorders that produce ischemia to the optic nerve. By definition, ION is termed anterior if disc edema is present acutely, suggesting infarction of the portion of the optic nerve closest to the globe. ION also may be posterior, lying several centimeters behind the globe. Ischemic optic neuropathy usually occurs only in people older than 60 years of age. Most cases are nonarteritic and attributed to the effects of atherosclerosis, diabetes, or hypertension on optic nerve perfusion. Temporal arteritis causes about 5% of cases (arteritic ION).

Symptoms and signs are sudden, partial or complete vision loss, accompanied by swelling of the optic nerve head and often hemorrhage. Visual field defects may manifest as loss of half the visual field with a horizontal demarcation or as central or centrocecal (surrounding the natural blind spot) scotomata. Decreased vision is soon followed by pallor of the optic disk.

More effective therapies to treat the above mentioned diseases and disorders would be of great therapeutic value.

SUMMARY OF THE INVENTION

The present invention provides novel TP53BP2, LRDD, CYBA, CASP2, NOX3, HRK, RAC1, RHOA and DUOX1 siRNA, and novel chemically and or structurally modified siRNA compounds for the inhibition of gene expression in general and of mammalian genes TP53BP2, LRDD, CYBA, ATF3, CASP2, NOX3, HRK, CIQBP, BNIP3, MAPK8, MAPK14, RAC1, GSK3B, P2RX7, TRPM2, PARG, CD38, STEAP4, BMP2, CX43, TYROBP, CTGF, SPP1, RHOA, and DUOX1, in particular. (See Table A, infra, for genes' details).

Novel structures of double stranded oligonucleotides, having advantageous properties and which may be applied to siRNA to any target sequence, and in particular to the siRNA oligonucleotides disclosed herein, are further provided. The chemically modified siRNA motifs disclosed in the present invention are useful in the preparation of stable and active compounds useful in RNA interference (RNAi).

The present invention also provides pharmaceutical compositions comprising one or more such oligonucleotides. The present invention further relates to methods for treating or preventing the incidence or severity of a disease or condition in a subject in need thereof wherein the disease or condition and/or symptoms associated therewith is associated with expression of the target gene. In some embodiments the disease or condition is selected from the group consisting of hearing loss, acute renal failure (ARF), glaucoma, acute respiratory distress syndrome (ARDS) and other acute lung and respiratory injuries, ischemia-reperfusion injury following lung transplantation, ocular ischemic conditions, organ transplantation including lung, liver, heart, pancreas, and kidney transplantation, nephro- and neurotoxicity, spinal cord injury, pressure sores, age-related macular degeneration (AMD), dry eye syndrome, oral mucositis, ischemic ocular neuropathy (ION) and chronic obstructive pulmonary disease (COPD). Such methods involve administering to a mammal in need of such treatment a prophylactically or therapeutically effective amount of one or more such compounds, which inhibit or reduce expression or activity of at least one such gene.

Accordingly, in one aspect the present invention provides novel oligonucleotide sequences useful in inhibiting a gene selected from LRDD, CYBA, CASP2, NOX3, HRK, RAC1, RHOA, and DUOX1, whose mRNA polynucleotide sequences are set forth in SEQ ID NOS: 1-2, 3-5, 6, 10-11, 12, 13, 24-26, 46 and 47-48, respectively. Tables D (D1-D34) provide 19, 21 and 23-mer sense and corresponding antisense oligonucleotides of the present invention. In another aspect the present invention provides chemically and or structurally modified nucleic acid compounds useful in inhibiting gene expression in general or gene expression of a gene selected from TP53BP2, LRDD, CYBA, ATF3, CASP2, NOX3, HRK, CIQBP, BNIP3, MAPK8, MAPK14, RAC1, GSK3B, P2RX7, TRPM2, PARG, CD38, STEAP4, BMP2, CX43, TYROBP, CTGF, SPP1, RHOA, or DUOX1. In various embodiments the modified compound comprises an oligonucleotide sequence present in Tables B (B1-B74) and C (C1-C3), set forth in SEQ ID NOS:97-68654 (disclosed in U.S. Ser. No. 11/978,089 and PCT Patent Application No. PCT/IL 2007/001278, which are hereby incorporated by reference in their entirety).

In certain embodiments the chemically and or structurally modified siRNA compounds comprise an oligonucleotide sequence present in Tables D (D1-D34; SEQ ID NOS:68, 655-87,088).

In one aspect the present invention provides a compound having structure (A) set forth below:

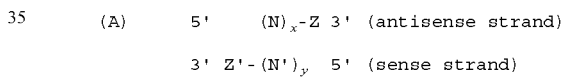

wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein each of x and y is an integer between 18 and 40;

wherein each of Z and Z' may be present or absent, but if present is 1-5 consecutive nucleotides covalently attached at the 3' terminus of the strand in which it is present;

wherein the sequence of $(N)_x$ comprises one or more of the antisense sequences present in Tables D (D1-D34).

In certain embodiments (N)x and (N')y are fully complementary. In other embodiments (N)x and (N')y are substantially complementary. In certain embodiments (N)x is fully complementary to a target sequence. In other embodiments (N)x is substantially complementary to a target sequence. According to certain preferred embodiments the present invention provides an siRNA compound comprising one or more modified nucleotide, wherein the modified nucleotide possesses a modification in the sugar moiety, in the base moiety or in the internucleotide linkage moiety.

In one aspect the present invention provides a compound having Structure (IX) set forth below:

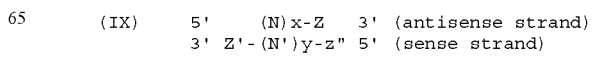

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein z" may be present or absent, but if present is a capping moiety covalently attached at the 5' terminus of (N')y;
wherein x=18 to 27;
wherein y=18 to 27;
wherein (N)x comprises modified and unmodified ribonucleotides, each modified ribonucleotide having a 2'-O-methyl on its sugar, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide;
wherein in (N')y at least one unconventional moiety is present, which unconventional moiety may be an abasic ribose moiety, an abasic deoxyribose moiety, a modified or unmodified deoxyribonucleotide, a mirror nucleotide, and a nucleotide joined to an adjacent nucleotide by a 2'-5' internucleotide phosphate bond; and
wherein the sequence of (N)x is substantially complementary to the sequence of (N')y; and the sequence of (N')y is substantially identical to the sequence of an mRNA encoded by a target gene.

In some embodiments x=y=19. In other embodiments x=y=23. In some embodiments the at least one unconventional moiety is present at positions 15, 16, 17, or 18 in (N')y. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18.

In other embodiments the unconventional moiety is an abasic moiety. In various embodiments (N')y comprises at least five abasic ribose moieties or abasic deoxyribose moieties.

In yet other embodiments (N')y comprises at least five abasic ribose moieties or abasic deoxyribose moieties and at least one of N' is an LNA.

In some embodiments of Structure (IX) (N)x comprises nine alternating modified ribonucleotides. In other embodiments of Structure (IX) (N)x comprises nine alternating modified ribonucleotides further comprising a 2'O modified nucleotide at position 2. In some embodiments (N)x comprises 2'O Me modified ribonucleotides at the odd numbered positions 1, 3, 5, 7, 9, 11, 13, 15, 17, 19. In other embodiments (N)x further comprises a 2'O Me modified ribonucleotide at one or both of positions 2 and 18. In yet other embodiments (N)x comprises 2'O Me modified ribonucleotides at positions 2, 4, 6, 8, 11, 13, 15, 17, 19.

In various embodiments z" is present and is selected from an abasic ribose moiety, a deoxyribose moiety; an inverted abasic ribose moiety, a deoxyribose moiety; C6-amino-Pi; a mirror nucleotide.

In another aspect the present invention provides a compound having Structure (X) set forth below:

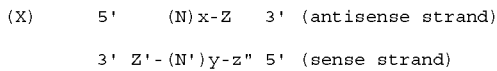

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein z" may be present or absent but if present is a capping moiety covalently attached at the 5' terminus of (N')y;
wherein x=18 to 27;
wherein y=18 to 27;
wherein (N)x comprises modified or unmodified ribonucleotides, and optionally at least one unconventional moiety;
wherein in (N')y at least one unconventional moiety is present, which unconventional moiety may be an abasic ribose moiety, an abasic deoxyribose moiety, a modified or unmodified deoxyribonucleotide, a mirror nucleotide, a non-base pairing nucleotide analog or a nucleotide joined to an adjacent nucleotide by a 2'-5' internucleotide phosphate bond; and
wherein the sequence of (N)x is substantially complementary to the sequence of (N')y; and the sequence of (N')y is substantially identical to the sequence of an mRNA encoded by a target gene.

In some embodiments x=y=19. In other embodiments x=y=23. In some preferred embodiments (N)x comprises modified and unmodified ribonucleotides, and at least one unconventional moiety. In various embodiments (N)x comprises less than 15 consecutive nucleotides complementary to the mRNA.

In some embodiments in (N)x the N at the 3' terminus is a modified ribonucleotide and (N)x comprises at least 8 modified ribonucleotides. In other embodiments at least 5 of the at least 8 modified ribonucleotides are alternating beginning at the 3' end. In some embodiments (N)x comprises an abasic moiety in one of positions 5, 6, 7, 8, 9, 10, 11, 12, 13, 14 or 15.

In some embodiments the at least one unconventional moiety in (N')y is present at positions 15, 16, 17, or 18. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18. In other embodiments the at least one unconventional moiety in (N')y is an abasic ribose moiety or an abasic deoxyribose moiety. In certain embodiments there are less than 15 base pairs between (N)x and (N')y.

In various embodiments of Structure (X) z" is present and is selected from an abasic ribose moiety, a deoxyribose moiety; an inverted abasic ribose moiety, a deoxyribose moiety; C6-amino-Pi; a mirror nucleotide.

In yet another aspect the present invention provides a compound having Structure (XI) set forth below:

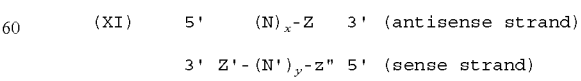

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present; wherein z" may be present or absent but if present is a capping moiety covalently attached at the 5' terminus of (N')y;
wherein x=18 to 27;
wherein y=18 to 27;
wherein (N)x comprises a combination of modified or unmodified ribonucleotides and unconventional moieties, any modified ribonucleotide having a 2'-O-methyl on its sugar;
wherein (N')y comprises modified or unmodified ribonucleotides and optionally an unconventional moiety, any modified ribonucleotide having a 2'OMe on its sugar;
wherein the sequence of (N)x is substantially complementary to the sequence of (N')y; and the sequence of (N')y is substantially identical to the sequence of an mRNA encoded by a target gene; and wherein there are less than 15 consecutive nucleotides complementary to the mRNA.

In some embodiments x=y=19. In other embodiments x=y=23. In some preferred embodiments the at least one preferred one unconventional moiety is present in (N)x and is an abasic ribose moiety or an abasic deoxyribose moiety. In other embodiments the at least one unconventional moiety is present in (N)x and is a non-base pairing nucleotide analog. In various embodiments (N)x comprises less than 15 consecutive nucleotides complementary to the mRNA. In various embodiments (N')y comprises unmodified ribonucleotides. In some embodiments (N)x comprises at least five abasic ribose moieties or abasic deoxyribose moieties or a combination thereof. In certain embodiments (N)x and/or (N')y comprise modified ribonucleotides which do not base pair with corresponding modified or unmodified ribonucleotides in (N')y and/or (N)x.

The Structure (IX), (X) and (XI) motifs is useful with any oligonucleotide pair (sense and antisense strands) to a mammalian or non-mammalian gene. In some embodiments the mammalian gene is a human gene. In various embodiments the mRNA of the human gene is set forth in one of SEQ ID NOS:1-41, 46-48.

In some embodiments the Structure (IX), (X) and (XI) motifs are used in combination with the oligonucleotide pairs presented in Tables B (B1-B74), C (C1-C3C4) and Tables D (D1-D34) (SEQ ID NOS:97-87,178).

In various embodiments the present invention provides an siRNA set forth in Structure (IV):

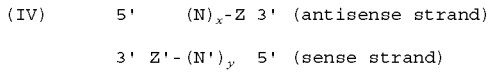

wherein each of N and N' is a nucleotide selected from an unmodified ribonucleotide, a modified ribonucleotide, an unmodified deoxyribonucleotide and a modified deoxyribonucleotide;
wherein each of (N)$_x$ and (N')$_y$ is an oligonucleotide in which each consecutive N or N' is joined to the next N or N' by a covalent bond;
wherein Z and Z' are absent;
wherein x=y=19;
wherein in (N')y the nucleotide in at least one of positions 15, 16, 17, 18 and 19 comprises a nucleotide selected from an abasic pseudo-nucleotide, a mirror nucleotide, a deoxyribonucleotide and a nucleotide joined to an adjacent nucleotide by a 2'-5' internucleotide bond;
wherein (N)x comprises alternating modified ribonucleotides and unmodified ribonucleotides each modified ribonucleotide being modified so as to have a 2'-O-methyl on its sugar and the ribonucleotide located at the middle position of (N)x being modified or unmodified, preferably unmodified; and wherein the sequence of (N)x is substantially complementary to the sequence of (N')y; and the sequence of (N')y is substantially identical to the mRNA of a target gene.

In some embodiments of Structure (IV), in (N')y the nucleotide in one or both of positions 17 and 18 comprises a modified nucleotide selected from an abasic pseudo-nucleotide, a mirror nucleotide and a nucleotide joined to an adjacent nucleotide by a 2'-5' internucleotide bond. In some embodiments the mirror nucleotide is selected from L-DNA and L-RNA. In various embodiments the mirror nucleotide is L-DNA.

In various embodiments (N')y comprises a modified nucleotide at position 15 wherein the modified nucleotide is selected from a mirror nucleotide and a deoxyribonucleotide.

In certain embodiments (N')y further comprises a modified nucleotide or pseudo nucleotide at position 2 wherein the pseudo nucleotide may be an abasic pseudo-nucleotide analog and the modified nucleotide is optionally a mirror nucleotide.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)X further comprises 2'O-Me modified ribonucleotides at one or both positions 2 and 18. In other embodiments (N)x comprises 2'O Me modified ribonucleotides at positions 2, 4, 6, 8, 11, 13, 15, 17, 19.

Other embodiments of Structures (IV), (IX) and (X) are envisaged wherein x=y=21 or wherein x=y=23; in these embodiments the modifications for (N')y discussed above instead of being in positions 17 and 18 are in positions 19 and 20 for 21-mer oligonucleotide and 21 and 22 for 23 mer oligonucleotide; similarly the modifications in positions 15, 16, 17, 18 or 19 are in positions 17, 18, 19, 20 or 21 for the 21-mer oligonucleotide and positions 19, 20, 21, 22, or 23 for the 23-mer oligonucleotide. The 2'O Me modifications on the antisense strand are similarly adjusted. In some embodiments (N)x comprises 2'O Me modified ribonucleotides at the odd numbered positions (5' to 3'; positions 1, 3, 5, 7, 9, 12, 14, 16, 18, 20 for the 21 mer oligonucleotide [nucleotide at position 11 unmodified] and 1, 3, 5, 7, 9, 11, 13, 15, 17, 19, 21, 23 for the 23 mer oligonucleotide [nucleotide at position 12 unmodified]. In other embodiments (N)x comprises 2'O Me modified ribonucleotides at positions 2, 4, 6, 8, 10, 12, 14, 16, 18, 20 [nucleotide at position 11 unmodified for the 21 mer oligonucleotide and at positions 2, 4, 6, 8, 10, 13, 15, 17, 19, 21, 23 for the 23 mer oligonucleotide [nucleotide at position 12 unmodified].

In some embodiments (N')y further comprises a 5' terminal cap nucleotide. In various embodiments the terminal cap moiety is selected from an abasic pseudo-nucleotide analog, an inverted abasic pseudo-nucleotide analog, an L-DNA nucleotide, and a C6-imine phosphate.

The Structure (IV) motif is useful with any oligonucleotide pair (sense and antisense strands) to a mammalian or non-mammalian gene. In some embodiments the mammalian gene is a human gene. In various embodiments the mRNA of the human gene is set forth in one of SEQ ID NOS:1-41, 46-48.

In some embodiments the Structure (IV) motif is used in combination with the oligonucleotide pairs presented in Tables B (B1-B74), C (C1-C3C4) and Tables D (D1-D34) (SEQ ID NOS:97-87,178)

In other embodiments the present invention provides a compound having Structure V set forth below:

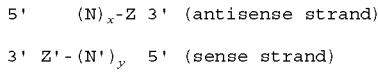

wherein each of N and N' is selected from a pseudo-nucleotide and a nucleotide;
wherein each nucleotide is selected from an unmodified ribonucleotide, a modified ribonucleotide, an unmodified deoxyribonucleotide and a modified deoxyribonucleotide;
wherein each of $(N)_x$ and $(N')_y$ is an oligonucleotide in which each consecutive N or N' is joined to the next N or N' by a covalent bond;
wherein Z and Z' are absent;
wherein x=18 to 27;
wherein y=18 to 27;
wherein the sequence of (N)x is substantially complementary to the sequence of (N')y; and the sequence of (N')y is substantially identical to the mRNA of a target gene;
wherein at least one of N is selected from an abasic pseudo nucleotide, a non-pairing nucleotide analog and a nucleotide mismatch to the mRNA of a target gene in a position of (N)x such that (N)x comprises less than 15 consecutive nucleotides complementary to the mRNA of a target gene.

In other embodiments the present invention provides a double stranded compound having Structure (VI) set forth below:

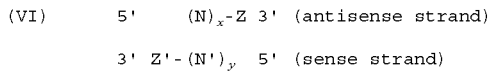

wherein each of N and N' is a nucleotide selected from an unmodified ribonucleotide, a modified ribonucleotide, an unmodified deoxyribonucleotide and a modified deoxyribonucleotide;
wherein each of $(N)_x$ and $(N')_y$ is an oligonucleotide in which each consecutive N or N' is joined to the next N or N' by a covalent bond;
wherein Z and Z' are absent;
wherein each of x and y is an integer between 18 and 40;
wherein the sequence of (N)x is substantially complementary to the sequence of (N')y; and the sequence of (N')y is substantially identical to the mRNA of a target gene;
wherein (N)x, (N')y or (N)x and (N')y comprise non base-pairing modified nucleotides such that (N)x and (N')y form less than 15 base pairs in the double stranded compound.

In other embodiments the present invention provides a compound having Structure (VII) set forth below:

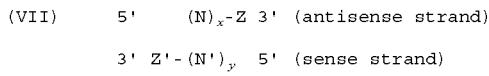

wherein each of N is a nucleotide selected from an unmodified ribonucleotide, a modified ribonucleotide, an unmodified deoxyribonucleotide and a modified deoxyribonucleotide;
wherein each of N' is a nucleotide analog selected from a six membered sugar nucleotide, seven membered sugar nucleotide, morpholino moiety, peptide nucleic acid and combinations thereof;
wherein each of $(N)_x$ and $(N')_y$ is an oligonucleotide in which each consecutive N or N' is joined to the next N or N' by a covalent bond;
wherein Z and Z' are absent;
wherein each of x and y is an integer between 18 and 40;
wherein the sequence of (N)x is substantially complementary to the sequence of (N')y; and the sequence of (N')y is substantially identical to the mRNA of a target gene.

In other embodiments the present invention provides a compound having Structure (VIII) set forth below:

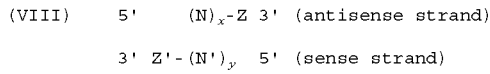

wherein each of N and N' is a nucleotide selected from an unmodified ribonucleotide, a modified ribonucleotide, an unmodified deoxyribonucleotide and a modified deoxyribonucleotide;
wherein each of $(N)_x$ and $(N')_y$ is an oligonucleotide in which each consecutive N or N' is joined to the next N or N' by a covalent bond;
wherein Z and Z' are absent;
wherein each of x and y is an integer between 18 and 40;
wherein one of N or N' in an internal position of (N)x or (N')y or one or more of N or N' at a terminal position of (N)x or (N')y comprises an abasic moiety or a 2' modified nucleotide;
wherein the sequence of (N)x is substantially complementary to the sequence of (N')y; and the sequence of (N')y is substantially identical to the mRNA of a target gene.

In some embodiments of Structures (V)-(VIII) (N)x comprises alternating modified ribonucleotides and unmodified ribonucleotides; each modified ribonucleotide being modified so as to have a 2'-O-methyl on its sugar. In some embodiments N located at the middle position of (N)x is unmodified.

In some embodiments of Structure (IV), in (N')y the nucleotide in one or both of positions 17 and 18 comprises a modified nucleotide selected from an abasic pseudo-nucleotide, a mirror nucleotide and a nucleotide joined to an adjacent nucleotide by a 2'-5' internucleotide bond. In some embodiments the mirror nucleotide is selected from L-DNA and L-RNA. In various embodiments the mirror nucleotide is L-DNA.

In various embodiments (N')y comprises a modified nucleotide at position 15 wherein the modified nucleotide is selected from a mirror nucleotide and a deoxyribonucleotide.

In certain embodiments (N')y further comprises a modified nucleotide at position 2 wherein the modified nucleotide is selected from a mirror nucleotide and an abasic pseudo-nucleotide analog.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments $(N)_x$ further comprises 2'O-Me modified ribonucleotides at one or both positions 2 and 18. In other embodiments (N)x comprises 2'O Me modified ribonucleotides at positions 2, 4, 6, 8, 11, 13, 15, 17, 19.

Other embodiments of Structure (IV) are envisaged wherein x=y=21 or wherein x=y=23; in these embodiments the modifications for (N')y discussed above instead of being in positions 17 and 18 are in positions 19 and 20 for 21-mer oligonucleotide and 21 and 22 for 23 mer oligonucleotide; similarly the modifications in positions 15, 16, 17, 18 or 19 are in positions 17, 18, 19, 20 or 21 for the 21-mer oligonucleotide and positions 19, 20, 21, 22, or 23 for the 23-mer oligonucleotide. The 2'O Me modifications on the antisense strand are similarly adjusted. In some embodiments (N)x comprises 2'O Me modified ribonucleotides at the odd numbered positions (5' to 3'; positions 1, 3, 5, 7, 9, 12, 14, 16, 18, 20 for the 21 mer oligonucleotide [nucleotide at position 11 unmodified] and 1, 3, 5, 7, 9, 11, 13, 15, 17, 19, 21, 23 for the 23 mer oligonucleotide [nucleotide at position 12 unmodified]. In other embodiments (N)x comprises 2'O Me modified ribonucleotides at positions 2, 4, 6, 8, 10, 12, 14, 16, 18, 20 [nucleotide at position 11 unmodified for the 21 mer oligonucleotide and at positions 2, 4, 6, 8, 10, 13, 15, 17, 19, 21, 23 for the 23 mer oligonucleotide [nucleotide at position 12 unmodified].

In some embodiments (N')y further comprises a 5' terminal cap nucleotide. In various embodiments the terminal cap moiety is selected from an abasic pseudo-nucleotide analog, an inverted abasic pseudo-nucleotide analog, an L-DNA nucleotide, and a C6-imine phosphate.

The Structure (IV) motif is useful with any oligonucleotide pair (sense and antisense strands) to a mammalian or non-mammalian gene. In some embodiments the mammalian gene is a human gene. In various embodiments the mRNA of the human gene is set forth in one of SEQ ID NOS:1-41, 46-48.

In some embodiments the Structure (IV) motif is used in combination with the oligonucleotide pairs presented in Tables B (B1-B74), C (C1-C4) and Tables D (D1-D34).

In a second aspect the present invention provides chemically and or structurally modified siRNA compounds based on Structures (C)-(H) and the related Structures (I)-(XI) disclosed herein. In various embodiments the siRNA compounds are based on one of a sense oligonucleotide and corresponding antisense oligonucleotide shown in Tables B (B1-B74), Tables C (C1-C4) and/or Tables D (D1-D34).

In another aspect the present invention provides a pharmaceutical composition comprising a modified or unmodified compound of the present invention, in an amount effective to inhibit human gene expression wherein the compound comprises an antisense sequence, (N)$_x$, present in Tables D (D1-D34); and a pharmaceutically acceptable carrier.

In yet another aspect the present invention provides a pharmaceutical composition comprising one or more modified compounds of the present invention, in an amount effective to inhibit human gene expression wherein the compound comprises an antisense sequence, (N)$_x$, present in Tables B (B1-B74) or Tables C (C1-C4) and/or Tables D (D1-D34); and a pharmaceutically acceptable carrier.

In another aspect, the present invention relates to a method for the treatment of a subject in need of treatment for a disease or disorder or symptoms associated with the disease or disorder, associated with the expression of a gene wherein the mRNA polynucleotide sequence of said gene is set forth in any one of SEQ ID NOS:1-41, 46-48 comprising administering to the subject an amount of an siRNA, according to the present invention, in a therapeutically effective dose so as to thereby treat the subject.

More specifically, the present invention provides methods and compositions useful in treating a subject suffering from acute renal failure (ARF), hearing loss, glaucoma, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation and including Delayed Graft Function (DGF) nephrotoxicity, spinal cord injury, pressure sores, dry eye syndrome, oral mucositis, ischemic ocular neuropathy (ION) and chronic obstructive pulmonary disease (COPD).

The methods of the invention comprise administering to the subject one or more siRNA compounds which inhibit expression of a gene wherein the mRNA polynucleotide sequence of said gene is set forth in any one of SEQ ID NOS:1-41, 46-48. The novel structures disclosed herein, when integrated into antisense and corresponding sense nucleic acid sequences to any target gene, provides siRNA compound useful in reducing expression of that target gene. The target gene is a mammalian or non-mammalian gene. In particular embodiments, the target gene is a mammalian gene having mRNA selected from any one of SEQ ID NOS:1-41, or 46-48.

The sense and corresponding antisense nucleotide sequences set forth in Tables B and C are disclosed in PCT publication no. WO2008/050329, to the assignee of the present invention, incorporated herein by reference in its entirety.

siRNA compounds wherein both the sequence and the modifications are known are excluded from the present invention.

BRIEF DESCRIPTION OF THE FIGURES

FIGS. 1A and 1B present 19-mer siRNA structures and experimental results obtained with 2'-O-methylated compounds of the present invention;

FIG. 2 shows examples of 23-mer siRNA compounds having alternating methylation pattern on both sense and antisense (AS) strands;

FIGS. 3A and 3B present 23-mer CASP2 siRNA structures comprising 2'-O-methylated monomers and experimental results obtained with those compounds;

FIGS. 5A and 5B present 23-mer CASP2 siRNA structures comprising 2'-O-methylated monomers and experimental results obtained with those compounds;

FIGS. 7A and 7B present 19-mer CASP2 siRNA structures comprising 2'5' bridged nucleotides and experimental results obtained using those compounds;

FIGS. 8A and 8B present 19-mer REDD2 and QM5 siRNA structures, respectfully, comprising 2'5' bridged nucleotides.

FIGS. 9A and 9B present 19-mer QM5 siRNA structures, comprising combination of 2'5' bridged nucleotides (stars) and 2'-O methoxyribonucleotides (bold, underlined)

FIGS. 10A and 10B present 19-mer QM5 siRNA structures, comprising combination of 2'5' bridged nucleotides (stars) and 2'-O methoxyribonucleotides (bold, underlined) and experimental results using those compounds.

FIGS. 11A and 11B present 23-mer CASP2 siRNA structures, comprising combination of 2'5' bridged nucleotides (stars) and 2'-O methoxyribonucleotides (bold, underlined) and experimental results using those compounds;

FIGS. 12A and 12B present 23-mer CASP2 siRNA structures, comprising 2'5' bridged nucleotides (stars) and experimental results using those compounds;

FIG. 13A shows QM5 siRNA structures, comprising L-DNA nucleotides; FIG. 13C shows serum stability and FIG. 13D shows the IC50 value of an siRNA comprising L-DNA nucleotides compared to an siRNA comprising an alternating 2' methoxy pattern;

FIG. 14A shows QM5 siRNA structures, comprising LNA nucleotides.

FIGS. 17A-17C show examples of siRNA compounds comprising combinations of modifications;

FIG. 18 depicts RNA/DNA chimeric oligonucleotides;

FIGS. 19A-19E show examples of oligonucleotides comprising L-DNA motifs, alone or in combination with additional modifications;

FIG. 20 depicts additional oligonucleotide structures useful in the preparation of duplex compounds according to the present invention;

FIG. 21 examples of non-base-pairing nucleotide monomers which are used in the various structures detailed herein;

FIG. 23 provides a table of compounds useful in RNAi comprising sequences and structural motifs according to the present invention.

DETAILED DESCRIPTION OF THE INVENTION

Figure 1B:
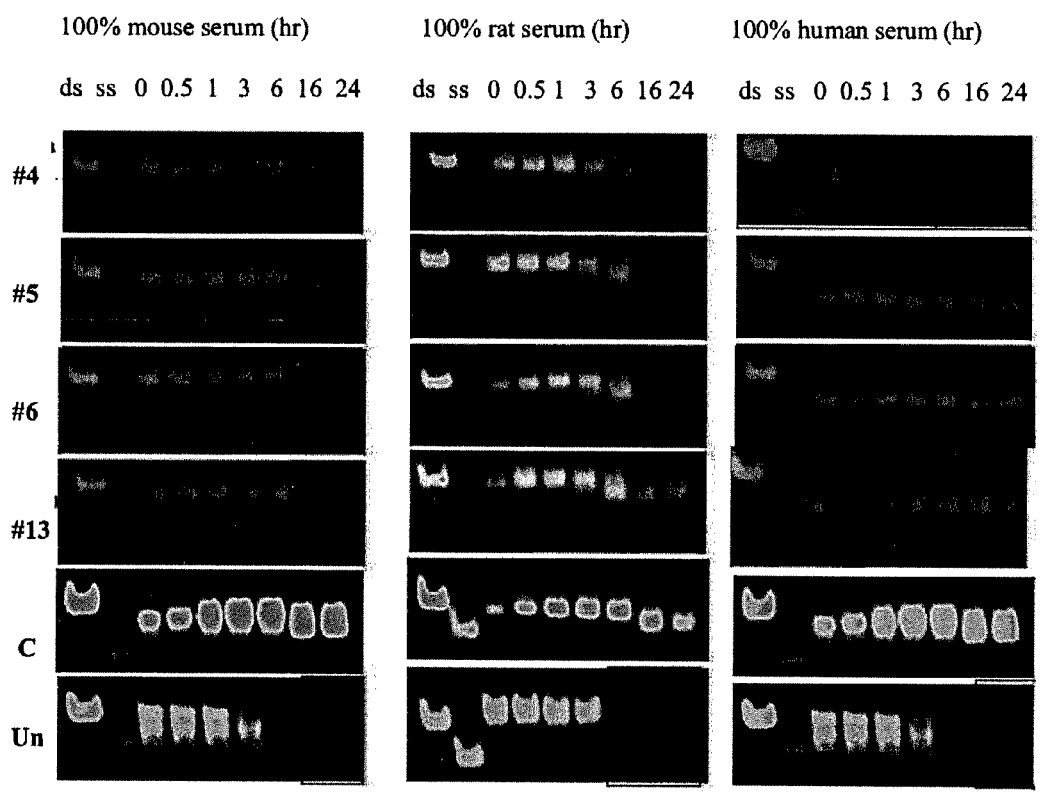

The present invention relates generally to compounds which down-regulate expression of various genes, particularly to novel small interfering RNAs (siRNAs), and to the use of these novel siRNAs in the treatment of a subject suffering from various medical conditions.

Accordingly, in one aspect the present invention provides novel oligonucleotide sequences useful in inhibiting a gene selected from LRDD, CYBA, CASP2, NOX3, HRK, RAC1, RHOA, and DUOX1, whose mRNA polynucleotide sequences are set forth in SEQ ID NOS: 1-2, 3-5, 6, 10-11, 12, 13, 24-26, 46 and 47-48, respectively. The oligonucleotide sequences are presented in Tables D (D1-D34) wherein a sense strand is paired with a complementary antisense strand. Novel structural motifs, useful in the preparation of siRNA to any target gene, are also provided. Lists of preferred siRNA to be used in the present invention are provided in Tables B (B1-B74), C (C1-C4) and D (D1-D34). For each gene there is a separate table of 19-mer, 21-mer and 23-mer sequences, which are prioritized based on their score in the proprietary algorithm as the best sequences for targeting the human gene expression.

Molecules and compositions, which inhibit the genes of the invention, are discussed herein at length, and any of said molecules and/or compositions may be beneficially employed in the treatment of a subject suffering from any of said conditions.

The siRNA compounds of the present invention possess structures and modifications which may for example increase activity, increase stability, and or minimize toxicity; the novel modifications of the siRNAs of the present invention are beneficially applied to double stranded RNA useful in preventing or attenuating target gene expression, in particular the target genes discussed herein.

Details of certain target genes and preferred indications are presented in Table A, hereinbelow.

TABLE A

Target genes of the present invention

| No. | Gene | Full name and Human Gene ID | Preferred diseases/ conditions |
|---|---|---|---|
| 1 | TP53BP2 | tumor protein p53 binding protein, 2<br>gi\|112799848\|ref\|NM_001031685.2 (SEQ ID NO: 1)<br>gi\|112799845\|ref\|NM_005426.2 (SEQ ID NO: 2): | ARF, nephrotoxicity, glaucoma, dry eye, ION, DGF, kidney transplantation, hearing loss, acoustic trauma, oral mucositis |
| 2 | LRDD | leucine-rich repeats and death domain containing<br>gi\|61742781\|ref\|NM_018494.3 (SEQ ID NO: 3)<br>gi\|61742783\|ref\|NM_145886.2 (SEQ ID NO: 4)<br>gi\|61742785\|ref\|NM_145887.2 (SEQ ID NO: 5) | ARF, glaucoma, hearing loss, SCI, oral mucositis; dry eye, kidney or lung transplantation, ION, ischemic-reperfusion lung injury |
| 3 | CYBA | cytochrome b-245, alpha polypeptide<br>gi\|68509913\|ref\|NM_000101.2\| (SEQ ID NO: 6) | ARF, ARDS, hearing loss, SCI, glaucoma, kidney transplantation, lung transplantation and ischemic-reperfusion lung injury, ION |
| 4 | ATF3 | activating transcription factor 3<br>gi\|95102484\|ref\|NM_001030287.2\| (SEQ ID NO: 7)<br>gi\|71902534\|ref\|NM_001674.2\| (SEQ ID NO: 8)<br>gi\|95102480\|ref\|NM_004024.4\| (SEQ ID NO: 9) | ARF, glaucoma, hearing loss, SCI, oral mucositis |
| 5 | CASP2 | caspase 2, apoptosis-related cysteine peptidase<br>gi\|39995058\|ref\|NM_032982.2 (SEQ ID NO: 10)<br>gi\|39995060\|ref\|NM_032983.2 (SEQ ID NO: 11) | ARF, glaucoma, hearing loss, SCI, dry eye, kidney transplantation, lung transplantation and ischemic-reperfusion lung injury, oral mucositis, ION |
| 6 | NOX3 | NADPH oxidase 3<br>Gi\|11136625\|ref\|NM_015718.1 (SEQ ID NO: 12) | Hearing loss, acoustic trauma |
| 7 | HRK | harakiri<br>gi\|4504492\|ref\|NM_003806.1 (SEQ ID NO: 13) | ARF, glaucoma, hearing loss, SCI, ARDS, ION |
| 8 | C1QBP | complement component 1, q subcomponent binding protein<br>gi\|28872801\|ref\|NM_001212.3 (SEQ ID NO: 14) | ARF, COPD, hearing loss, spinal-cord injury, pressure sores |

TABLE A-continued

Target genes of the present invention

| No. | Gene | Full name and Human Gene ID | Preferred diseases/ conditions |
|---|---|---|---|
| 9 | BNIP3 | BCL2/adenovirus E1B 19 kDa interacting protein 3 Gi\|7669480\|ref\|NM_004052.2 (SEQ ID NO: 15) | ARF, glaucoma, hearing loss, acoustic trauma, ION, SCI, ARDS, COPD, transplantation (lung) and ischemic-reperfusion lung injury, |
| 10 | MAPK8 | mitogen-activated protein kinase 8 gi\|20986493\|ref\|NM_002750.2 (SEQ ID NO: 16) gi\|20986522\|ref\|NM_139049.1 (SEQ ID NO: 17) gi\|20986518\|ref\|NM_139046.1 (SEQ ID NO: 18) gi\|20986520\|ref\|NM_139047.1 (SEQ ID NO: 19) | ARF, glaucoma, hearing loss, SCI, ARDS |
| 11 | MAPK14 | mitogen-activated protein kinase 14 gi\|20986511\|ref\|NM_139012.1 (SEQ ID NO: 20) gi\|20986515\|ref\|NM_139014.1 (SEQ ID NO: 21) gi\|4503068\|ref\|NM_001315.1 (SEQ ID NO: 22) gi\|20986513\|ref\|NM_139013.1 (SEQ ID NO: 23) | ARF, glaucoma, hearing loss, SCI, ARDS |
| 12 | Rac1 | ras-related C3 botulinum toxin substrate 1 (rho family, small GTP binding protein) gi\|38505164\|ref\|NM_198829.1 (SEQ ID NO: 24) gi\|156071511\|ref\|NM_018890.3 (SEQ ID NO: 25) gi\|156071503\|ref\|NM_006908.4 (SEQ ID NO: 26) | ARF, glaucoma, hearing loss, acoustic trauma, SCI, ARDS, AMD, pressure sores, lung transplantation and ischemic-reperfusion lung injury |
| 13 | GSK3B | glycogen synthase kinase 3 beta gi\|21361339\|ref\|NM_002093.2 (SEQ ID NO: 27) | ARF, hearing loss, SCI, COPD, pressure sores, ARDS, transplantation |
| 14 | P2RX7 | purinergic receptor P2X, ligand-gated ion channel, 7 gi\|34335273\|ref\|NM_002562.4 (SEQ ID NO: 28) | ARF, hearing loss, SCI, COPD, pressure sores, ARDS, transplantation |
| 15 | TRPM2 | transient receptor potential cation channel, subfamily M, member 2 gi\|67906811\|ref\|NM_001001188.3 (SEQ ID NO: 29) gi\|67906812\|ref\|NM_003307.3 (SEQ ID NO: 30) | ARF, hearing loss, SCI, COPD, pressure sores, ARDS, transplantation |
| 16 | PARG | poly (ADP-ribose) glycohydrolase gi\|70610135\|ref\|NM_003631.2 (SEQ ID NO: 31) | ARF, hearing loss, SCI, COPD, pressure sores, ARDS, transplantation |
| 17 | CD38 | CD38 molecule Gi\|38454325\|ref\|NM_001775.2 (SEQ ID NO: 32) | ARF, hearing loss, SCI, COPD, pressure sores |
| 18 | STEAP4 | STEAP family member 4 Gi\|13375867\|ref\|NM_024636.1 (SEQ ID NO: 33) | ARF, hearing loss, SCI, COPD, pressure sores |
| 19 | BMP2 | bone morphogenetic protein 2 gi\|80861484\|ref\|NM_001200.2 (SEQ ID NO: 34) | ARF, hearing loss, SCI, COPD, pressure sores |
| 20 | GJA1 | gap junction protein, alpha 1, 43 kDa gi\|4755136\|ref\|NM_000165.2 (SEQ ID NO: 35) | ARF, hearing loss, SCI, COPD, pressure sores |
| 21 | TYROBP | TYRO protein tyrosine kinase binding protein gi\|38157998\|ref\|NM_003332.2 (SEQ ID NO: 36) gi\|38158004\|ref\|NM_198125.1 (SEQ ID NO: 37) | ARF, hearing loss, SCI, COPD, pressure sores |
| 22 | CTGF | connective tissue growth factor gi\|4503122\|ref\|NM_001901.1 (SEQ ID NO: 38) | ARF, hearing loss, SCI, COPD |
| 23 | SPP1 | secreted phosphoprotein 1 gi\|91206461\|ref\|NM_001040058.1 (SEQ ID NO: 39) gi\|38146097\|ref\|NM_000582.2 (SEQ ID NO: 40) gi\|91598938\|ref\|NM_001040060.1 (SEQ ID NO: 41) | ARF, glaucoma, ARDS, osteoarthritis |
| 24 | RTN4R | reticulon 4 receptor gi\|47519383\|ref\|NM_023004.5 (SEQ ID NO: 42) | SCI |
| 25 | ANXA2 | annexin A2 gi\|50845387\|ref\|NM_001002858.1\| (SEQ ID NO: 43) gi\|50845389\|ref\|NM_004039.2\| (SEQ ID NO: 44) gi\|50845385\|ref\|NM_001002857.1 (SEQ ID NO: 45) | ARF, hearing loss, SCI, COPD |
| 26 | RHOA | ras homolog gene family member A gi\|50593005\|ref\|NM_001664.2 (SEQ ID NO: 46) | SCI, glaucoma, ION |
| 27 | DUOX1 | dual oxidase 1 gi\|28872749\|ref\|NM_017434.3 (SEQ ID NO: 47) gi\|28872750\|ref\|NM_175940.1 (SEQ ID NO: 48) | ARDS, COPD |

ARDS: acute respiratory distress syndrome;
AMD: age-related macular degeneration;
COPD: Chronic obstructive pulmonary disease;
ARF: acute renal failure;
SCI: spinal cord injury;
ION: ischemic ocular neuropathy.

Table A provides the gi (GeneInfo identifier) and accession numbers for polynucleotide sequences of the mRNA set forth as SEQ ID NOS:1-48. The corresponding polypeptides are set forth in SEQ ID NOS:49-96. The genes listed in Table A, supra, are described in more detail as follows:

(1) Tumor Protein p53 Binding Protein, 2 (TP53BP2):

Gene aliases: BBP; 53BP2; ASPP2; p53BP2; PPP1R13A, AI746547, X98550

This gene encodes a member of the ASPP (apoptosis-stimulating protein of p53) family of p53 interacting proteins. The corresponding protein contains four ankyrin repeats and an SH3 domain involved in protein-protein interactions. It is localized to the perinuclear region of the cytoplasm, and regulates apoptosis and cell growth through interactions with other regulatory molecules including members of the p53 family. Multiple transcript variants encoding different isoforms have been found for this gene. The polynucleotide sequences of human TP53BP2 mRNA transcriptional variants 1 and 2 are SEQ ID NOS:1 and 2, respectively, and the corresponding polypeptide sequence are set forth in SEQ ID NOS:49-50, respectively.

(2) Leucine-Rich Repeats and Death Domain Containing (LRDD)

Gene aliases: PIDD; MGC16925; DKFZp434D229, 1200011D09Rik, AU042446

The protein encoded by this gene contains a leucine-rich repeat and a death domain (LRDD). This protein has been shown to interact with other death domain proteins, such as Fas (TNFRSF6)-associated via death domain (FADD) and MAP-kinase activating death domain-containing protein (MADD), and thus may function as an adaptor protein in cell death-related signaling processes. The expression of the mouse counterpart of this gene has been found to be positively regulated by the tumor suppressor p53 and to induce cell apoptosis in response to DNA damage, which suggests a role for this gene as an effector of p53-dependent apoptosis. Three alternatively spliced transcript variants encoding distinct isoforms have been reported. The polynucleotide sequence of human LRDD transcriptional variants 2, 1 and 3 are set forth in SEQ ID NOS: 3-5, respectively, and the corresponding polypeptide sequence are set forth in SEQ ID NOS:51-53, respectively.

International Patent Publication WO 01/18037 discloses the LRDD polynucleotide and polypeptide sequences. International Patent Publication WO 03/087368 teaches compositions and methods for inhibiting genes.

(3) Cytochrome b-245, Alpha Polypeptide (CYBA)

Gene aliases: cytochrome b light chain; cytochrome b(558) alpha-subunit; cytochrome b, alpha polypeptide; flavocytochrome b-558 alpha polypeptide; p22-phox.

Cytochrome b is comprised of a light chain (alpha) and a heavy chain (beta). This gene encodes the light, alpha subunit which has been proposed as a primary component of the microbicidal oxidase system of phagocytes. Mutations in this gene are associated with autosomal recessive chronic granulomatous disease (CGD) characterized by the failure of activated phagocytes to generate superoxide, which is important for the microbicidal activity of these cells. The polynucleotide sequence of human CYBA mRNA is set forth in SEQ ID NO:6, and the corresponding polypeptide sequence is set forth in SEQ ID NO:54. International Patent Publication WO 2005/103297 teaches modulation of p22phox activity.

(4) Activating Transcription Factor 3 (ATF3)

Gene aliases: ATF3deltaZip2; ATF3deltaZip2c; ATF3deltaZip3, LRG-21, LRF-1

ATF3 is a member of the mammalian activation transcription factor/cAMP responsive element-binding (CREB) protein family of transcription factors. Multiple transcript variants encoding two different isoforms have been found for this gene. The longer isoform represses rather than activates transcription from promoters with ATF binding elements. The shorter isoform (deltaZip2) lacks the leucine zipper protein-dimerization motif and does not bind to DNA, and it stimulates transcription presumably by sequestering inhibitory co-factors away from the promoter. It is possible that alternative splicing may be physiologically important in the regulation of target genes. The polynucleotide sequences of human ATF3 transcriptional variants 3, 1 and 2 are set forth in SEQ ID NOS: 7-9, respectively, and the corresponding polypeptide sequences are set forth in SEQ ID NOS:55-57, respectively.

US Patent Publication No. 2003/0125277 teaches antisense to ATF3. International Patent Publication No. WO 2005/103297 relates to the methods of treating neuronal disease.

(5) Caspase 2, Apoptosis-Related Cysteine Peptidase (Neural Precursor Cell Expressed, Developmentally Down-Regulated 2 (CASP2)

Gene aliases: CASP-2, ICH-1L, ICH-1L/1S, ICH1, NEDD2; ICH-1 protease; NEDD2 apoptosis regulatory gene; Caspase 2, apoptosis-related cysteine protease.

This gene encodes a protein, which is a member of the cysteine-aspartic acid protease (caspase) family. Sequential activation of caspases plays a central role in the execution-phase of cell apoptosis. Caspases exist as inactive proenzymes, which undergo proteolytic processing at conserved aspartic residues to produce two subunits, large and small, that dimerize to form the active enzyme. The proteolytic cleavage of this protein is induced by a variety of apoptotic stimuli. Alternative splicing of this gene results in multiple transcript variants that encode different isoforms. The polynucleotide sequences of human CASP2 transcriptional variants 1 and 3 are set forth in SEQ ID NOS:10-11, respectively, and the corresponding polypeptide sequences are set forth in SEQ ID NOS:58-59, respectively.

U.S. Pat. No. 6,083,735 relates to the alternative splicing products of Casp2. U.S. Pat. Nos. 5,929,042 and 7,223,856 disclose specific Casp2 antisense compounds for the treatment of neurodegenerative disorders. International Patent Publication WO 02/024720 teaches Casp2 antisense. International Patent Publications WO 02/034201 discloses methods of treating diabetic retinopathy; WO 03/05821 relates to the inhibition of apoptosis related genes; WO 2004/009797 teaches Casp2 antisense; and WO 2004/103389 relates to methods for preventing cell death.

(6) NADPH Oxidase 3 (NOX3)

Gene aliases: GP91-3, MGC124289, het, nmf250; NADPH oxidase catalytic subunit-like 3, NADPH oxidase 1; head-tilt NADPH oxidases, such as NOX3, are plasma membrane-associated enzymes found in many cell types. They catalyze the production of superoxide by a 1-electron reduction of oxygen, using NADPH as the electron donor. The polynucleotide sequence of human NOX3 mRNA is set forth in SEQ ID NO:12, and the corresponding polypeptide sequence is set forth in SEQ ID NO:60.

International Patent Publication No. WO 2005/119251 relates to a method of treating hearing loss.

(7) Harakiri, BCL2 Interacting Protein (Contains Only BH3 Domain) (HRK)

Gene aliases: DP5, Bid3; BCL2-interacting protein; activator of apoptosis Hrk; BH3 interacting (with BCL2 family) domain, apoptosis agonist.

As an activator of apoptosis, Hrk regulates apoptosis through interaction with death-repressor proteins Bcl-2 and Bcl-X(L). The HRK protein lacks significant homology to other BCL2 family members except for an 8-amino acid region that was similar to the BCL2 homology domain-3 (BH3) motif of BIK. HRK interacts with BCL2 and BCLXL via the BH3 domain, but not with the death-promoting BCL2-related proteins BAX, BAK, or BCLXS. HRK localizes to membranes of intracellular organelles in a pattern similar to that previously reported for BCL2 and BCLXL. The polynucleotide sequence of human HRK mRNA is set forth in SEQ ID NO: 13 and the corresponding polypeptide sequence is set forth in SEQ ID NO. 61.

(8) Complement Component 1, q Subcomponent Binding Protein (C1QBP)

Gene aliases: GC1QBP, HABP1, SF2p32, gC1Q-R, gC1qR, p32, RP23-83I13.1, AA407365, AA986492, D11Wsu182e, MGC91723; C1q globular domain-binding protein; hyaluronan-binding protein 1; splicing factor SF2-associated protein.

The human complement subcomponent C1q associates with C1r and C1s in order to yield the first component of the serum complement system. The protein encoded by this gene is known to bind to the globular heads of C1q molecules and inhibit C1 activation. This protein has also been identified as the p32 subunit of pre-mRNA splicing factor SF2, as well as a hyaluronic acid-binding protein. The polynucleotide sequence of human C1QBP mRNA is set forth in SEQ ID NO: 14 and the corresponding polypeptide sequence is set forth in SEQ ID NO:62.

(9) BCL2/Adenovirus E1B 19 kDa Interacting Protein 3 (BNIP3)

Gene aliases: NIP3, MGC93043; BCL2/adenovirus E1B 19 kD-interacting protein 3, BCL2/adenovirus E1B 19 kDa-interacting protein 3 nuclear gene for mitochondrial product.

This gene is a member of the BCL2/adenovirus E1B 19 kd-interacting protein (BNIP) family. It interacts with the E1B 19 kDa protein, which is responsible for the protection of virally-induced cell death, as well as E1B 19 kDa-like sequences of BCL2, also an apoptotic protector. This gene contains a BH3 domain and a transmembrane domain, which have been associated with pro-apoptotic function. The dimeric mitochondrial protein encoded by this gene is known to induce apoptosis, even in the presence of BCL2. The polynucleotide sequence of human BNIP3 mRNA is set forth in SEQ ID NO:15 and the corresponding polypeptide sequence is set forth in SEQ ID NO:63.

U.S. Pat. No. 5,858,678 relates to the BNIP3 polynucleotide and polypeptide sequences. International Patent Publication No. WO 2004/009780 discloses methods of preventing ischemia induced cell damage.

(10) Mitogen-Activated Protein Kinase 8 (MAPK8)

Gene aliases: JNK; JNK1; PRKM8; SAPK1; JNK1A2; JNK21B1/2; JNK1 alpha protein kinase; JNK1 beta protein kinase; c-Jun N-terminal kinase 1; mitogen-activated protein Kinase 8 Transcript Variant 2; Protein Kinase JNK1; Stress-Activated Protein Kinase JNK1.

The protein encoded by this gene is a member of the MAP kinase family. MAP kinases act as an integration point for multiple biochemical signals, and are involved in a wide variety of cellular processes such as proliferation, differentiation, transcription regulation and development. This kinase is activated by various cell stimuli, and targets specific transcription factors, and thus mediates immediate-early gene expression in response to cell stimuli. The activation of this kinase by tumor-necrosis factor alpha (TNF-α) is found to be required for TNF-α induced apoptosis. This kinase is also involved in UV radiation induced apoptosis, which is thought to be related to cytochrome c-mediated cell death pathway. Studies of the mouse counterpart of this gene suggested its role in T cell proliferation, apoptosis and differentiation. Four alternatively spliced transcript variants encoding distinct isoforms have been reported. The polynucleotide sequence of MAPK8 transcriptional variants 2, 1, 3 and 4 are set forth in SEQ ID NOS:16-19, respectively, and the corresponding polypeptide sequences are set forth in SEQ ID NO:64-67.

International Patent Publication WO 99/09214 and U.S. Pat. No. 5,877,309 disclose antisense to JNK family members.

(11) Mitogen-Activated Protein Kinase 14 (MAPK14)

Gene aliases: CSBP1; CSBP2; CSPB1; EXIP; Mxi2; PRKM14; PRKM15; RK; SAPK2A; p38; p38ALPHA; MGC102436; p38MAPK; CSBP; Exip; Hog; MGC105413; p38Hog; Csaids binding protein; MAP kinase Mxi2; MAX-interacting protein 2; cytokine suppressive anti-inflammatory drug binding protein; p38 MAP kinase; p38 mitogen activated protein kinase; p38alpha Exip; stress-activated protein kinase 2A, tRNA synthetase cofactor p38.

The protein encoded by this gene is a member of the MAP kinase family, which act as an integration point for multiple biochemical signals, and are involved in a wide variety of cellular processes such as proliferation, differentiation, transcription regulation and development. This kinase is activated by various environmental stresses and proinflammatory cytokines. The activation requires its phosphorylation by MAP kinase kinases (MKKs), or its autophosphorylation triggered by its interaction with MAP3K7IP1/TAB1 protein. The substrates of this kinase include transcription regulator ATF2, MEF2C, and MAX, cell cycle regulator CDC25B, and tumor suppressor p53, which suggest its role in stress related transcription and cell cycle regulation, as well as in genotoxic stress response. Four alternatively spliced transcript variants of this gene encoding distinct isoforms have been reported. The polynucleotide sequence of human MAPK14 transcriptional variants 2, 4, 1 and 3 are set forth in SEQ ID NOS:20-23, respectively and the corresponding polypeptide sequences are set forth in SEQ ID NO:68-71.

International Patent Publications WO 2000/59919 and WO 2005/016947 and U.S. Pat. Nos. 6,140,124 and 6,448,079 teach antisense inhibition of p38.

(12) Ras-Related C3 Botulinum Toxin Substrate 1 (rho Family, Small GTP Binding Protein Rac1; RAC1)

Gene aliases: MGC111543, MIG5, TC-25, p21-Rac1; migration-inducing gene 5; migration-inducing protein 5; ras-related C3 botulinum toxin substrate 1; rho family, small GTP binding protein Rac1, ras-related C3 botulinum toxin substrate 1 (rho family small GTP binding protein Rac1)

The protein encoded by this gene is a GTPase, which belongs to the RAS superfamily of small GTP-binding proteins. Members of this superfamily regulate a diverse array of cellular events, including the control of cell growth, cytoskeletal reorganization, and the activation of protein kinases. Several alternatively spliced transcript variants of this gene have been described, but the full-length nature of some of these variants has not been determined. The polynucleotide sequences of human RAC1 transcriptional variants 1c, 1b and 1 are set forth in SEQ ID NOS:24-26, respectively and the corresponding polypeptide sequences are set forth in SEQ ID NO:72-74.

U.S. Pat. No. 6,180,597 relates to rho GTPase inhibitors that increase endothelial cell nitric oxide synthase levels. International Patent Publication WO 01/15739 teaches antisense modulation of Rho family members. International Patent Publication WO 2004/042052 teaches methods of suppressing TNF-α secretion.

(13) Glycogen Synthase Kinase 3 Beta (GSK3B)

Gene aliases: 7330414F15Rik, 8430431H08Rik, C86142, GSK-3, GSK-3beta, GSK3

Glycogen synthase kinase-3 (GSK3) is a proline-directed serine-threonine kinase that was initially identified as a phosphorylating and inactivating glycogen synthase. Two isoforms, alpha (GSK3A; MIM 606784) and beta, show a high degree of amino acid homology (Stambolic and Woodgett, Biochem J. 1994 303(Pt 3):701-4). GSK3B is involved in energy metabolism, neuronal cell development, and body pattern formation (Plyte et al., Biochim Biophys Acta. 1992. 1114(2-3):147-62). The polynucleotide sequence of human GSK3B mRNA is set forth in SEQ ID NO:27, and the corresponding polypeptide sequence is set forth in SEQ ID NO:75.

U.S. Pat. No. 6,323,029 relates to antisense inhibition of GSK3B.

(14) Purinergic Receptor P2X, Ligand-Gated Ion Channel, 7 (P2RX7)

Gene aliases: MGC20089, P2X7, AI467586; ATP receptor; P2X purinoceptor 7; P2X7 receptor; P2Z receptor; purinergic receptor P2X7.

The product of this gene belongs to the family of purinoceptors for ATP. This receptor functions as a ligand-gated ion channel and is responsible for ATP-dependent lysis of macrophages through the formation of membrane pores permeable to large molecules. Activation of this nuclear receptor by ATP in the cytoplasm may be a mechanism by which cellular activity can be coupled to changes in gene expression. Multiple alternatively spliced variants which would encode different isoforms have been identified although some fit nonsense-mediated decay (NMD) criteria. The polynucleotide sequence of human P2RX7 mRNA is set forth in SEQ ID NO:28 and the corresponding polypeptide sequence is set forth in SEQ ID NO:76.

(15) Transient Receptor Potential Cation Channel, Subfamily M, Member 2 (TRPM2)

Gene aliases: EREG1, KNP3, LTRPC2, MGC133383, NUDT9H, NUDT9L1, TRPC7, 9830168K16Rik, C79133, Trp7, Trrp7; estrogen responsive element associated gene 1; long transient receptor potential channel 2; transient receptor potential channel 7, transient receptor potential cation channel, subfamily M, member 2 (Trpm2); transient receptor potential channel 7; transient receptor protein 7.

The protein encoded by this gene is a calcium-permeable cation channel that is regulated by free intracellular ADP-ribose. The encoded protein is activated by oxidative stress and confers susceptibility to cell death. The polynucleotide sequences of the human TRPM2 is set forth in SEQ ID NO:29 and the corresponding polypeptide sequences is set forth in SEQ ID NO:77. (Two transcript variants encoding different isoforms S and L had been found for this gene. The S variant (SEQ ID NO:30) was removed by NCBI since it contains a sequencing error and does not exist).

(16) Poly (ADP-ribose) Glycohydrolase (PARG)

Gene aliases: PARG99; poly(ADP-ribose) glycohydrolase

PARG is the major enzyme responsible for the catabolism of poly(ADP-ribose), a reversible covalent-modifier of chromosomal proteins. The protein is found in many tissues and may be subject to proteolysis generating smaller, active products. The polynucleotide sequence of human PARG mRNA is set forth in SEQ ID NO:31, and the corresponding polypeptide sequence is set forth in SEQ ID NO:79.

(17) CD38 Molecule (CD38)

Gene aliases: T10, Cd38-rs1; ADP-ribosyl cyclase/cyclic ADP-ribose hydrolase; CD38 antigen; CD38 antigen (p45); cyclic ADP-ribose hydrolase.

CD38 is a novel multifunctional ectoenzyme widely expressed in cells and tissues; especially in leukocytes. CD38 also functions in cell adhesion, signal transduction and calcium signaling. The polynucleotide sequence of human CD38 mRNA is set forth in SEQ ID NO: 32, and the corresponding polypeptide sequences are set forth in SEQ ID NO:80.

(18) STEAP Family Member 4 (STEAP4)

Gene aliases: DKFZp666D049, FLJ23153, STAMP2, TIARP, TNFAIP9, 1110021O17Rik, AI481214, dudulin 4; six transmembrane prostate protein 2; tumor necrosis factor, alpha-induced protein 9; tumor necrosis-alpha-induced adipose-related protein, TNF α-induced adipose-related protein; tumor necrosis factor, alpha-induced protein 9.

A membrane protein induced by TNF-α and IL-6 in adipose tissues. Both IL-6 and TNF-α were shown to be unregulated in a spinal cord injury model (Ahn, et al., BBRC 2006 348(2):560-70) and are thought to promote apoptotic events. The polynucleotide sequence of human STEAP4 mRNA is set forth in SEQ ID NO:33, and the corresponding polypeptide sequence is set forth in SEQ ID NO:81.

(19) Bone Morphogenetic Protein 2 (BMP2)

Gene aliases: BMP2A, AI467020, BC069214CR618407, M22489

The protein encoded by this gene belongs to the transforming growth factor-beta (TGFB) superfamily. The encoded protein acts as a disulfide-linked homodimer and induces bone and cartilage formation. The polynucleotide sequence of human BMP2 mRNA is set forth in SEQ ID NO:34, and the corresponding polypeptide sequence is set forth in SEQ ID NO:82.

International Patent Publication No. WO 2005/041857, coassigned to the assignee of the present application, relates to BMP inhibition for the treatment of ischemia and neurological disease.

(20) Gap Junction Protein, Alpha 1, 43 kDa (Connexin 43, GJA1)

Gene aliases: CX43, DFNB38, GJAL, ODD, ODDD, ODOD, SDTY3, MGC93610, AU042049, AW546267, Cnx43, Cx43alpha1, Gja-1, Npm1, gap junction protein, alpha-like; oculodentodigital dysplasia (syndactyly type III), gap junction protein alpha 1 43 kD; gap junction protein, alpha 1, 43 kD, alpha 1 connexin.

Gap junction protein, alpha 1 is a member of the connexin gene family of proteins and is a component of gap junctions in the heart, and is believed to have a crucial role in the synchronized contraction of the heart and in embryonic development. Connexin 43 is targeted by several protein kinases that regulate myocardial cell-cell coupling. A related intron-less connexin 43 pseudogene, GJA1P, has been mapped to chromosome 5. The polynucleotide sequence of human GJA1 mRNA is set forth in SEQ ID NO:35, and the corresponding polypeptide sequence is set forth in SEQ ID NO:83.

U.S. Pat. No. 7,098,190 teaches antisense compounds for treating, inter alia, wounds and spinal cord injury.

(21) TYRO Protein Tyrosine Kinase Binding Protein (TYROBP)

Gene aliases: DAP12, KARAP, PLOSL, Ly83; DNAX-activation protein 12; killer activating receptor associated protein.

This gene encodes a transmembrane signaling polypeptide that contains an immunoreceptor tyrosine-based activation motif (ITAM) in its cytoplasmic domain. The protein may associate with the killer-cell inhibitory receptor (KIR) family of membrane glycoproteins and may act as an activating signal transduction element. This protein may bind zeta-chain (TCR) associated protein kinase 70 kDa (ZAP-70) and spleen tyrosine kinase (SYK) and play a role in signal transduction, bone modeling, brain myelination, and inflammation. Mutations within the gene have been associated with polycystic lipomembranous osteodysplasia with sclerosing leukoencephalopathy (PLOSL), also known as Nasu-Hakola disease. Its putative receptor, triggering receptor expressed on myeloid cells 2 (TREM2), also causes PLOSL. Two alternative transcript variants encoding distinct isoforms have been identified for this gene. Other alternative splice variants have been described, but their full-length nature has not been determined. The polynucleotide sequences of human TYROBP transcriptional variants 1 and 2 are set forth in SEQ ID NO:36-37, respectively, and the corresponding polypeptide sequences are set forth in SEQ ID NO:84-85.

(22) Connective Tissue Growth Factor (CTGF)

Gene aliases: CCN2, HCS24, IGFBP8, MGC102839, NOV2, CTGRP, Fisp12, Hcs24, fisp-12; hypertrophic chondrocyte-specific protein 24; insulin-like growth factor-binding protein 8, FISP-12 protein; fibroblast inducible secreted protein; fibroblast inducible secreted protein; hypertrophic chondrocyte-specific gene product 24.

A major connective tissue mitoattractant secreted by vascular endothelial cells. Promotes proliferation and differentiation of chondrocytes. The polynucleotide sequence of human CTGF mRNA is set forth in SEQ ID NO:38 and the corresponding polypeptide sequence is set forth in SEQ ID NO:86.

(23) Secreted Phosphoprotein 1 (SPP1)

Gene aliases: AA960535, AI790405, Apl-1, BNSP, BSPI, Bsp, ETA-1, Eta, OP, Opn, Opnl, Ric, Spp-1, minopontin, OSP; 44 kDa bone phosphoprotein; 44 kDa bone phosphoprotein; bone sialoprotein I; osteopontin, early T-lymphocyte activation 1.

SSP1 is a secreted protein which acts as a cytokine involved in enhancing production of interferon-γ and interleukin-12 and reducing production of interleukin-10, essential in the pathway that leads to type I immunity. The polynucleotide sequences of human SPP1 transcriptional variants 1, 2 and 3 are set forth in SEQ ID NOS:39-41, respectively and the corresponding polypeptide sequences are set forth in SEQ ID NOS:87-89.

U.S. Pat. No. 6,458,590 and US Patent Publication Nos. 2004/0142865 and 2006/0252684 relate to inhibition of osteopontin.

(24) Reticulon 4 Receptor (RTN4R)

Gene aliases: NGR, NOGOR, NgR1; Nogo-66 receptor; UNQ330/PRO526; nogo receptor; reticulon 4 receptor precursor.

This gene encodes the receptor for reticulon 4, oligodendrocyte myelin glycoprotein and myelin-associated glycoprotein. This receptor mediates axonal growth inhibition and may play a role in regulating axonal regeneration and plasticity in the adult central nervous system. The polynucleotide sequence of human RTN4R mRNA is set forth in SEQ ID NO:42 and the corresponding polypeptide sequence is set forth in SEQ ID NO:90.

(25) Annexin A2 (ANXA2)

Gene aliases: ANX2, ANX2L4, CAL1H, LIP2, LPC2, LPC2D, P36, PAP-IV; annexin calpactin I heavy polypeptide; chromobindin 8; lipocortin II; placental anticoagulant protein IV.

This gene encodes a member of the annexin family. Members of this calcium-dependent phospholipid-binding protein family play a role in the regulation of cellular growth and in signal transduction pathways. This protein functions as an autocrine factor, which heightens osteoclast formation and bone resorption. This gene has three pseudogenes located on chromosomes 4, 9 and 10, respectively. Multiple alternatively spliced transcript variants encoding different isoforms have been found for this gene. The polynucleotide sequences of human ANXA2 transcriptional variants 1, 3 and 2 are set forth in SEQ ID NOS:43-45 and the corresponding polypeptide sequences are set forth in SEQ ID NOS:91-93.

(26) ras Homolog Gene Family, Member A (RHOA)

Gene Aliases: ARH12, ARHA, RHO12, RHOH12, Aplysia ras-related homolog 12; oncogene RHO H12; small GTP binding protein RhoA.

RHOA is a small GTPase protein known to regulate the actin cytoskeleton in the formation of stress fibers. It acts upon the effector proteins: Rho kinase (ROCK) culminating in the inhibition of axonal regeneration. In vitro studies using the Rho-A antagonist C3 transferase enhances axonal growth on myelin substrates while in vivo studies have not been effective. The polynucleotide sequence of human RHOA mRNA is set forth in SEQ ID NO:46 and the corresponding polypeptide sequence is set forth in SEQ ID NO:94.

(27) Dual Oxidase 1 (DUOX1)

Gene Aliases: LNOX1, MGC138840, MGC138841, NOXEF1, THOX1, NADPH thyroid oxidase 1; flavoprotein NADPH oxidase; nicotinamide adenine dinucleotide phosphate oxidase.

The protein encoded by this gene is a glycoprotein and a member of the NADPH oxidase family. The synthesis of thyroid hormone is catalyzed by a protein complex located at the apical membrane of thyroid follicular cells. This complex contains an iodide transporter, thyroperoxidase, and a peroxide generating system that includes this encoded protein and DUOX2. This protein has both a peroxidase homology domain and a gp91phox domain. Two alternatively spliced transcript variants encoding the same protein have been described for this gene. The polynucleotide sequence of human DUOX1 transcriptional variants 1 and 2 are set forth in SEQ ID NOS:47-48, respectively and the corresponding polypeptide sequences are set forth in SEQ ID NOS:95-96.

A "pro-apoptotic polypeptide" refers to a polypeptide encoded by any of the above listed genes, including splice variants, isoforms, orthologs, or paralogs and the like.

According to one aspect the present invention provides inhibitory oligonucleotide compounds comprising unmodified and modified nucleotides. The compound comprises at least one modified nucleotide selected from the group consisting of a sugar modification, a base modification and an internucleotide linkage modification and may contain DNA, and modified nucleotides such as LNA (locked nucleic acid) including ENA (ethylene-bridged nucleic acid; PNA (peptide nucleic acid); arabinoside; PACE (phosphonoacetate and derivatives thereof), mirror nucleotide, or nucleotides with a 6 member sugar analog (eg. hexose or morpholino).

In one embodiment the compound comprises a 2' modification on the sugar moiety of at least one ribonucleotide ("2' sugar modification"). In certain embodiments the compound comprises 2'O-alkyl or 2'-fluoro or 2'O-allyl or any other 2' sugar modification, optionally on alternate positions. A preferred 2' modification is 2' O-methyl (2' methoxy, 2'OMe).

Other stabilizing modifications are also possible (eg. modified nucleotides added to a 3' or 5' terminus of an oligomer). In some embodiments the backbone of the oligonucleotides is modified and comprises phosphate-D-ribose entities but may also contain thiophosphate-D-ribose entities, phosphodiester L-ribose entities, triester, thioate, 2'-5' bridged backbone (also may be referred to as 5'-2'), PACE modified internucleotide linkage or any other type of modification.

Other modifications include additions to the 5' and/or 3' termini of the oligonucleotides. Such terminal modifications may be lipids, peptides, sugars or other molecules.

The present invention also relates to compounds which down-regulate expression of various genes, particularly to novel small interfering RNAs (siRNAs), and to the use of these novel siRNAs in the treatment of various diseases and medical conditions. Particular diseases and conditions to be treated are acute renal failure (ARF), hearing loss, glaucoma, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation, ocular ischemic conditions, organ transplantation nephrotoxicity, spinal cord injury, pressure sores, dry eye syndrome, oral mucositis, ION and chronic obstructive pulmonary disease (COPD).

Lists of preferred siRNA to be used in the present invention are provided in Tables B (B1-B74), Tables C (C1-C4) and Tables D (D1-D34). For each gene there is a separate list of 19-mer, 21-mer and 23-mer sequences, which are prioritized based on their score in the proprietary algorithm as the best sequences for targeting the human gene expression. The 21- or 23-mer siRNA sequences are also generated by 5' and/or 3' extension of the 19-mer sequences disclosed herein. Such extension is preferably complementary to the corresponding mRNA sequence. Certain 23-mer oligomers were devised by this method where the order of the prioritization is the order of the corresponding 19-mer.

Structural Motifs

According to the present invention the siRNA compounds are chemically and or structurally modified according to one of the following modifications set forth in Structures (A)-(H) or as tandem siRNA or RNAstar.

In one aspect the present invention provides a compound set forth as Structure (A):

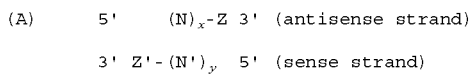

wherein each of N and N' is a nucleotide selected from an unmodified ribonucleotide, a modified ribonucleotide, an unmodified deoxyribonucleotide and a modified deoxyribonucleotide;
wherein each of $(N)_x$ and $(N')_y$ is an oligonucleotide in which each consecutive N or N' is joined to the next N or N' by a covalent bond;
wherein each of x and y is an integer between 18 and 40;
wherein each of Z and Z' may be present or absent, but if present is 1-5 consecutive nucleotides covalently attached at the 3' terminus of the strand in which it is present; and
wherein the sequence of $(N)_x$ is set forth in any one of Tables D (D1-D34); and with the proviso that each of (N)x and (N')y does not comprise more than 50% unmodified deoxyribonucleotide or modified deoxyribonucleotide.

The presently preferred antisense sequences are novel siRNA compounds directed to TP53BP2, LRDD, CYBA, CASP2, NOX3, HRK, RAC1, RHOA and DUOX1, whose mRNA polynucleotide sequences are set forth in SEQ ID NOS:1-2, 3-5, 6, 10-11, 12, 13, 24-26, 46 and 47-48, respectively.

In certain embodiments the present invention provides a compound having structure B (structures having alternating 2'-O-methyl modification in both strands for Tables D):

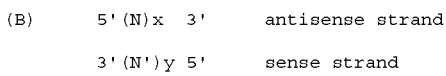

wherein each of $(N)_x$ and $(N')_y$ is an oligomer in which each consecutive N or N' is an unmodified ribonucleotide or a modified ribonucleotide joined to the next N or N' by a covalent bond;
wherein each of x and y=19, 21 or 23 and $(N)_x$ and $(N')_y$ are fully complementary
wherein alternating ribonucleotides in each of $(N)_x$ and $(N')_y$ are modified to result in a 2'-O-methyl modification in the sugar residue of the ribonucleotides;
wherein the sequence of $(N')_y$ is a sequence complementary to (N)x; and wherein the sequence of $(N)_x$ is present in any one of Tables D.

In some embodiments each of $(N)_x$ and $(N')_y$ is independently phosphorylated or non-phosphorylated at the 3' and 5' termini.

In certain embodiments of the invention, alternating ribonucleotides are modified in both the antisense and the sense strands of the compound.

In certain embodiments wherein each of x and y=19 or 23, each N at the 5' and 3' termini of $(N)_x$ is modified; and each N' at the 5' and 3' termini of $(N')_y$ is unmodified.

In certain embodiments wherein each of x and y=21, each N at the 5' and 3' termini of $(N)_x$ is unmodified; and each N' at the 5' and 3' termini of $(N')_y$ is modified.

In particular embodiments, when x and y=19, the siRNA is modified such that a 2'-O-methyl (2'-OMe) group is present on the first, third, fifth, seventh, ninth, eleventh, thirteenth, fifteenth, seventeenth and nineteenth nucleotide of the antisense strand $(N)_x$, and whereby the very same modification, i.e. a 2'-OMe group, is present at the second, fourth, sixth, eighth, tenth, twelfth, fourteenth, sixteenth and eighteenth nucleotide of the sense strand $(N')_y$. In various embodiments these particular siRNA compounds are blunt ended at both termini.

New Structures C-H for siRNA

The following structural motifs are useful in designing siRNA compounds.

In some embodiments, the present invention provides a compound having Structure (C):

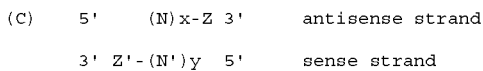

wherein each of N and N' is a nucleotide independently selected from an unmodified ribonucleotide, a modified ribonucleotide, an unmodified deoxyribonucleotide and a modified deoxyribonucleotide;
wherein each of (N)x and (N')y is an oligomer in which each consecutive nucleotide is joined to the next nucleotide by a covalent bond and each of x and y is an integer between 18 and 40;
wherein in (N)x the nucleotides are unmodified or (N)x comprises alternating modified ribonucleotides and unmodified ribonucleotides; each modified ribonucleotide being modified so as to have a 2'-O-methyl on its sugar and the ribonucleotide located at the middle position of (N)x being modified or unmodified preferably unmodified;
wherein (N')y comprises unmodified ribonucleotides further comprising one modified nucleotide at a terminal or penultimate position, wherein the modified nucleotide is selected from the group consisting of a mirror nucleotide, a bicyclic nucleotide, a 2'-sugar modified nucleotide, an altritol nucleotide, or a nucleotide joined to an adjacent nucleotide by an internucleotide linkage selected from a 2'-5' phosphodiester bond, a P-alkoxy linkage or a PACE linkage;

wherein if more than one nucleotide is modified in (N')y, the modified nucleotides may be consecutive;

wherein each of Z and Z' may be present or absent, but if present is 1-5 deoxyribonucleotides covalently attached at the 3' terminus of any oligomer to which it is attached;

wherein the sequence of $(N')_y$ comprises a sequence substantially complementary to (N)x; and wherein the sequence of $(N)_x$ comprises an antisense sequence substantially complementary to about 18 to about 40 consecutive ribonucleotides in the mRNA transcribed from a gene.

In certain embodiments the sequence of $(N)_x$ is present in any one of Tables A-D.

In particular embodiments, x=y=19 and in (N)x each modified ribonucleotide is modified so as to have a 2'-O-methyl on its sugar and the ribonucleotide located at the middle of (N)x is unmodified. Accordingly, in a compound wherein x=19, (N)x comprises 2'-O-methyl sugar modified ribonucleotides at positions 1, 3, 5, 7, 9, 11, 13, 15, 17 and 19. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 5. In other embodiments, (N)x comprises 2'O Me modified ribonucleotides at positions 2, 4, 8, 11, 13, 15, 17 and 19 and may further comprise at least one abasic or inverted abasic pseudo-nucleotide for example in position 6. In other embodiments, (N)x comprises 2'O Me modified ribonucleotides at positions 2, 4, 6, 8, 11, 13, 17 and 19 and may further comprise at least one abasic or inverted abasic pseudo-nucleotide for example in position 15. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 14. In other embodiments, (N)x comprises 2'O Me modified ribonucleotides at positions 1, 2, 3, 7, 9, 11, 13, 15, 17 and 19 and may further comprise at least one abasic or inverted abasic pseudo-nucleotide for example in position 5. In other embodiments, (N)x comprises 2'O Me modified ribonucleotides at positions 1, 2, 3, 5, 7, 9, 11, 13, 15, 17 and 19 and may further comprise at least one abasic or inverted abasic pseudo-nucleotide for example in position 6. In other embodiments, (N)x comprises 2'O Me modified ribonucleotides at positions 1, 2, 3, 5, 7, 9, 11, 13, 17 and 19 and may further comprise at least one abasic or inverted abasic pseudo-nucleotide for example in position 15. In other embodiments, (N)x comprises 2'O Me modified ribonucleotides at positions 1, 2, 3, 5, 7, 9, 11, 13, 15, 17 and 19 and may further comprise at least one abasic or inverted abasic pseudo-nucleotide for example in position 14. In other embodiments, (N)x comprises 2'O Me modified ribonucleotides at positions 2, 4, 6, 7, 9, 11, 13, 15, 17 and 19 and may further comprise at least one abasic or inverted abasic pseudo-nucleotide for example in position 5. In other embodiments, (N)x comprises 2'O Me modified ribonucleotides at positions 1, 2, 4, 6, 7, 9, 11, 13, 15, 17 and 19 and may further comprise at least one abasic or inverted abasic pseudo-nucleotide for example in position 5. In other embodiments, (N)x comprises 2'O Me modified ribonucleotides at positions 2, 4, 6, 8, 11, 13, 14, 16, 17 and 19 and may further comprise at least one abasic or inverted abasic pseudo-nucleotide for example in position 15. In other embodiments, (N)x comprises 2'O Me modified ribonucleotides at positions 1, 2, 3, 5, 7, 9, 11, 13, 14, 16, 17 and 19 and may further comprise at least one abasic or inverted abasic pseudo-nucleotide for example in position 15.

In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 7. In other embodiments, (N)x comprises 2'O Me modified ribonucleotides at positions 2, 4, 6, 11, 13, 15, 17 and 19 and may further comprise at least one abasic or inverted abasic pseudo-nucleotide for example in position 8. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 9. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 10. In other embodiments, (N)x comprises 2'O Me modified ribonucleotides at positions 2, 4, 6, 8, 13, 15, 17 and 19 and may further comprise at least one abasic or inverted abasic pseudo-nucleotide for example in position 11. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 12. In other embodiments, (N)x comprises 2'O Me modified ribonucleotides at positions 2, 4, 6, 8, 11, 15, 17 and 19 and may further comprise at least one abasic or inverted abasic pseudo-nucleotide for example in position 13. In yet other embodiments (N)x comprises at least one nucleotide mismatch relative to the target gene. In certain preferred embodiments, (N)x comprises a single nucleotide mismatch on position 5, 6, or 14. In one embodiment of Structure (C), at least two nucleotides at either or both the 5' and 3' termini of (N')y are joined by a 2'-5' phosphodiester bond. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and three nucleotides at the 3' terminus of (N')y are joined by two 2'-5' phosphodiester bonds (set forth herein as Structure I). In other preferred embodiments, x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N)y may be modified with 2'-O-methyl on its sugar. In another preferred embodiment, in (N)x the nucleotides alternate between 2'-O-methyl modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-methyl modifications.

In certain preferred embodiments of Structure C, x=y=19 and in (N')y, at least one position comprises an abasic or inverted abasic pseudo-nucleotide, preferably five positions comprises an abasic or inverted abasic pseudo-nucleotides. In various embodiments, the following positions comprise an abasic or inverted abasic: positions 1 and 16-19, positions 15-19, positions 1-2 and 17-19, positions 1-3 and 18-19, positions 1-4 and 19 and positions 1-5. (N')y may further comprise at least one LNA nucleotide.

In certain preferred embodiments of Structure C, x=y=19 and in (N')y the nucleotide in at least one position comprises a mirror nucleotide, a deoxyribonucleotide and a nucleotide joined to an adjacent nucleotide by a 2'-5' internucleotide bond.

In certain preferred embodiments of Structure C, x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. In certain embodiments (N')y further comprises a 5' terminal cap nucleotide such as 5'-O-methyl DNA or an abasic or inverted abasic pseudo-nucleotide as an overhang.

In yet other embodiments (N')y comprises at least one nucleotide mismatch relative to the target gene. In certain preferred embodiments, (N')y comprises a single nucleotide mismatch on position 6, 14, or 15.

In yet other embodiments (N')y comprises a DNA at position 15 and L-DNA at one or both of positions 17 and 18. In that structure, position 2 may further comprise an L-DNA or an abasic pseudo-nucleotide.

Other embodiments of Structure C are envisaged in wherein x=y=21 or wherein x=y=23; in these embodiments the modifications for (N')y discussed above instead of being on positions 15, 16, 17, 18 are on positions 17, 18, 19, 20 for 21 mer and on positions 19, 20, 21, 22 for 23 mer; similarly the modifications at one or both of positions 17 and 18 are on one or both of positions 19 or 20 for the 21 mer and one or both of positions 21 and 22 for the 23 mer. All modifications in the 19 mer are similarly adjusted for the 21 and 23 mers.

According to various embodiments of Structure (C), in (N')y 2, 3, 4, 5, 6, 7, 8, 9, 10, 11, 12, 13 or 14 consecutive ribonucleotides at the 3' terminus are linked by 2'-5' internucleotide linkages In one preferred embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y comprises a 2'-O-methyl sugar modification. In certain preferred embodiments of Structure C, x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In some embodiments the nucleotides at positions 17 and 18 in (N')y are joined by a 2'-5' internucleotide bond. In other embodiments the nucleotides at positions 16, 17, 18, 16-17, 17-18, or 16-18 in (N')y are joined by a 2'-5' internucleotide bond.

In certain embodiments (N')y comprises an L-DNA at position 2 and 2'-5' internucleotide bonds at positions 16, 17, 18, 16-17, 17-18, or 16-18. In certain embodiments (N')y comprises 2'-5' internucleotide bonds at positions 16, 17, 18, 16-17, 17-18, or 16-18 and a 5' terminal cap nucleotide.

According to various embodiments of Structure (C), in (N')y 2, 3, 4, 5, 6, 7, 8, 9, 10, 11, 12, 13 or 14 consecutive nucleotides at either terminus or 2-8 modified nucleotides at each of the 5' and 3' termini are independently minor nucleotides. In some embodiments the minor nucleotide is an L-ribonucleotide. In other embodiments the minor nucleotide is an L-deoxyribonucleotide. The minor nucleotide may further be modified at the sugar or base moiety or in an internucleotide linkage.

In one preferred embodiment of Structure (C), the 3' terminal nucleotide or two or three consecutive nucleotides at the 3' terminus of (N')y are L-deoxyribonucleotides.

In other embodiments of Structure (C), in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one series of preferred embodiments, three, four or five consecutive nucleotides at the 5' terminus of (N')y comprise the 2'-OMe modification. In another preferred embodiment, three consecutive nucleotides at the 3' terminus of (N')y comprise the 2'-O-methyl modification.

In some embodiments of Structure (C), in (N')y 2, 3, 4, 5, 6, 7, 8, 9, 10, 11, 12, 13 or 14 consecutive ribonucleotides at either or 2-8 modified nucleotides at each of the 5' and 3' termini are independently bicyclic nucleotide. In various embodiments the bicyclic nucleotide is a locked nucleic acid (LNA). A 2'-O, 4'-C-ethylene-bridged nucleic acid (ENA) is a species of LNA (see below).

In various embodiments (N')y comprises modified nucleotides at the 5' terminus or at both the 3' and 5' termini.

In some embodiments of Structure (C), at least two nucleotides at either or both the 5' and 3' termini of (N')y are joined by P-ethoxy backbone modifications. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle position of (N)x being unmodified; and four consecutive nucleotides at the 3' terminus or at the 5' terminus of (N')y are joined by three P-ethoxy backbone modifications. In another preferred embodiment, three consecutive nucleotides at the 3' terminus or at the 5' terminus of (N')y are joined by two P-ethoxy backbone modifications.

In some embodiments of Structure (C), in (N')y 2, 3, 4, 5, 6, 7 or 8, consecutive ribonucleotides at each of the 5' and 3' termini are independently mirror nucleotides, nucleotides joined by 2'-5' phosphodiester bond, 2' sugar modified nucleotides or bicyclic nucleotide. In one embodiment, the modification at the 5' and 3' termini of (N')y is identical. In one preferred embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one specific embodiment, the modified nucleotides at the 5' terminus of (N')y are mirror nucleotides and the modified nucleotides at the 3' terminus of (N')y are joined by 2'-5' phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified, or the ribonucleotides in (N)x being unmodified In another embodiment of Structure (C), the present invention provides a compound wherein x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA.

In another embodiment of Structure (C), five consecutive nucleotides at the 5' terminus of (N')y comprise the 2'-O-methyl sugar modification and two consecutive nucleotides at the 3' terminus of (N')y are L-DNA.

In yet another embodiment, the present invention provides a compound wherein x=y=19 or x=y=23; (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA such as ENA.

According to other embodiments of Structure (C), in (N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some preferred embodiments in (N')y, 1 or 2 consecutive nucleotides at each of the 5' and 3' termini are PACE nucleotides. Examples of PACE nucleotides and analogs are disclosed in U.S. Pat. Nos. 6,693,187 and 7,067,641 both incorporated by reference.

In additional embodiments, the present invention provides a compound having Structure (D):

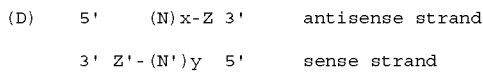

wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein (N)x comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein (N')y comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')y is a sequence substantially complementary to (N)x; and
wherein the sequence of (N)x comprises an antisense sequence having substantial identity to about 18 to about 40 consecutive ribonucleotides in the mRNA transcribed from a gene.

In certain embodiments the sequence of (N)x and the complementary (N')y are present in any one of Tables A-D.

In one embodiment of Structure (D), x=y=19 or x=y=23; (N)x comprises unmodified ribonucleotides in which two consecutive nucleotides linked by one 2'-5' internucleotide linkage at the 3' terminus; and (N')y comprises unmodified ribonucleotides in which two consecutive nucleotides linked by one 2'-5' internucleotide linkage at the 5' terminus.

In some embodiments, x=y=19 or x=y=23; (N)x comprises unmodified ribonucleotides in which three consecutive nucleotides at the 3' terminus are joined together by two 2'-5' phosphodiester bonds; and (N')y comprises unmodified ribonucleotides in which four consecutive nucleotides at the 5' terminus are joined together by three 2'-5' phosphodiester bonds (set forth herein as Structure II).

According to various embodiments of Structure (D) 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are linked by 2'-5' internucleotide linkages.

According to one preferred embodiment of Structure (D), four consecutive nucleotides at the 5' terminus of (N')y are joined by three 2'-5' phosphodiester bonds and three consecutive nucleotides at the 3' terminus of (N')x are joined by two 2'-5' phosphodiester bonds. Three nucleotides at the 5' terminus of (N')y and two nucleotides at the 3' terminus of (N')x may also comprise 3'-O-methyl modifications.

According to various embodiments of Structure (D), 2, 3, 4, 5, 6, 7, 8, 9, 10, 11, 12, 13 or 14 consecutive nucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently mirror nucleotides. In some embodiments the mirror is an L-ribonucleotide. In other embodiments the mirror nucleotide is L-deoxyribonucleotide.

In other embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one preferred embodiment of Structure (D), five consecutive nucleotides at the 5' terminus of (N')y comprise the 2'-O-methyl modification and five consecutive nucleotides at the 3' terminus of (N')x comprise the 2'-O-methyl modification. In another preferred embodiment of Structure (D), ten consecutive nucleotides at the 5' terminus of (N')y comprise the 2'-O-methyl modification and five consecutive nucleotides at the 3' terminus of (N')x comprise the 2'-O-methyl modification. In another preferred embodiment of Structure (D), thirteen consecutive nucleotides at the 5' terminus of (N')y comprise the 2'-O-methyl modification and five consecutive nucleotides at the 3' terminus of (N')x comprise the 2'-O-methyl modification.

In some embodiments of Structure (D), in (N')y 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (D), (N')y comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In various embodiments of Structure (D), (N)x comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In embodiments wherein each of the 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In one specific embodiment of Structure (D), five consecutive nucleotides at the 5' terminus of (N')y comprise the 2'-O-methyl modification and two consecutive nucleotides at the 3' terminus of (N')y are L-DNA. In addition, the compound may further comprise five consecutive 2'-O-methyl modified nucleotides at the 3' terminus of (N')x.

In various embodiments of Structure (D), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (E):

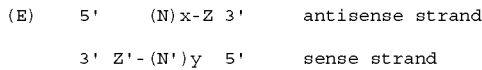

wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein (N)x comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein (N')y comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')y is a sequence substantially complementary to (N)x; and
wherein the sequence of $(N)_x$ comprises an antisense sequence having substantial identity to about 18 to about 40 consecutive ribonucleotides in the mRNA transcribed from a gene.

In certain embodiments the sequence of $(N)_x$ and the complementary (N')y are present in any one of Tables A-D.

In certain preferred embodiments the ultimate nucleotide at the 5' terminus of (N)x is unmodified.

According to various embodiments of Structure (E) 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are linked by 2'-5' internucleotide linkages.

According to various embodiments of Structure (E), 2, 3, 4, 5, 6, 7, 8, 9, 10, 11, 12, 13 or 14 consecutive nucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive nucleotides starting at the ultimate or penultimate position of the 3' terminus of (N')y are independently mirror nucleotides. In some embodiments the mirror is an L-ribonucleotide. In other embodiments the mirror nucleotide is L-deoxyribonucleotide.

In other embodiments of Structure (E), 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3° terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (E), in (N')y 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (E), (N')y comprises modified nucleotides selected from a bicyclic nucleotide, a 2' sugar modified nucleotide, a mirror nucleotide, an altritol nucleotide, a nucleotide joined to an adjacent nucleotide by a P-alkoxy backbone modification or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In various embodiments of Structure (E), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where both 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (E), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (F):

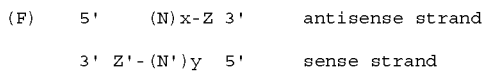

wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein each of (N)x and (N')y comprise unmodified ribonucleotides in which each of (N)x and (N')y independently comprise one modified nucleotide at the 3' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')$_y$ is a sequence substantially complementary to (N)x; and
wherein the sequence of (N)$_x$ comprises an antisense sequence having substantial identity to about 18 to about 40 consecutive ribonucleotides in the mRNA transcribed from a gene.

In certain embodiments the sequence of (N)$_x$ and the complementary (N')y are present in any one of Tables A-D.

In some embodiments of Structure (F), x=y=19 or x=y=23; (N')y comprises unmodified ribonucleotides in which two consecutive nucleotides at the 3' terminus comprises two consecutive mirror deoxyribonucleotides; and (N)x comprises unmodified ribonucleotides in which one nucleotide at the 3' terminus comprises a mirror deoxyribonucleotide (set forth as Structure III).

According to various embodiments of Structure (F) 2, 3, 4, 5, 6, 7, 8, 9, 10, 11, 12, 13 or 14 consecutive ribonucleotides independently beginning at the ultimate or penultimate position of the 3' termini of (N)x and (N')y are linked by 2'-5' internucleotide linkages.

According to one preferred embodiment of Structure (F), three consecutive nucleotides at the 3' terminus of (N')y are joined by two 2'-5' phosphodiester bonds and three consecutive nucleotides at the 3' terminus of (N')x are joined by two 2'-5' phosphodiester bonds.

According to various embodiments of Structure (F), 2, 3, 4, 5, 6, 7, 8, 9, 10, 11, 12, 13 or 14 consecutive nucleotides independently beginning at the ultimate or penultimate position of the 3' termini of (N)x and (N')y are independently mirror nucleotides. In some embodiments the mirror nucleotide is an L-ribonucleotide. In other embodiments the mirror nucleotide is an L-deoxyribonucleotide.

In other embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (F), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at both the 3' and 5' termini.

In various embodiments of Structure (F), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (F), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (G):

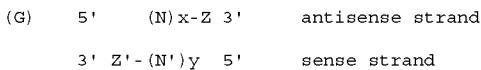

(G)  5'   (N)x-Z 3'      antisense strand
     3' Z'-(N')y 5'      sense strand wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein each of (N)x and (N')y comprise unmodified ribonucleotides in which each of (N)x and (N')y independently comprise one modified nucleotide at the 5' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;
wherein for (N)x the modified nucleotide is preferably at penultimate position of the 5' terminal;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')$_y$ is a sequence substantially complementary to (N)x; and
wherein the sequence of (N)$_x$ comprises an antisense sequence having substantial identity to about 18 to about 40 consecutive ribonucleotides in the mRNA transcribed from a gene.

In certain embodiments the sequence of (N)$_x$ and the complementary (N')y are present in any one of Tables A-D.

In some embodiments of Structure (G), x=y=19 or x=y=23.

According to various embodiments of Structure (G) 2, 3, 4, 5, 6, 7, 8, 9, 10, 11, 12, 13 or 14 consecutive ribonucleotides independently beginning at the ultimate or penultimate position of the 5' termini of (N)x and (N')y are linked by 2'-5' internucleotide linkages. For (N)x the modified nucleotides preferably starting at the penultimate position of the 5' terminal.

According to various embodiments of Structure (G), 2, 3, 4, 5, 6, 7, 8, 9, 10, 11, 12, 13 or 14 consecutive nucleotides independently beginning at the ultimate or penultimate position of the 5' termini of (N)x and (N')y are independently mirror nucleotides. In some embodiments the mirror nucleotide is an L-ribonucleotide. In other embodiments the mirror nucleotide is an L-deoxyribonucleotide. For (N)x the modified nucleotides preferably starting at the penultimate position of the 5' terminal.

In other embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In some preferred embodiments the consecutive modified nucleotides preferably begin at the penultimate position of the 5' terminus of (N)x.

In one preferred embodiment of Structure (G), five consecutive ribonucleotides at the 5' terminus of (N')y comprise a 2'-O-methyl modification and one ribonucleotide at the 5' penultimate position of (N')x comprises a 2'-O-methyl modification. In another preferred embodiment of Structure (G), five consecutive ribonucleotides at the 5' terminus of (N')y comprise a 2'-O-methyl modification and two consecutive ribonucleotides at the 5' terminal position of (N')x comprise a 2'-O-methyl modification.

In some embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are bicyclic nucleotides. In various embodiments the bicyclic nucleotide is a locked nucleic acid (LNA) such as a 2'-O, 4'-C-ethylene-bridged nucleic acid (ENA). In some preferred embodiments the consecutive modified nucleotides preferably begin at the penultimate position of the 5' terminus of (N)x.

In various embodiments of Structure (G), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In various embodiments of Structure (G), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond. In various embodiments of Structure (G), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (H):

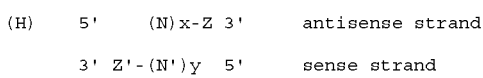

(H)  5'   (N)x-Z 3'      antisense strand
     3' Z'-(N')y 5'      sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 3' terminal or penultimate position or the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at an internal position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial identity to about 18 to about 40 consecutive ribonucleotides in the mRNA transcribed from a gene.

In certain embodiments the sequence of $(N)_x$ and the complementary (N')y are present in any one of Tables A-D.

In one embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or both termini of (N)x are independently 2' sugar modified nucleotides, bicyclic nucleotides, mirror nucleotides, altritol nucleotides or nucleotides joined to an adjacent nucleotide by a 2'-5' phosphodiester bond and 2, 3, 4, 5, 6, 7, 8, 9, 10, 11, 12, 13 or 14 consecutive internal ribonucleotides in (N')y are independently 2' sugar modified nucleotides, bicyclic nucleotides, mirror nucleotides, altritol nucleotides or nucleotides joined to an adjacent nucleotide by a 2'-5' phosphodiester bond. In some embodiments the 2' sugar modification comprises the presence of an amino, a fluoro, an alkoxy or an alkyl moiety. In certain embodiments the 2' sugar modification comprises a methoxy moiety (2'-OMe).

In another embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or 2-8 consecutive nucleotides at each of 5' and 3' termini of (N')y are independently 2' sugar modified nucleotides, bicyclic nucleotides, mirror nucleotides, altritol nucleotides or nucleotides joined to an adjacent nucleotide by a 2'-5' phosphodiester bond, and 2, 3, 4, 5, 6, 7, 8, 9, 10, 11, 12, 13 or 14 consecutive internal ribonucleotides in (N)x are independently 2' sugar modified nucleotides, bicyclic nucleotides, mirror nucleotides, altritol nucleotides or nucleotides joined to an adjacent nucleotide by a 2'-5' phosphodiester bond.

In one embodiment wherein each of 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (H), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In one preferred embodiment of Structure (H), x=y=19; three consecutive ribonucleotides at the 9-11 nucleotide positions 9-11 of (N')y comprise 2'-O-methyl modification and five consecutive ribonucleotides at the 3' terminal position of (N')x comprise 2'-O-methyl modification.

For all the above Structures (A)-(H), in various embodiments x=y and each of x and y is 19, 20, 21, 22 or 23. In certain embodiments, x=y=19. In yet other embodiments x=y=23. In additional embodiments the compound comprises modified ribonucleotides in alternating positions wherein each N at the 5' and 3' termini of (N)x are modified in their sugar residues and the middle ribonucleotide is not modified, e.g. ribonucleotide in position 10 in a 19-mer strand, position 11 in a 21 mer and position 12 in a 23-mer strand.

In some embodiments where x=y=21 or x=y=23 the position of modifications in the 19 mer are adjusted for the 21 and 23 mers with the proviso that the middle nucleotide of the antisense strand is preferably not modified.

In some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 2' termini position using cleavable or non-cleavable phosphate groups. These particular siRNA compounds are also blunt ended and are non-phosphorylated at the termini; however, comparative experiments have shown that siRNA compounds phosphorylated at one or both of the 3'-termini have similar activity in vivo compared to the non-phosphorylated compounds.

In certain embodiments for all the above-mentioned Structures, the compound is blunt ended, for example wherein both Z and Z' are absent. In an alternative embodiment, the compound comprises at least one 3' overhang, wherein at least one of Z or Z' is present. Z and Z' independently comprises one or more covalently linked modified or non-modified nucleotides, for example inverted dT or dA; dT, LNA, mirror nucleotide and the like. In some embodiments each of Z and Z' are independently selected from dT and dTdT. siRNA in which Z and/or Z' is present have similar activity and stability as siRNA in which Z and Z' are absent.

In certain embodiments for all the above-mentioned Structures, the compound comprises one or more phosphonocarboxylate and/or phosphinocarboxylate nucleotides (PACE nucleotides). In some embodiments the PACE nucleotides are deoxyribonucleotides and the phosphinocarboxylate nucleotides are phosphinoacetate nucleotides. Examples of PACE nucleotides and analogs are disclosed in U.S. Pat. Nos. 6,693,187 and 7,067,641, both incorporated herein by reference.

In certain embodiments for all the above-mentioned Structures, the compound comprises one or more locked nucleic acids (LNA) also defined as bridged nucleic acids or bicyclic nucleotides. Preferred locked nucleic acids are 2'-O, 4'-C-ethylene nucleosides (ENA) or 2'-O, 4'-C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allart, et al., 1998. Nucleosides & Nucleotides 17:1523-1526; Herdewijn et al., 1999. Nucleosides & Nucleotides 18:1371-1376; Fisher et al., 2007, NAR 35(4):1064-1074; all incorporated herein by reference).

The present invention explicitly excludes compounds in which each of N and/or N' is a deoxyribonucleotide (D-A, D-C, D-G, D-T). In certain embodiments (N)x and (N')y may comprise independently 1, 2, 3, 4, 5, 6, 7, 8, 9 or more deoxyribonucleotides. In certain embodiments the present invention provides a compound wherein each of N is an unmodified ribonucleotide and the 3' terminal nucleotide or 2, 3, 4, 5, 6, 7, 8, 9, 10, 11, 12, 13 or 14 consecutive nucleotides at the 3' terminus of (N')y are deoxyribonucleotides. In yet other embodiments each of N is an unmodified ribonucleotide and the 5' terminal nucleotide or 2, 3, 4, 5, 6, 7, 8, 9, 10, 11, 12, 13 or 14 consecutive nucleotides at the 5' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide. In certain embodiments the 3' terminal nucleotide or 2, 3, 4, 5, 6, 7, 8, 9, 10, 11, 12 13 or 14 consecutive nucleotides at the 3' terminus of (N')y and the terminal 5' nucleotide or 2, 3, 4, 5, 6, 7, 8, 9, 10, 11, 12 13 or 14 consecutive nucleotides at the 5' terminus of (N)x are deoxyribonucleotides. The present invention excludes compounds in which each of N and/or N' is a deoxyribonucleotide. In some embodiments the 5' terminal nucleotide of N or 2 or 3 consecutive of N and 1, 2, or 3 of N' is a deoxyribonucleotide. Certain examples of active DNA/RNA siRNA chimeras are disclosed in US patent publication 2005/0004064, and Ui-Tei, 2008 (NAR 36(7):2136-2151) incorporated herein by reference in their entirety.

Unless otherwise indicated, in preferred embodiments of the structures discussed herein the covalent bond between each consecutive N or N' is a phosphodiester bond.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Said triple-stranded oligonucleotide may be an oligoribonucleotide having the general structure:

```
5' Oligo1 (sense)      LINKER A Oligo2 (sense)       3'
3' Oligo1 (antisense)  LINKER B Oligo3 (sense)       5'
3' Oligo3 (antisense)  LINKER C Oligo2 (antisense)   5'
or
5' Oligo1 (sense)      LINKER A Oligo2 (antisense)   3'
3' Oligo1 (antisense)  LINKER B Oligo3 (sense)       5'
3' Oligo3 (antisense)  LINKER C Oligo2 (sense)       5'
or
5' Oligo1 (sense)      LINKER A Oligo3 (antisense)   3'
3' Oligo1 (antisense)  LINKER B Oligo2 (sense)       5'
5' Oligo3 (sense)      LINKER C Oligo2 (antisense)   3'
``` wherein one or more of linker A, linker B or linker C is present; any combination of two or more oligonucleotides and one or more of linkers A-C is possible, so long as the polarity of the strands and the general structure of the molecule remains. Further, if two or more of linkers A-C are present, they may be identical or different.

Thus, a triple-armed structure is formed, wherein each arm comprises a sense strand and substantially complementary antisense strand (i.e. Oligo1 antisense base pairs to Oligo1 sense etc.). The triple armed structure may be triple stranded, whereby each arm possesses base pairing.

Further, the above triple stranded structure may have a gap instead of a linker in one or more of the strands. Such a molecule with one gap is technically quadruple stranded and not triple stranded; inserting additional gaps or nicks will lead to the molecule having additional strands. Preliminary results obtained by the inventors of the present invention indicate that said gapped molecules are more active in inhibiting certain target genes than the similar but non-gapped molecules. This may also be the case for nicked molecules.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain preferred embodiments a covalent bond is a phosphodiester bond. Covalent bond encompasses non-phosphorous-containing internucleoside linkages, such as those disclosed in WO 2004/041924 inter alia. Unless otherwise indicated, in preferred embodiments of the structures discussed herein the covalent bond between each consecutive N or N' is a phosphodiester bond.

For all of the structures above, in some embodiments the oligonucleotide sequence of (N)x is fully complementary to the oligonucleotide sequence of (N')y. In other embodiments (N)x and (N')y are substantially complementary. In certain embodiments (N)x is fully complementary to a target sequence. In other embodiments (N)x is substantially complementary to a target sequence.

DEFINITIONS

For convenience certain terms employed in the specification, examples and claims are described herein.

It is to be noted that, as used herein, the singular forms "a", "an" and "the" include plural forms unless the content clearly dictates otherwise.

Where aspects or embodiments of the invention are described in terms of Markush groups or other grouping of alternatives, those skilled in the art will recognize that the invention is also thereby described in terms of any individual member or subgroup of members of the group.

A "pro-apoptotic polypeptide" refers to a polypeptide encoded by any of the above listed genes, including splice variants, isoforms, orthologs, or paralogs and the like.

An "inhibitor" is a compound which is capable of reducing the expression of a gene or the activity of the product of such gene to an extent sufficient to achieve a desired biological or physiological effect. The term "inhibitor" as used herein refers to one or more of an oligonucleotide inhibitor, including siRNA, shRNA, miRNA and ribozymes. Inhibition may also be referred to as down-regulation or, for RNAi, silencing.

The term "inhibit" as used herein refers to reducing the expression of a gene or the activity of the product of such gene to an extent sufficient to achieve a desired biological or physiological effect. Inhibition may be complete or partial.

As used herein, the terms "polynucleotide" and "nucleic acid" may be used interchangeably and refer to nucleotide sequences comprising deoxyribonucleic acid (DNA), and ribonucleic acid (RNA). The terms should also be understood to include, as equivalents, analogs of either RNA or DNA made from nucleotide analogs. Throughout this application mRNA sequences are set forth as representing the target of their corresponding genes. The terms "mRNA polynucleotide sequence" and mRNA are used interchangeably.

"Oligonucleotide" or "oligomer" refers to a deoxyribonucleotide or ribonucleotide sequence from about 2 to about 50 nucleotides. Each DNA or RNA nucleotide may be independently natural or synthetic, and or modified or unmodified. Modifications include changes to the sugar moiety, the base moiety and or the linkages between nucleotides in the oligonucleotide. The compounds of the present invention encompass molecules comprising deoxyribonucleotides, ribonucleotides, modified deoxyribonucleotides, modified ribonucleotides and combinations thereof.

As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

The present invention provides methods and compositions for inhibiting expression of a target gene in vivo. In general, the method includes administering oligoribonucleotides, in particular small interfering RNAs (i.e., siRNAs) or a nucleic acid material that can produce siRNA in a cell, to target an mRNA set forth in any one of SEQ ID NOS:1-41, 46-48; in an amount sufficient to down-regulate expression of a target gene by an RNA interference mechanism. In particular, the method is useful for inhibiting expression of the gene for treatment of a subject suffering from a disease related to expression of that gene. In accordance with the present invention, the siRNA molecules or inhibitors of the target gene are used as drugs to treat various pathologies.

"Nucleotide" is meant to encompass deoxyribonucleotides and ribonucleotides, which may be natural or synthetic, and be modified or unmodified. Modifications include changes and substitutions to the sugar moiety, the base moiety and/or the internucleotide linkages.

All analogs of, or modifications to, a nucleotide/oligonucleotide may be employed with the present invention, provided that said analog or modification does not substantially adversely affect the function of the nucleotide/oligonucleotide. Acceptable modifications include modifications of the sugar moiety, modifications of the base moiety, modifications in the internucleotide linkages and combinations thereof.

What is sometimes referred to in the present invention as an "abasic nucleotide" or "abasic nucleotide analog" is more properly referred to as a pseudo-nucleotide or an unconventional moiety. A nucleotide is a monomeric unit of nucleic acid, consisting of a ribose or deoxyribose sugar, a phosphate, and a base (adenine, guanine, thymine, or cytosine in DNA; adenine, guanine, uracil, or cytosine in RNA). A modified nucleotide comprises a modification in one or more of the sugar, phosphate and or base. The abasic pseudo-nucleotide lacks a base, and thus is not strictly a nucleotide.

The term "capping moiety" as used herein includes abasic ribose moiety, abasic deoxyribose moiety, modifications abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl) nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Figure 22:
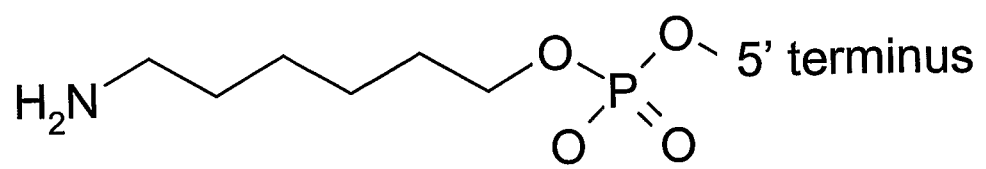
FIG. 22 provides an image of the chemical structure of the C6-amino-phosphate (C6-amino-Pi) moiety useful as a 5' cap structure in the present invention.

Certain preferred capping moieties are abasic ribose or abasic deoxyribose moieties; inverted abasic ribose or abasic deoxyribose moieties; C6-amino-Pi; a mirror nucleotide including L-DNA and L-RNA. FIG. 22 shows the chemical structure of a C6-amino phosphate 5' capping moiety and its attachment point to the 5' terminal (N').

The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide joined to an adjacent nucleotide by a 2'-5' internucleotide phosphate bond; bridged nucleic acids including LNA and ethylene bridged nucleic acids.

Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moiety includes inverted deoxyriboabasic; 3',5' inverted deoxyabasic 5'-phosphate.

Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

Modified deoxyribonucleotide includes, for example 5'OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate.

Bridged nucleic acids include LNA (2'-O,4'-C-methylene bridged Nucleic Acid adenosine 3' monophosphate, 2'-O,4'-C-methylene bridged Nucleic Acid 5-methyl-cytidine 3' monophosphate, 2'-O,4'-C-methylene bridged Nucleic Acid guanosine 3' monophosphate, 5-methyl-uridine (or thymidine) 3' monophosphate); and ENA (2'-O,4'-C-ethylene bridged Nucleic Acid adenosine 3' monophosphate, 2'-O,4'-C-ethylene bridged Nucleic Acid 5-methyl-cytidine 3' monophosphate, 2'-O,4'-C-ethylene bridged Nucleic Acid guanosine 3' monophosphate, 5-methyl-uridine (or thymidine) 3' monophosphate).

In some embodiments of the present invention a preferred unconventional moiety is an abasic ribose moiety, an abasic deoxyribose moiety, a deoxyribonucleotide, a mirror nucleotide, and a nucleotide joined to an adjacent nucleotide by a 2'-5' internucleotide phosphate bond.

The nucleotides are selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. Abasic pseudo-nucleotides are encompassed by the present invention, as well as molecules comprising alternating RNA and DNA nucleotides. A nucleotide monomer comprising a modified base, including abasic pseudo-nucleotide monomers, may be substituted for one or more ribonucleotides of the oligonucleotide. An abasic pseudo-nucleotide monomer may be included at the one or more of the terminal positions or as a 5' terminal cap. A 5' terminal cap may also be selected from an inverted abasic pseudo-nucleotide analog, an L-DNA nucleotide, and a C6-imine phosphate.

In addition, analogues of polynucleotides are prepared wherein the structure of one or more nucleotide is fundamentally altered and better suited as therapeutic or experimental reagents. An example of a nucleotide analog is a peptide nucleic acid (PNA) wherein the deoxyribose (or ribose) phosphate backbone in DNA (or RNA comprises with a polyamide backbone which is similar to that found in peptides. PNA analogs have been shown to be resistant to enzymatic degradation and to have extended lives in vivo and in vitro.

Possible modifications to the sugar residue are manifold and include 2'-O alkyl, locked nucleic acid (LNA), glycol nucleic acid (GNA), threose nucleic acid (TNA), arabinoside; altritol (ANA) and other 6-membered sugars including morpholinos, and cyclohexinyls.

LNA compounds are disclosed in International Patent Publication Nos. WO 00/47599, WO 99/14226, and WO 98/39352. Examples of siRNA compounds comprising LNA nucleotides are disclosed in Elmen et al., (NAR 2005. 33(1): 439-447) and in International Patent Publication No. WO 2004/083430. Six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides comprising 6-membered ring nucleotide analogs including hexitol and altritol nucleotide monomers are disclosed in International patent application publication No. WO 2006/047842.

The compounds of the present invention are synthesized using one or more inverted nucleotides, for example inverted thymidine or inverted adenine (for example see Takei, et al., 2002. JBC 277(26):23800-06.

In the context of the present invention, a "mirror" nucleotide (also referred to as a spiegelmer), is a nucleotide analog with reverse chirality to the naturally occurring or commonly employed nucleotide, i.e., a mirror image of the naturally occurring or commonly employed nucleotide. The mirror nucleotide is a ribonucleotide (L-RNA) or a deoxyribonucleotide (L-DNA) and may further comprise at least one sugar or base modification and/or a backbone modification, such as a phosphorothioate or phosphonate moiety. U.S. Pat. No. 6,602,858 discloses nucleic acid catalysts comprising at least one L-nucleotide substitution.

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, phosphonoacetate derivatives. Certain structures include siRNA compounds having one or a plurality of 2'-5' internucleotide linkages (bridges or backbone).

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

Oligonucleotides

Tables B (B1-B74), Tables C (C1-C4) and Tables D (D1-D34) comprise nucleic acid sequences of sense and corresponding antisense oligomers, useful in preparing siRNA compounds. The compounds are used as chemically and or structurally modified compounds.

The selection and synthesis of siRNA corresponding to known genes has been widely reported; see for example Ui-Tei et al., J Biomed Biotechnol. 2006; 65052; Chalk et al., BBRC. 2004, 319(1):264-74; Sioud & Leirdal, Met. Mol. Biol. 2004, 252:457-69; Levenkova et al., Bioinform. 2004, 20(3):430-2; Ui-Tei et al., NAR. 2004, 32(3):936-48. For examples of the use and production of modified siRNA see for example Braasch et al., Biochem. 2003, 42(26):7967-75; Chiu et al., RNA. 2003, 9(9):1034-48; PCT Publication Nos. WO 2004/015107 and WO 02/44321 and U.S. Pat. Nos. 5,898,031 and 6,107,094.

The present invention provides double-stranded oligonucleotides (e.g. siRNAs), which down-regulate the expression of a desired gene. An siRNA of the invention is a duplex oligoribonucleotide in which the sense strand is derived from the mRNA sequence of the desired gene, and the antisense strand is at least substantially complementary to the sense strand. In general, some deviation from the target mRNA sequence is tolerated without compromising the siRNA activity (see e.g. Czauderna et al., NAR. 2003, 31(11):2705-2716). An siRNA of the invention inhibits gene expression on a post-transcriptional level with or without destroying the mRNA. Without being bound by theory, siRNA may target the mRNA for specific cleavage and degradation and/or may inhibit translation from the targeted message.

In some embodiments an oligonucleotide pair selected from Tables D (D1-D34) comprises modified siRNA, having one or more of any of the modifications disclosed herein. In various embodiments the siRNA comprises an RNA duplex comprising a first strand and a second strand, whereby the first strand comprises a ribonucleotide sequence at least partially complementary to about 18 to about 40 consecutive nucleotides of a target nucleic acid which is mRNA transcribed from a target gene, and the second strand comprises a ribonucleotide sequence at least partially complementary to the first strand and wherein said first strand and or said second strand comprises a plurality of groups of modified ribonucleotides, optionally having a modification at the 2'-position of the sugar moiety whereby within each strand each group of modified ribonucleotides is flanked on one or both sides by a group of flanking nucleotides, optionally ribonucleotides, whereby each ribonucleotide forming the group of flanking ribonucleotides is selected from an unmodified ribonucleotide or a ribonucleotide having a modification different from the modification of the groups of modified ribonucleotides.

In some embodiments the group of modified ribonucleotides and/or the group of flanking nucleotides comprises a number of ribonucleotides selected from the group consisting of an integer from 1 to 12. Accordingly, the group thus comprises one nucleotide, two nucleotides, three nucleotides, four nucleotides, five nucleotides, six nucleotides, seven nucleotides, eight nucleotides, nine nucleotides, ten nucleotides, eleven nucleotides or twelve nucleotides.

The groups of modified nucleotides and flanking nucleotides may be organized in a pattern on one or both of the strands. In some embodiments the antisense and sense strands comprise alternating unmodified and 2' sugar modified ribonucleotides. In some preferred embodiments the middle ribonucleotide in the antisense strand is an unmodified nucleotide. For example, in a 19-oligomer antisense strand, ribonucleotide at position 10 is unmodified; in a 21-oligomer antisense strand, the ribonucleotide at position 11 is unmodified; and in a 23-oligomer antisense strand, ribonucleotide at position 12 is unmodified. The modifications or pattern of modification, if any, of the siRNA must be planned to allow for this. In an even-numbered oligomer, e.g. a 22 mer, the middle nucleotide may be at position 11 or 12.

Possible modifications on the 2' moiety of the sugar residue include amino, fluoro, methoxy alkoxy, alkyl, amino, fluoro, chloro, bromo, CN, CF, imidazole, carboxylate, thioate, $C_1$ to $C_{10}$ lower alkyl, substituted lower alkyl, alkaryl or aralkyl, $OCF_3$, OCN, O-, S-, or N-alkyl; O-, S, or N-alkenyl; $SOCH_3$; $SO_2CH_3$; $ONO_2$; $NO_2$, $N_3$; heterozycloalkyl; heterozycloalkaryl; amino alkylamino; polyalkylamino or substituted silyl, as, among others, described in European patents EP 0 586 520 B1 or EP 0 618 925 B1. One or more deoxyribonucleotides are also tolerated in the compounds of the present invention. As used herein, in the description of any strategy for the design of molecules, RNAi or any embodiment of RNAi disclosed herein, the term "end modification" means a chemical entity added to the terminal 5' or 3' nucleotide of the sense and/or antisense strand. Examples for such end modifications include, but are not limited to, 3' or 5' phosphate, inverted abasic, abasic, amino, fluoro, chloro, bromo, CN, $CF_3$, methoxy, imidazolyl, carboxylate, phosphothioate, $C_1$ to $C_{22}$ and lower alkyl, lipids, sugars and polyaminoacids (i.e. peptides), substituted lower alkyl, alkaryl or aralkyl, $OCF_3$, OCN, O-, S-, or N-alkyl; O-, S-, or N-alkenyl; $SOCH_3$; $SO_2CH_3$; $ONO_2$; $NO_2$, $N_3$; heterocycloalkyl; heterocycloalkaryl; aminoalkylamino; polyalkylamino or substituted silyl, as, among others, described in European patents EP 0 586 520 B1 or EP 0 618 925 B1.

In some embodiments the siRNA is blunt ended, i.e. Z and Z' are absent, on one or both ends. More specifically, the siRNA may be blunt ended on the end defined by the 5'-terminus of the first strand and the 3'-terminus of the second strand, and/or the end defined by the 3'-terminus of the first strand and the 5'-terminus of the second strand.

In other embodiments at least one of the two strands may have an overhang of at least one nucleotide at the 5'-terminus; the overhang may consist of at least one deoxyribonucleotide. At least one of the strands may also optionally have an overhang of at least one nucleotide at the 3'-terminus. The overhang may consist of from about 1 to about 5 nucleotides.

The length of RNA duplex is from about 18 to about 40 ribonucleotides, preferably 19, 21 or 23 ribonucleotides. Further, the length of each strand may independently have a length selected from the group consisting of about 15 to about 40 bases, preferably 18 to 23 bases and more preferably 19, 21 or 23 ribonucleotides.

In certain embodiments the complementarity between said first strand and the target nucleic acid may be perfect. In some embodiments, the strands are substantially complementary, i.e. having one, two or up to five mismatches between said first strand and the target mRNA or between the first and the second strands. Substantially complementary refers to complementarity of greater than about 70%, and less than 100% to another sequence. For example in a duplex region consisting of 19 base pairs one mismatch results in 94.7% complementarity, two mismatches results in about 89.5% complementarity, 3 mismatches results in about 84.2% complementarity, 4 mismatches results in about 79% complementarity and 5 mismatches results in about 74% complementarity, rendering the duplex region substantially complementary. Accordingly, substantially identical refers to identity of greater than about 70%, to another sequence.

The first strand and the second strand may be linked by a loop structure, which may be comprised of a non-nucleic acid polymer such as, inter alia, polyethylene glycol. Alternatively, the loop structure may be comprised of a nucleic acid, including modified and non-modified ribonucleotides and modified and non-modified deoxyribonucleotides.

Further, the 5'-terminus of the first strand of the siRNA may be linked to the 3'-terminus of the second strand, or the 3'-terminus of the first strand may be linked to the 5'-terminus of the second strand, said linkage being via a nucleic acid linker typically having a length between 2-100 nucleobases, preferably about 2 to about 30 nucleobases.

In preferred embodiments of the compounds of the invention having alternating ribonucleotides modified in at least one of the antisense and the sense strands of the compound, for 19 mer and 23 mer oligomers the ribonucleotides at the 5' and 3' termini of the antisense strand are modified in their sugar residues, and the ribonucleotides at the 5' and 3' termini of the sense strand are unmodified in their sugar residues. For 21 mer oligomers the ribonucleotides at the 5' and 3' termini of the sense strand are modified in their sugar residues, and the ribonucleotides at the 5' and 3' termini of the antisense strand are unmodified in their sugar residues, or may have an optional additional modification at the 3' terminus. As mentioned above, it is preferred that the middle nucleotide of the antisense strand is unmodified.

According to one preferred embodiment of the invention, the antisense and the sense strands of the oligonucleotide/siRNA are phosphorylated only at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

Any siRNA sequence disclosed herein are prepared having any of the modifications/structures disclosed herein. The combination of sequence plus structure is novel and is useful used in the treatment of the conditions disclosed herein.

Pharmaceutical Compositions

While it may be possible for the compounds of the present invention to be administered as the raw chemical, it is preferable to present them as a pharmaceutical composition. Accordingly the present invention provides a pharmaceutical composition comprising one or more of the compounds of the invention; and a pharmaceutically acceptable carrier. This composition may comprise a mixture of two or more different oligonucleotides/siRNAs.

The invention further provides a pharmaceutical composition comprising at least one compound of the invention covalently or non-covalently bound to one or more compounds of the invention in an amount effective to inhibit one or more genes as disclosed above; and a pharmaceutically acceptable carrier. The compound may be processed intracellularly by endogenous cellular complexes to produce one or more oligoribonucleotides of the invention.

The invention further provides a pharmaceutical composition comprising a pharmaceutically acceptable carrier and one or more of the compounds of the invention in an amount effective to down-regulate expression in a cell of a target gene, the compound comprising a sequence substantially complementary to the sequence of $(N)_x$. In certain embodiments, the target gene is a viral, bacterial or mammalian gene. In various embodiments the target gene is a mammalian gene, preferably a human gene.

Additionally, the invention provides a method of inhibiting the expression of a target gene, by at least 50% as compared to a control, comprising contacting an mRNA transcript of the target gene with one or more of the compounds of the invention. In some embodiments an active siRNA compound inhibits gene expression at a level of at least 50%, 60% or 70% as compared to control. In certain preferred embodiments inhibition is at a level of at least 75%, 80% or 90% as compared to control. In some embodiments the target gene is a pro-apoptotic gene as disclosed herein.

In one embodiment the oligoribonucleotide is inhibiting one or more of the pro-apoptotic genes of the present invention, whereby the inhibition is selected from the group comprising inhibition of gene function, inhibition of polypeptide and inhibition of mRNA expression.

In one embodiment the compound inhibits expression of a polypeptide encoded by a target gene whereby the inhibition is selected from the group comprising inhibition of function (which may be examined by an enzymatic assay or a binding assay with a known interactor of the native gene/polypeptide, inter alia), inhibition of protein (which may be examined by Western blotting, ELISA or immuno-precipitation, inter alia) and inhibition of mRNA expression (which may be examined by Northern blotting, quantitative RT-PCR, in-situ hybridisation or microarray hybridisation, inter alia).

In additional embodiments the invention provides a method of treating a subject suffering from a disease accompanied by an elevated level of the pro-apoptotic genes of the present invention, the method comprising administering to the subject a compound of the invention in a therapeutically effective dose thereby treating the subject.

More particularly, the invention provides an oligoribonucleotide wherein one strand comprises consecutive nucleotides having, from 5' to 3', the sequence set forth in Table B or a homolog thereof wherein in up to two of the ribonucleotides do not base pair with the ribonucleotide in the complementary strand Additionally, further nucleic acids according to the present invention comprise at least 14 contiguous nucleotides of any one of the polynucleotides oligomers set forth in Table B (Tables B1-B74) and more preferably 14 contiguous nucleotide base pairs at any end of the double-stranded structure comprised of the first strand and second strand as described above.

Delivery

The siRNA molecules of the present invention may be delivered to the target tissue by direct application of the naked molecules prepared with a carrier or a diluent.

The term "naked siRNA" refers to siRNA molecules that are free from any delivery vehicle that acts to assist, promote or facilitate entry into the cell, including viral sequences, viral particles, liposome formulations, lipofectin or precipitating agents and the like. For example, siRNA in PBS is "naked siRNA".

However, in some embodiments the siRNA molecules of the invention are delivered in liposome or lipofectin formulations and the like and are prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003. 327: 761-766; Lewis et al., Nat. Gen. 2002, 32: 107-108 and Simeoni et al., NAR 2003, 31, 11: 2717-2724). siRNA has recently been successfully used for inhibition of gene expression in primates (see for example, Tolentino et al., Retina 24(4):660.

The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art. In one specific embodiment of this invention topical and transdermal formulations may be selected. The siRNAs or pharmaceutical compositions of the present invention are administered and dosed in accordance with good medical practice, taking into account the clinical condition of the individual patient, the disease to be treated, the site and method of administration, scheduling of administration, patient age, sex, body weight and other factors known to medical practitioners.

The "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art.

In general, the active dose of compound for humans is in the range of from 1 mg/kg to about 20-100 mg/kg body weight per day, preferably about 0.01 mg to about 2-10 mg/kg body weight per day, in a regimen of one dose per day or twice or three or more times per day for a period of 1-4 weeks or longer.

The compounds of the present invention are administered by any of the conventional routes of administration. It should be noted that the compound is administered as the compound, per se, or as pharmaceutically acceptable salt and is administered alone or as an active ingredient in combination with pharmaceutically acceptable carriers, solvents, diluents, excipients, adjuvants and vehicles. The compounds are administered orally, topically, subcutaneously or parenterally including intravenous, intraarterial, intramuscular, intraperitoneally, and intranasal, inhalation, transtympanic administration as well as intrathecal and infusion techniques. Implants of the compounds are also useful. Liquid forms may be prepared for injection, the term including subcutaneous, transdermal, intravenous, intramuscular, intrathecal, and other parental routes of administration. The liquid compositions include aqueous solutions, with and without organic co-solvents, aqueous or oil suspensions, emulsions with edible oils, as well as similar pharmaceutical vehicles. In a particular embodiment, the administration comprises intravenous administration. In another embodiment the administration comprises topical or local administration.

In addition, in certain embodiments the compositions for use in the novel treatments of the present invention may be formed as aerosols, for example for intranasal administration.

In certain embodiments, oral compositions (such as tablets, suspensions, solutions) may be effective for local delivery to the oral cavity such as oral composition suitable for mouthwash for the treatment of oral mucositis.

In preferred embodiments the subject being treated is a warm-blooded animal and, in particular, mammals including human.

In an additional embodiment, the modification is a modification of the phosphate moiety, whereby the modified phosphate moiety is selected from the group comprising phosphorothioate or lack of a phosphate group.

The molecules of the present invention may comprise siRNAs, synthetic siRNAs, synthetic shRNAs, in addition to other nucleic acid sequences or molecules which encode such molecules or other inhibitory nucleotide molecules.

A further end modification is a biotin group. Such biotin group may preferably be attached to either the most 5' or the most 3' nucleotide of the first and/or second strand or to both ends. In a more preferred embodiment the biotin group is coupled to a polypeptide or a protein. It is also within the scope of the present invention that the polypeptide or protein is attached through any of the other aforementioned end modifications.

The various end modifications as disclosed herein are preferably located at the ribose moiety of a nucleotide of the nucleic acid according to the present invention. More particularly, the end modification may be attached to or replace any of the OH-groups of the ribose moiety, including but not limited to the 2'OH, 3'OH and 5'OH position, provided that the nucleotide thus modified is a terminal nucleotide. Inverted abasic or abasic are nucleotides, either deoxyribonucleotides or ribonucleotides which do not have a nucleobase moiety. This kind of compound is, inter alia, described in Sternberger, M., et al., (2002). Antisense Nucleic Acid Drug Dev, 12, 131-43. siNA compounds are described in international patent application WO 03/070918.

It is to be understood that, in the context of the present invention, any of the siRNA molecules disclosed herein, or any long double-stranded RNA molecules (typically 25-500 nucleotides in length) which are processed by endogenous cellular complexes (such as DICER—see above) to form the siRNA molecules disclosed herein, or molecules which comprise the siRNA molecules disclosed herein, are incorporated into the molecules of the present invention to form additional novel molecules, and are employed in the treatment of the diseases or disorders described herein.

In particular, it is envisaged that a long oligonucleotide (typically about 80-500 nucleotides in length) comprising one or more stem and loop structures, where stem regions comprise the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide is termed a tandem shRNA construct. It is envisaged that this long oligonucleotide is a single stranded oligonucleotide comprising one or more stem and loop structures, wherein each stem region comprises a sense and corresponding antisense siRNA sequence. Any molecules, such as, for example, antisense DNA molecules which comprise the inhibitory sequences disclosed herein (with the appropriate nucleic acid modifications) are particularly desirable and may be used in the same capacity as their corresponding RNAs/siRNAs for all uses and methods disclosed herein.

In addition, analogs of polynucleotides can be prepared wherein the structure of the nucleotide is fundamentally altered and that are better suited as therapeutic or experimental reagents. An example of a nucleotide analog is a peptide nucleic acid (PNA) wherein the deoxyribose (or ribose) phosphate backbone in DNA (or RNA comprises a polyamide backbone which is similar to that found in peptides. PNA analogs have been shown to be resistant to degradation by enzymes and to have extended, lives in vivo and in vitro. Further, PNAs have been shown to bind stronger to a complementary DNA sequence than a DNA molecule. This observation is attributed to the lack of charge repulsion between the PNA strand and the DNA strand. Other modified monomers useful in synthesizing the oligonucleotides include moieties having polymer backbones, cyclic backbones, or acyclic backbones.

Methods of Treatment

In another aspect, the present invention relates to a method for the treatment of a subject in need of treatment for a disease or disorder associated with the abnormal expression of a target gene the proapoptotic genes of Table A, comprising administering to the subject an amount of an inhibitor which reduces or inhibits expression of these genes.

In preferred embodiments the subject being treated is a warm-blooded animal and, in particular, mammals including human.

The methods of the invention comprise administering to the subject one or more inhibitory compounds which down-regulate expression of the proapoptotic genes of Table A; and in particular siRNA in a therapeutically effective dose so as to thereby treat the subject.

The term "treatment" refers to both therapeutic treatment and prophylactic or preventative measures, wherein the object is to prevent or slow down (lessen) a disorder as listed herein. Those in need of treatment include those already experiencing the disease or condition, those prone to having the disease or condition, and those in which the disease or condition is to be prevented. The compounds of the invention are administered before, during or subsequent to the onset of the disease or condition or symptoms associated therewith. In cases where treatment is for the purpose of prevention, then the present invention relates to a method for delaying the onset of or averting the development of the disease or disorder.

The present invention relates to the use of compounds which down-regulate the expression of the pro-apoptotic genes of the invention particularly to novel small interfering RNAs (siRNAs), in the treatment of the following diseases or conditions in which inhibition of the expression of the pro-apoptotic genes is beneficial: hearing loss, acute renal failure (ARF), glaucoma, acute respiratory distress syndrome (ARDS) and other acute lung and respiratory injuries, ischemia-reperfusion injury following lung transplantation, organ transplantation including lung, liver, heart, bone marrow, pancreas, cornea and kidney transplantation which includes DGF; spinal cord injury, pressure sores, age-related macular degeneration (AMD), dry eye syndrome, ocular ischemic conditions including ION and AION; oral mucositis and chronic obstructive pulmonary disease (COPD). Other indications include chemical-induced nephrotoxicity and chemical-induced neurotoxicity, for example toxicity induced by cisplatin and cisplatin-like compounds, by aminoglycosides, by loop diuretics, and by hydroquinone and their analogs.

Methods, molecules and compositions which inhibit the pro-apoptotic genes of the invention are discussed herein at length, and any of said molecules and/or compositions may be beneficially employed in the treatment of a subject suffering from any of said conditions.

The present invention also provides for a process of preparing a pharmaceutical composition, which comprises:
  providing one or more compounds of the invention; and
  admixing said compound with a pharmaceutically acceptable carrier.

The present invention also provides for a process of preparing a pharmaceutical composition, which comprises admixing one or more compounds of the present invention with a pharmaceutically acceptable carrier.

In a preferred embodiment, the compound used in the preparation of a pharmaceutical composition is admixed with a carrier in a pharmaceutically effective dose. In a particular embodiment the compound of the present invention is conjugated to a steroid or to a lipid or to another suitable molecule e.g. to cholesterol.

Synthesis of Modified Compounds

The compounds of the present invention can be synthesized by any of the methods that are well known in the art for synthesis of ribonucleic (or deoxyribonucleic) oligonucleotides. Such synthesis is, among others, described in Beaucage and Iyer, Tetrahedron 1992; 48:2223-2311; Beaucage and Iyer, Tetrahedron 1993; 49: 6123-6194 and Caruthers, et. al., Methods Enzymol. 1987; 154: 287-313; the synthesis of thioates is, among others, described in Eckstein, Annu. Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et. al., in IRL Press 1989 edited by Oliver R. W. A.; Kap. 7: 183-208.

Other synthetic procedures are known in the art e.g. the procedures as described in Usman et al., J. Am. Chem. Soc., 1987, 109:7845; Scaringe et al., NAR, 1990, 18:5433; Wincott et al., NAR 1995, 23:2677-2684; and Wincott et al., Methods Mol. Bio., 1997, 74:59, and these procedures may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

The oligonucleotides of the present invention can be synthesized separately and joined together post-synthetically, for example, by ligation (Moore et al., Science 1992, 256:9923; International Patent Publication No. WO 93/23569; Shabarova et al., NAR 1991, 19:4247; Bellon et al., Nucleosides & Nucleotides, 1997, 16:951; Bellon et al., Bioconjugate Chem 1997, 8:204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The compounds of the invention can also be synthesized via tandem synthesis methodology, as described for example in US Patent Publication No. 2004/0019001 (McSwiggen), wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker is selected from a polynucleotide linker or a non-nucleotide linker.

The present invention further provides for a pharmaceutical composition comprising two or more siRNA molecules for the treatment of any of the diseases and conditions mentioned herein, whereby said two molecules may be physically mixed together in the pharmaceutical composition in amounts which generate equal or otherwise beneficial activity, or may be covalently or non-covalently bound, or joined together by a nucleic acid linker of a length ranging from 2-100, preferably 2-50 or 2-30 nucleotides. In one embodiment, the siRNA molecules are comprised of a double-stranded nucleic acid structure as described herein, wherein the two siRNA sequences are selected from Tables B (B1-B74), Tables C (C1-C4) and Tables D (D1-D34).

Thus, the siRNA molecules may be covalently or non-covalently bound or joined by a linker to form a tandem siRNA compound. Such tandem siRNA compounds comprising two siRNA sequences are typically about 38-150 nucleotides in length, more preferably 38 or 40-60 nucleotides in length, and longer accordingly if more than two siRNA sequences are included in the tandem molecule. A longer tandem compound comprised of two or more longer sequences which encode siRNA produced via internal cellular processing, e.g., long dsRNAs, is also envisaged, as is a tandem molecule encoding two or more shRNAs. Synthetic modified tandem molecule are also considered to be a part of the present invention. A tandem compound comprising two or more siRNAs sequences of the invention is envisaged.

siRNA molecules that target the pro-apoptotic genes of the invention may be the main active component in a pharmaceutical composition, or may be one active component of a pharmaceutical composition containing two or more siRNAs (or molecules which encode or endogenously produce two or more siRNAs, be it a mixture of molecules or one or more tandem molecules which encode two or more siRNAs), said pharmaceutical composition further being comprised of one or more additional siRNA molecule which targets one or more additional gene. Simultaneous inhibition of said additional gene(s) will likely have an additive or synergistic effect for treatment of the diseases disclosed herein.

Additionally, the pro-apoptotic siRNA disclosed herein or any nucleic acid molecule comprising or encoding such siRNA may optionally be linked or bound (covalently or non-covalently) to antibodies (including aptamer molecules) against cell surface internalizable molecules expressed on the target cells, in order to achieve enhanced targeting for treatment of the diseases disclosed herein. For example, anti-Fas antibody (preferably a neutralizing antibody) may be combined (covalently or non-covalently) with any pro-apoptotic siRNA.

The compounds of the present invention are delivered for example as double stranded compounds, as double stranded hairpin compounds or as tandem compounds. It is also envisaged that a long oligonucleotide (typically 25-500 nucleotides in length) comprising one or more stem and loop structures, where stem regions comprise the sequences of the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide is termed a tandem shRNA construct. It is envisaged that this long oligonucleotide is a single stranded oligonucleotide comprising one or more stem and loop structures, wherein each stem region comprises a sense and corresponding antisense siRNA sequence of the pro-apoptotic genes of the invention. In particular, it is envisaged that this oligonucleotide comprises sense and antisense siRNA sequences as depicted in Tables B-D (B1-B74; C1-C4, D1-D34) set forth in SEQ ID NOS:97-87,178.

RNA Interference

A number of PCT applications have recently been published that relate to the RNAi phenomenon. These include: PCT publication WO 00/44895; PCT publication WO 00/49035; PCT publication WO 00/63364; PCT publication WO 01/36641; PCT publication WO 01/36646; PCT publication WO 99/32619; PCT publication WO 00/44914; PCT publication WO 01/29058; and PCT publication WO 01/75164.

RNA interference (RNAi) is based on the ability of dsRNA species to enter a cytoplasmic protein complex, where it is then targeted to the complementary cellular RNA and specifically degrade it. The RNA interference response features an endonuclease complex containing an siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir et al., Genes Dev., 2001, 15(2): 188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., Nature, 2001, 409(6818): 363-6; Lee et al., Nature, 2003, 425(6956):415-9). The RISC protein complex recognizes these fragments and complementary mRNA. The whole process is culminated by endonuclease cleavage of target mRNA (McManus & Sharp, Nature Rev Genet, 2002, 3(10):737-47; Paddison & Hannon, Curr Opin Mol. Ther. 2003, 5(3):217-24). (For additional information on these terms and proposed mechanisms, see for example Bernstein et al., RNA 2001, 7(11):1509-21; Nishikura, Cell 2001, 107(4):415-8 and PCT publication WO 01/36646).

Several groups have described the development of DNA-based vectors capable of generating siRNA within cells. The method generally involves transcription of short hairpin RNAs that are efficiently processed to form siRNAs within cells (Paddison et al. PNAS USA 2002, 99:1443-1448; Paddison et al. Genes & Dev 2002, 16:948-958; Sui et al. PNAS USA 2002, 8:5515-5520; and Brummelkamp et al. Science 2002, 296:550-553). These reports describe methods of generating siRNAs capable of specifically targeting numerous endogenously and exogenously expressed genes.

The invention has been described in an illustrative manner, and it is to be understood that the terminology used is intended to be in the nature of words of description rather than of limitation.

Obviously, many modifications and variations of the present invention are possible in light of the above teachings. It is, therefore, to be understood that within the scope of the appended claims, the invention can be practiced otherwise than as specifically described.

The present invention is illustrated in detail below with reference to examples, but is not to be construed as being limited thereto.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

Standard molecular biology protocols known in the art not specifically described herein are generally followed essentially as in Sambrook et al., *Molecular cloning: A laboratory manual*, Cold Springs Harbor Laboratory, New-York (1989, 1992), and in Ausubel et al., *Current Protocols in Molecular Biology*, John Wiley and Sons, Baltimore, Md. (1988), and as in Ausubel et al., Current Protocols in Molecular Biology, John Wiley and Sons, Baltimore, Md. (1989) and as in Perbal, *A Practical Guide to Molecular Cloning*, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683, 202; 4,801,531; 5,192,659 and 5,272,057 and incorporated herein by reference. Polymerase chain reaction (PCR) was carried out generally as in PCR Protocols: A Guide To Methods And Applications, Academic Press, San Diego, Calif. (1990). In situ (In cell) PCR in combination with Flow Cytometry is useful for detection of cells containing specific DNA and mRNA sequences (Testoni et al., Blood 1996, 87:3822.) Methods of performing RT-PCR are also well known in the art.

Cell Culture

HeLa cells (American Type Culture Collection) were cultured as described in Czauderna, et al. (NAR, 2003. 31:670-82). Human keratinocytes were cultured at 37° C. in Dulbecco's modified Eagle medium (DMEM) containing 10% FCS. The mouse cell line, B16V (American Type Culture Collection), was cultured at 37° C. in Dulbecco's modified Eagle medium (DMEM) containing 10% FCS. Culture conditions were as described in (Methods Find Exp Clin Pharmacol. 1997 May; 19(4):231-9).

In each case, the cells were subject to the experiments as described herein at a density of about 50,000 cells per well and the double-stranded nucleic acid according to the present invention was added at 20 nM, whereby the double-stranded nucleic acid was complexed using 1 μg/ml of a proprietary lipid as described below.

Induction of Hypoxia-Like Conditions

The cells were treated with $CoCl_2$ for inducing a hypoxia-like condition as follows: siRNA transfections were carried out in 10-cm plates (30-50% confluency) as described by Czauderna et al., 2003; Kretschmer et al., 2003. Briefly, siRNA were transfected by adding a preformed 10× concentrated complex of GB and lipid in serum-free medium to cells in complete medium. The total transfection volume was 10 ml. The final lipid concentration was 1.0 μg/ml; the final siRNA concentration was 20 nM unless otherwise stated. Induction of the hypoxic responses was carried out by adding $CoCl_2$ (100 μM) directly to the tissue culture medium 24 h before lysis.

Preparation of Cell Extracts and Immuno Blotting

The preparation of cell extracts and immuno blot analysis were carried out essentially as described (Klippel et al. Mol Cell Biol, 1998. 18:5699-711; Klippel, A., et al., Mol Cell Biol, 1996. 16:4117-27).

Example 1

In Vitro Testing of siRNA Compounds

About 1.5-2×10$^5$ tested cells (HeLa cells and/or 293T cells for siRNA targeting human genes and NRK52 cells and/or NMUMG cells for siRNA targeting the rat/mouse gene) were seeded per well in 6 wells plate (70-80% confluent).

24 hour later, cells were transfected with siRNA compounds using the Lipofectamine™ 2000 reagent (Invitrogen) at final concentrations of 5 nM or 20 nM. The cells were incubated at 37° C. in a CO2 incubator for 72 h.

As positive control for transfection PTEN-Cy3 labeled siRNA compounds were used. An additional positive control used was a blunt-ended 19-mer siRNA, i.e. x=y=19 wherein Z and Z' are both absent. This siRNA was non-phosphorylated and had alternating ribonucleotides modified at the 2' position of the sugar residue in both the antisense and the sense strands, wherein the moiety at the 2' position is methoxy (2'-O-methyl) and wherein the ribonucleotides at the 5' and 3' termini of the antisense strand are modified in their sugar residues, and the ribonucleotides at the 5' and 3' termini of the sense strand are unmodified in their sugar residues.

As negative control for siRNA activity GFP siRNA compounds were used.

At 72 h after transfection cells were harvested and RNA was extracted from cells. Transfection efficiency was tested by fluorescent microscopy.

The percent of inhibition of gene expression using specific preferred siRNA structures was determined using qPCR analysis of a target gene in cells expressing the endogenous gene.

In general, the siRNAs having specific sequences that were selected for in vitro testing were specific for human and a second species such as rat or rabbit genes. Similar results are obtained using siRNAs having these RNA sequences and modified as described herein. Similar results of reduced expression of specific genes are obtained with other siRNA oligomers, the sequences of which are listed in Tables B (B1-B74), Tables C (C1-C4) and Tables D (D1-D34). The siRNA oligomers of Tables B are set forth in SEQ ID NOS: 97-68654 (disclosed in U.S. Ser. No. 11/978,089 and PCT Patent Application No. PCT/IL 2007/001278, which are hereby incorporated by reference in their entirety).

Tables C1, C2, C3 and C4 below disclose preferred siRNA sequences, all of which siRNAs were found active in the above assay (Tables C1, C3 and C4-19mer siRNA molecules; Table C2-23mer siRNA molecules). In general, the siRNAs having specific sequences that were selected for in vitro testing were specific for both human and the rat/rabbit genes. Similar results are obtained using siRNAs having these RNA sequences and modified as described herein. Similar results of reduced expression of specific genes are obtained with other siRNAs, the sequences of which are listed in Tables B (B1-B74), Tables C (C1-C4) and Tables D (D1-D34).

TABLE C1

Preferred 19-mer siRNA sequences.

| Target gene | Cell line* | siRNA tested | Sequence |
|---|---|---|---|
| TP53BP2 | 293T | TP53BP2_1<br>SEQ ID NOS: 97-98 | SS: GAGGGUGAAAUUCAACCCC<br>AS: GGGGUUGAAUUUCACCCUC |
| TP53BP2 | 293T | TP53BP2_2<br>SEQ ID NOS: 99-100 | SS: CACCCAGAGAACAUUUAUU<br>AS: AAUAAAUGUUCUCUGGGUG |
| TP53BP2 | 293T | TP53BP2_3<br>SEQ ID NOS: 101-102 | SS: GGGUGAAAUUCAACCCCCU<br>AS: AGGGGGUUGAAUUUCACCC |

TABLE C1-continued

Preferred 19-mer siRNA sequences.

| Target gene | Cell line* | siRNA tested | Sequence |
|---|---|---|---|
| TP53BP2 | 293T | TP53BP2_4<br>SEQ ID No. 103-104 | SS: AGGGUGAAAUUCAACCCCC<br>AS: GGGGGUUGAAUUUCACCCU |
| TP53BP2 | 293T | TP53BP2_5<br>SEQ ID NOS: 105-106 | SS: AGGGAGUGUUUGAAUAAGC<br>AS: GCUUAUUCAAACACUCCCU |
| TP53BP2 | 293T | TP53BP2_6<br>SEQ ID NOS: 107-108 | SS: ACCCAGAGAACAUUUAUUC<br>AS: GAAUAAAUGUUCUCUGGGU |
| TP53BP2 | 293T | TP53BP2_8<br>SEQ ID NOS: 109-110 | SS: CGCUGAGGGAGAAAGAGAA<br>AS: UUCUCUUUCUCCCUCAGCG |
| LRDD | PC-3 | LRDD_1<br>SEQ ID NOS: 111-112 | SS: CGCACCUGAAGAAUGUGAA<br>AS: UUCACAUUCUUCAGGUGCG |
| LRDD | PC-3 | LRDD_2<br>SEQ ID NOS: 113-114 | SS: GUCUUCUACUCGCACCUGA<br>AS: UCAGGUGCGAGUAGAAGAC |
| LRDD | PC-3 | LRDD_3<br>SEQ ID NOS: 115-116 | SS: GACUGUUCCUGACCUCAGA<br>AS: UCUGAGGUCAGGAACAGUC |
| LRDD | PC-3 | LRDD_5<br>SEQ ID NOS: 117-118 | SS: ACCUCAGAUUUGGACAGCU<br>AS: AGCUGUCCAAAUCUGAGGU |
| CYBA | MDA-MB-4 | CYBA_15<br>SEQ ID NOS: 119-120 | SS: UGGGGACAGAAGUACAUGA<br>AS: UCAUGUACUUCUGUCCCCA |
| CYBA | MDA-MB-4 | CYBA_16<br>SEQ ID NOS: 121-122 | SS: GGGCCCUUUACCAGGAAUU<br>AS: AAUUCCUGGUAAAGGGCCC |
| CYBA | MDA-MB-4 | CYBA_17<br>SEQ ID NOS: 123-124 | SS: CCCUUUACCAGGAAUUACU<br>AS: AGUAAUUCCUGGUAAAGGG |
| ATF3 | 293T | ATF3_2<br>SEQ ID NOS: 125-126 | SS: GAAGGAACAUUGCAGAGCU<br>AS: AGCUCUGCAAUGUUCCUUC |
| ATF3 | 293T | ATF3_3<br>SEQ ID NOS: 127-128 | SS: ACAGAUAAAGAAGGAACA<br>AS: UGUUCCUUCUUUUAUCUGU |
| ATF3 | 293T | ATF3_4<br>SEQ ID NOS: 129-130 | SS: AUCCUAGUAUUCCUAACCU<br>AS: AGGUUAGGAAUACUAGGAU |
| ATF3 | 293T | ATF3_5<br>SEQ ID NOS: 131-132 | SS: AUCCCAGUAUUCCUAGCCU<br>AS: AGGCUAGGAAUACUGGGAU |
| CASP2 | HeLa- | CASP2_1<br>SEQ ID NOS: 133-134 | SS: GCACUCCUGAAUUUUAUCA<br>AS: UGAUAAAAUUCAGGAGUGC |
| CASP2 | HeLa- | CASP2_2<br>SEQ ID NOS: 135-136 | SS: GCACAGGAAAUGCAAGAGA<br>AS: UCUCUUGCAUUUCCUGUGC |
| CASP2 | HeLa- | CASP2_3<br>SEQ ID NOS: 137-138 | SS: GGGCUUGUGAUAUGCACGU<br>AS: ACGUGCAUAUCACAAGCCC |
| CASP2 | HeLa- | CASP2_4<br>SEQ ID NOS: 139-140 | SS: GCCAGAAUGUGGAACUCCU<br>AS: AGGAGUUCCACAUUCUGGC |
| NOX3 | 293 | NOX_4<br>SEQ ID NOS: 141-142 | SS: UCCUGGAACUUCACAUGAA<br>AS: UUCAUGUGAAGUUCCAGGA |
| NOX3 | 293 | NOX_5<br>SEQ ID NOS: 143-144 | SS: GGUGUUCAUUUCUAUUACA<br>AS: UGUAAUAGAAAUGAACACC |
| NOX3 | 293 | NOX_6<br>SEQ ID NOS: 145-146 | SS: ACACACACCAUGUUUUCAU<br>AS: AUGAAAACAUGGUGUGUGU |
| NOX3 | 293 | NOX_7<br>SEQ ID NOS: 147-148 | SS: GGUACACACACCAUGUUUU<br>AS: AAAACAUGGUGUGUGUACC |
| NOX3 | 293 | NOX_8<br>SEQ ID NOS: 149-150 | SS: CACUUUCUGAGUUAUCAUA<br>AS: UAUGAUAACUCAGAAAGUG |
| NOX3 | 293 | NOX_9<br>SEQ ID NOS: 151-152 | SS: CUGAAAUCUAUAUGGUACA<br>AS: UGUACCAUAUAGAUUUCAG |

TABLE C1-continued

Preferred 19-mer siRNA sequences.

| Target gene | Cell line* | siRNA tested | Sequence |
|---|---|---|---|
| NOX3 | 293 | NOX_10<br>SEQ ID NOS:153-154 | SS:CUGGCGAUUUCAACAAGAA<br>AS:UUCUUGUUGAAAUCGCCAG |
| NOX3 | 293 | NOX_11<br>SEQ ID NOS: 155-156 | SS:UCUGGCGAUUUCAACAAGA<br>AS:UCUUGUUGAAAUCGCCAGA |
| HRK | MDA-MB-468 | HRK_1<br>SEQ ID NOS: 157-158 | SS:CCCCAAUGCUAUUUACAUA<br>AS:UAUGUAAAUAGCAUUGGGG |
| HRK | MDA-MB-468 | HRK_2<br>SEQ ID NOS: 159-160 | SS:AUGCUAUUUACAUACAGCU<br>AS:AGCUGUAUGUAAAUAGCAU |
| CIQBP | HeLa- | CIQBP_1<br>SEQ ID NOS: 161-162 | SS:CCCCAAUGCUAUUUACAUA<br>AS:UAUGUAAAUAGCAUUGGGG |
| CIQBP | HeLa- | CIQBP_2<br>SEQ ID NOS: 163-164 | SS:AUGCUAUUUACAUACAGCU<br>AS:AGCUGUAUGUAAAUAGCAU |
| CIQBP | HeLa- | CIQBP_3<br>SEQ ID NOS: 165-166 | SS:GAGCCUGAACUGACAUCAA<br>AS:UUGAUGUCAGUUCAGGCUC |
| BNIP3 | 293T | BNIP3_1<br>SEQ ID NOS: 167-168 | SS:GAGACAUGGAAAAAAUACU<br>AS:AGUAUUUUUUCCAUGUCUC |
| BNIP3 | 293T | BN1P3_2<br>SEQ ID NOS: 169-170 | SS:GACAUGGAAAAAAUACUGC<br>AS:GCAGUAUUUUUUCCAUGUC |
| BNIP3 | 293T | BNIP3_3<br>SEQ ID NOS: 171-172 | SS:ACCCUCAGCAUGAGGAACA<br>AS:UGUUCCUCAUGCUGAGGGU |
| BNIP3 | 293T | BNIP3_4<br>SEQ ID NOS: 173-174 | SS:GAAAAACUCAGAUUGGAUA<br>AS:UAUCCAAUCUGAGUUUUUC |
| BNIP3 | 293T | BNIP3_11<br>SEQ ID NOS: 175-176 | SS:CUGCAUUGGUGAAUUUAAU<br>AS:AUUAAAUUCACCAAUGCAG |
| BNIP3 | 293T | BNIP3_12<br>SEQ ID NOS: 177-178 | SS:CAGGUUGUCUACUAAAGAA<br>AS:UUCUUUAGUAGACAACCUG |
| BNIP3 | 293T | BNIP3_13<br>SEQ ID NOS: 179-180 | SS:GCCUUAUAUAUCACACUAU<br>AS:AUAGUGUGAUAUAUAAGGC |
| BNIP3 | 293T | BNIP3_15<br>SEQ ID NOS: 181-182 | SS:GGAAUUAAGUCUCCGAUUA<br>AS:UAAUCGGAGACUUAAUUCC |
| BNIP3 | 293T | BN1P3_22<br>SEQ ID NOS: 183-184 | SS:AGGUUGUCUACUAAAGAAA<br>AS:UUUCUUUAGUAGACAACCU |
| BNIP3 | 293T | BNIP3_23<br>SEQ ID NOS: 185-186 | SS:GAGAAAAACAGCUCACAGU<br>AS:ACUGUGAGCUGUUUUUCUC |
| BNIP3 | 293T | BNIP3_24<br>SEQ ID NOS: 187-188 | SS:CCAAGAUAGAGCUACAAAC<br>AS:GUUUGUAGCUCUAUCUUGG |
| BNIP3 | 293T | BN1P3_25<br>SEQ ID NOS: 189-190 | SS:CACUCUGCAUUGGUGAAUU<br>AS:AAUUCACCAAUGCAGAGUG |
| BNIP3 | 293T | BN1P3_26<br>SEQ ID NOS: 191-192 | SS:CCUUAAUUCAGCUGAAGUA<br>AS:UACUUCAGCUGAAUUAAGG |
| BNIP3 | 293T | BNIP3_27<br>SEQ ID NOS: 193-194 | SS:GUUCAACUUUUGUGUGCUU<br>AS:AAGCACACAAAAGUUGAAC |
| BNIP3 | 293T | BNIP3_28<br>SEQ ID NOS: 195-196 | SS:UCCUUUGUGUUCAACUUUU<br>AS:AAAAGUUGAACACAAAGGA |
| MAPK8 | 293T | MAPK8_1<br>SEQ ID NOS: 197-198 | SS:ACCACAGAAAUCCCUAGAA<br>AS:UUCUAGGGAUUUCUGUGGU |
| MAPK8 | 293T | MAPK8_2<br>SEQ ID NOS: 199-200 | SS:GCCGACCAUUUCAGAAUCA<br>AS:UGAUUCUGAAAUGGUCGGC |
| MAPK8 | 293T | MAPK8_3<br>SEQ ID NOS: 201-202 | SS:GGACUUACGUUGAAAACAG<br>AS:CUGUUUUCAACGUAAGUCC |

TABLE C1-continued

Preferred 19-mer siRNA sequences.

| Target gene | Cell line* | siRNA tested | Sequence |
|---|---|---|---|
| MAPK8 | 293T | MAPK8_4<br>SEQ ID NOS: 203-204 | SS:UGGAUGCAAAUCUUUGCCA<br>AS:UGGCAAAGAUUUGCAUCCA |
| MAPK14 | A431 | MAPK14_1<br>SEQ ID NOS: 205-2-6 | SS:GACCAUUUCAGUCCAUCAU<br>AS:AUGAUGGACUGAAAUGGUC |
| MAPK14 | A431 | MAPK14_2<br>SEQ ID NOS: 207-208 | SS:GAGGUCUAAAGUAUAUACA<br>AS:UGUAUAUACUUUAGACCUC |
| MAPK14 | A431 | MAPK14_3<br>SEQ ID NOS: 209-210 | SS:GUGCUGCUUUUGACACAAA<br>AS:UUUGUGUCAAAAGCAGCAC |
| RAC-1 | 293T | RAC1_1<br>SEQ ID NOS: 211-212 | SS:UUGGUGCUGUAAAAUACCU<br>AS:AGGUAUUUUACAGCACCAA |
| RAC-1 | 293T | RAC1_2<br>SEQ ID NOS: 213-214 | SS:GAGUCCUGCAUCAUUUGAA<br>AS:UUCAAAUGAUGCAGGACUC |
| RAC-1 | 293T | RAC1_3<br>SEQ ID NOS: 215-216 | SS:GAUGUGUUCUUAAUUUGCU<br>AS:AGCAAAUUAAGAACACAUC |
| BMP2 | Hela | BMP2_5<br>SEQ ID NOS: 217-218 | SS:GUCAAGCCAAACACAAACA<br>AS:UGUUUGUGUUUGGCUUGAC |
| SPP1 | HEPG2 | SPP1_1<br>SEQ ID NOS: 219-220 | SS:GUCCAGCAAUUAAUAAAAC<br>AS:GUUUUAUUAAUUGCUGGAC |
| SPP1 | HEPG2 | SPP1_2<br>SEQ ID NOS: 221-222 | SS:GUGCCAUACCAGUUAAACA<br>AS:UGUUUAACUGGUAUGGCAC |
| SPP1 | HEPG2 | SPP1_3<br>SEQ ID NOS: 223-224 | SS:GCAAAAUGAAAGAGAACAU<br>AS:AUGUUCUCUUUCAUUUUGC |
| SPP1 | HEPG2 | SPP1_5<br>SEQ ID NOS: 225-226 | SS:GCAUUUCUCAUGAAUUAGA<br>AS:UCUAAUUCAUGAGAAAUGC |
| SPP1 | HEPG2 | SPP1_6<br>SEQ ID NOS: 227-228 | SS:CCGCAUUUCUCAUGAAUUA<br>AS:UAAUUCAUGAGAAAUGCGG |
| RHOA | 293T-human | RHOA_1<br>SEQ ID NOS: 229-230 | SS:GUACCAGUUAAUUUUUCCA<br>AS:UGGAAAAAUUAACUGGUAC |
| RHOA | 293T-human | RHOA_2<br>SEQ ID NOS: 231-232 | SS:UAGAAAACAUCCCAGAAAA<br>AS:UUUUCUGGGAUGUUUUCUA |
| RHOA | 293T-human | RHOA_3<br>SEQ ID NOS: 233-234 | SS:ACCAGUUAAUUUUUCCAAC<br>AS:GUUGGAAAAAUUAACUGGU |
| RHOA | 293T-human | RHOA_4<br>SEQ ID NOS: 235-236 | SS:GCCACUUAAUGUAUGUUAC<br>AS:GUAACAUACAUUAAGUGGC |
| RHOA | 293T-human | RHOA_5<br>SEQ ID NOS: 237-238 | SS:GGGCAGUUUUUGAAAAUG<br>AS:CAUUUUCAAAAACUGCCC |
| RHOA | 293T-human | RHOA_6<br>SEQ ID NOS: 239-240 | SS:GGCUAAGUAAAUAGGAAUU<br>AS:AAUUCCUAUUUACUUAGCC |
| RHOA | 293T-human | RHOA_7<br>SEQ ID NOS: 241-242 | SS:CCUGUGGAAAGACAUGCUU<br>AS:AAGCAUGUCUUUCCACAGG |
| RHOA | 293T-human | RHOA_8<br>SEQ ID NOS: 243-244 | SS:GUGCUCUUUUCUCCCUCACU<br>AS:AGUGAGGGAGAAAAGAGCAC |
| RHOA | 293T-human | RHOA_9<br>SEQ ID NOS: 245-246 | SS:GGGCUAAGUAAAUAGGAAU<br>AS:AUUCCUAUUUACUUAGCCC |
| RHOA | 293T-human | RHOA_10<br>SEQ ID NOS: 247-248 | SS:GUGGGCAGUUUUUUGAAAA<br>AS:UUUUCAAAAAACUGCCCAC |
| RHOA | 293T-human | RHOA_11<br>SEQ ID NOS: 249-250 | SS:GGUGCCUUGUCUUGUGAAA<br>AS:UUUCACAAGACAAGGCACC |
| RHOA | 293T-human | RHOA_12<br>SEQ ID NOS: 251-252 | SS:CCCAAGUUCAUGCAGCUGU<br>AS:ACAGCUGCAUGAACUUGGG |

TABLE C1-continued

Preferred 19-mer siRNA sequences.

| Target gene | Cell line* | siRNA tested | Sequence |
|---|---|---|---|
| RHOA | 293T-human | RHOA_13<br>SEQ ID NOS: 253-254 | SS:GGCACUCAGUCUCUCUUCU<br>AS:AGAAGAGAGACUGAGUGCC |
| RHOA | 293T-human | RHOA_14<br>SEQ ID NOS: 255-256 | SS:CACUUUGGAAGAUGGCAUA<br>AS:UAUGCCAUCUUCCAAAGUG |
| Duox1 | exogenous expression | Duox1_1<br>SEQ ID NOS: 257-258 | SS:GAGAGAAGUUCCAACGCAG<br>AS:CUGCGUUGGAACUUCUCUC |
| Duox1 | exogenous expression | Duox1_2<br>SEQ ID NOS: 259-260 | SS:CGAGAGAAGUUCCAACGCA<br>AS:UGCGUUGGAACUUCUCUCG |
| Duox1 | exogenous expression | Duox1_3<br>SEQ ID NOS: 261-262 | SS:ACCGAGAGAAGUUCCAACG<br>AS:CGUUGGAACUUCUCUCGGU |
| Duox1 | exogenous expression | Duox1_4<br>SEQ ID NOS: 263-264 | SS:AGAUCCCAAGGAGUAUGA<br>AS:UCAUACUCCUUGGGGAUCU |
| Duox1 | exogenous expression | Duox1_6<br>SEQ ID NOS: 265-266 | SS:UUGCCUCCAUCCUCAAAGA<br>AS:UCUUUGAGGAUGGAGGCAA |

TABLE C2

Preferred 23-mer siRNA sequences.

| Target gene | Cell line | siRNA tested | Sequence |
|---|---|---|---|
| CASP2 | HeLa- | CASP2_1-1<br>SEQ ID No. 267-268 | SS:CCUUGCACUCCUGAAUUUUAUCA<br>AS:UGAUAAAAUUCAGGAGUGCAAGG |
| CASP2 | HeLa- | CASP2_1-2<br>SEQ ID No. 269-270 | SS:CUUGCACUCCUGAAUUUUAUCAA<br>AS:UUGAUAAAAUUCAGGAGUGCAAG |
| CASP2 | HeLa- | CASP2_1-3<br>SEQ ID No. 271-272 | SS:UUGCACUCCUGAAUUUUAUCAAA<br>AS:UUUGAUAAAAUUCAGGAGUGCAA |
| CASP2 | HeLa- | CASP2_1-4<br>SEQ ID No. 273-274 | SS:UGCACUCCUGAAUUUUAUCAAAC<br>AS:GUUUGAUAAAAUUCAGGAGUGCA |
| CASP2 | HeLa- | CASP2_1-5<br>SEQ ID No. 275-276 | SS:GCACUCCUGAAUUUUAUCAAACA<br>AS:UGUUUGAUAAAAUUCAGGAGUGC |

TABLE C3

Additional preferred 19-mer siRNA sequences.

| Target gene | Cell line* | siRNA tested | Sequence |
|---|---|---|---|
| P2RX7 | Nalm6 | P2RX7_6<br>SEQ ID NOS: 50971-50972 | SS:CCGAGAAACAGGCGAUAAU<br>AS:AUUAUCGCCUGUUUCUCGG |
| P2RX7 | Nalm6 | P2RX7_7<br>SEQ ID NOS: 50973-50974 | SS:CCAGACGCCAUUUAAAAGU<br>AS:ACUUUUAAAUGGCGUCUGG |
| P2RX7 | Nalm6 | P2RX7_8<br>SEQ ID NOS: 50975-50976 | SS:GUGGCUCUGAUUGCUUUAU<br>AS:AUAAAGCAAUCAGAGCCAC |
| P2RX7 | Nalm6 | P2RX7_9<br>SEQ ID NOS: 50977-50978 | SS:CCAAAGGGAAAUAUGCUUU<br>AS:AAAGCAUAUUUCCCUUUGG |
| P2RX7 | Nalm6 | P2RX7_10<br>SEQ ID NOS: 50979-50980 | SS:CACAACUACACCACGAGAA<br>AS:UUCUCGUGGUGUAGUUGUG |
| TRPM2 | Nalm6 | TRPM2_5<br>SEQ ID NOS: 50981-50982 | SS:GACAAUGCCUGGAUCGAGA<br>AS:UCUCGAUCCAGGCAUUGUC |

TABLE C3-continued

Additional preferred 19-mer siRNA sequences.

| Target gene | Cell line* | siRNA tested | Sequence |
|---|---|---|---|
| TRPM2 | Nalm6 | TRPM2_6<br>SEQ ID NOS: 50983-50984 | SS:CCAAGAACUUCAACAUGAA<br>AS:UUCAUGUUGAAGUUCUUGG |
| PARG | Nalm6 | PARG_2<br>SEQ ID NOS: 50985-50986 | SS:GACAGAGUCUUGAAGAUUU<br>AS:AAAUCUUCAAGACUCUGUC |
| PARG | Nalm6 | PARG_3<br>SEQ ID NOS: 50987-50988 | SS:GUGGCAUAUUCUAAGAAAU<br>AS:AUUUCUUAGAAUAUGCCAC |
| PARG | Nalm6 | PARG_5<br>SEQ ID NOS: 50989-50990 | SS:CCCAGACAUUAACUUCAAU<br>AS:AUUGAAGUUAAUGUCUGGG |
| CD38 | Nalm6 | CD38_5 | SS:GGGUGCAUUUAUUUCAAAA |

TABLE C4

Additional preferred 19-mer siRNA sequences.

| Target gene | siRNA | SEQ ID NOS: | SS (Sense strand 5'>3')<br>AS (antisense strand 5'>3') |
|---|---|---|---|
| HRK | HRK_7 | SEQ ID NOS: 87089-87090 | CGAUCGUAGAAACACAGAA<br>UUCUGUGUUUCUACGAUCG |
| HRK | HRK_8 | SEQ ID NOS: 87091-87092 | AGGCGGAACUUGUAGGAAC<br>GUUCCUACAAGUUCCGCCU |
| HRK | HRK_9 | SEQ ID NOS: 87093-87094 | CCUGGAGCGAUCGUAGAAA<br>UUUCUACGAUCGCUCCAGG |
| HRK | HRK_10 | SEQ ID NOS: 87095-87096 | CUGGAGCGAUCGUAGAAAC<br>GUUUCUACGAUCGCUCCAG |
| HRK | HRK_11 | SEQ ID NOS: 87097-87098 | CCUUGGAGAAAGCUGGUUC<br>GAACCAGCUUUCUCCAAGG |
| HRK | HRK_12 | SEQ ID NOS: 87099-87100 | UGGAAAUCCAGCUGCAGAA<br>UUCUGCAGCUGGAUUUCCA |
| RAC1 | RAC1_9 | SEQ ID NOS: 87101-87102 | GGGAUGAUAAAGACACGAU<br>AUCGUGUCUUUAUCAUCCC |
| RAC1 | RAC1_10 | SEQ ID NOS: 87103-87104 | GUCUUCUUGAUUUGCUUUU<br>AAAAGCAAAUCAAGAAGAC |
| RAC1 | RAC1_11 | SEQ ID NOS: 87105-87106 | CCAAUACUGACCCUCUUUA<br>UAAAGAGGGUCAGUAUUGG |
| RAC1 | RAC1_12 | SEQ ID NOS: 87107-87108 | CCUUCUAAAGCCUUAUUU<br>AAAUAAGGCUUUAGAAGG |
| RAC1 | RAC1_13 | SEQ ID NOS: 87109-18110 | GGAGAUUGGUGCUGUAAAA<br>UUUUACAGCACCAAUCUCC |
| RAC1 | RAC1_14 | SEQ ID NOS: 87111-87112 | GGGCAUUUAAUUCAUCUUU<br>AAAGAUGAAUUAAAUGCCC |
| RAC1 | RAC1_15 | SEQ ID NOS: 87113-87114 | CGAGUUUUCUGACCAGCUU<br>AAGCUGGUCAGAAAACUCG |
| RAC1 | RAC1_16 | SEQ ID NOS: 87115-87116 | GCAGAAUUGUGGAGUGUUU<br>AAACACUCCACAAUUCUGC |
| RAC1 | RAC1_17 | SEQ ID NOS: 87117-87118 | GGUGUAAAAUCAUGUGUUU<br>AACACAUGAUUUUUACACC |
| STEAP4 | STEAP4_3 | SEQ ID NOS: 87119-87120 | GUGAUUCCUAUUCGAUAUU<br>AAUAUCGAAUAGGAAUCAC |
| RHOA | RHOA_15 | SEQ ID NOS: 87121-87122 | GGCCUUUUUCAUUUAUCUA<br>UAGAUAAAUGAAAAAGGCC |

TABLE C4-continued

Additional preferred 19-mer siRNA sequences.

| Target gene | siRNA | SEQ ID NOS: | SS (Sense strand 5'>3') AS (antisense strand 5'>3') |
|---|---|---|---|
| RHOA | RHOA_16 | SEQ ID NOS: 87123-87124 | UGAGAGAGGUUUUUGAAAU<br>AUUUCAAAAACCUCUCUCA |
| RHOA | RHOA_17 | SEQ ID NOS: 87125-87126 | GGUGGGCAGUUUUUUGAAA<br>UUUCAAAAAACUGCCCACC |
| RHOA | RHOA_18 | SEQ ID NOS: 87127-87128 | CAGAAAAGCCCAAGUUCAU<br>AUGAACUUGGGCUUUUCUG |
| RHOA | RHOA_19 | SEQ ID NOS: 87129-87130 | CUAAUACUGUCAUCCUCAA<br>UUGAGGAUGACAGUAUUAG |
| RHOA | RHOA_20 | SEQ ID NOS: 87131-87132 | GCUAGACGUGGGAAGAAAA<br>UUUUCUUCCCACGUCUAGC |
| RHOA | RHOA_21 | SEQ ID NOS: 87133-87134 | CAACUACUAAUAGAAUAAA<br>UUUAUUCUAUUAGUAGUUG |
| RHOA | RHOA_22 | SEQ ID NOS: 87135-87136 | GUGUAUUGGUUUUUUAAAA<br>UUUUAAAAAACCAAUACAC |
| RHOA | RHOA_23 | SEQ ID NOS: 87137-87138 | CGGAAUGAUGAGCACACAA<br>UUGUGUGCUCAUCAUUCCG |
| RHOA | RHOA_24 | SEQ ID NOS: 87139-87140 | GAAGGAUCUUCGGAAUGAU<br>AUCAUUCCGAAGAUCCUUC |
| RHOA | RHOA_25 | SEQ ID NOS: 87141-87142 | CCAGCUGACUAAACUUUUU<br>AAAAAGUUUAGUCAGCUGG |
| RHOA | RHOA_26 | SEQ ID NOS: 87143-87144 | UCGGAAUGAUGAGCACACA<br>UGUGUGCUCAUCAUUCCGA |
| RHOA | RHOA_27 | SEQ ID NOS: 87145-87146 | AGUCAGAUGGAAAAUUCAU<br>AUGAAUUUUCCAUCUGACU |
| RHOA | RHOA_28 | SEQ ID NOS: 87147-87148 | GUCAGAUGGAAAAUUCAUU<br>AAUGAAUUUUCCAUCUGAC |
| RHOA | RHOA_29 | SEQ ID NOS: 87149-87150 | UCGACAGCCCUGAUAGUUU<br>AAACUAUCAGGGCUGUCGA |
| RHOA | RHOA_30 | SEQ ID NOS: 87151-87152 | GCUGUGGCAGAGUUACAGU<br>ACUGUAACUCUGCCACAGC |
| CASP2 | CASP2_16 | SEQ ID NOS: 87153-87154 | GGAUCAUGUAAAUGCUCAA<br>UUGAGCAUUUACAUGAUCC |
| CASP2 | CASP2_18 | SEQ ID NOS: 87155-87156 | CCCUUACUAUUCCCACUUU<br>AAAGUGGGAAUAGUAAGGG |
| CASP2 | CASP2_19 | SEQ ID NOS: 87157-87158 | CCUGACAAGUGAAGUUGUA<br>UACAACUUCACUUGUCAGG |
| CASP2 | CASP2_20 | SEQ ID NOS: 87159-17160 | CCUUAUUGAUCUUUGCCCA<br>UGGGCAAAGAUCAAUAAGG |
| CASP2 | CASP2_21 | SEQ ID NOS: 87161-87162 | CAGGAAUGUUUCAGCUGCA<br>UGCAGCUGAAACAUUCCUG |
| CASP2 | CASP2_22 | SEQ ID NOS: 98162-87164 | GACUGCACAGGAAAUGCAA<br>UUGCAUUUCCUGUGCAGUC |
| CASP2 | CASP2_23 | SEQ ID NOS: 87165-87166 | CUACAGAACAAACCAAAAA<br>UUUUUGGUUUGUUCUGUAG |
| CASP2 | CASP2_25 | SEQ ID NOS: 87167-87168 | GAAUGUGGAACUCCUCAAC<br>GUUGAGGAGUUCCACAUUC |
| CASP2 | CASP2_26 | SEQ ID NOS: 87169-87170 | UCUUCAAGCUUUUGGGCUA<br>UAGCCCAAAAGCUUGAAGA |
| CASP2 | CASP2_27 | SEQ ID NOS: 87171-87172 | GAACAAACCAAAAAUGUUC<br>GAACAUUUUUGGUUUGUUC |

TABLE C4-continued

Additional preferred 19-mer siRNA sequences.

| Target gene | siRNA | SEQ ID NOS: | SS (Sense strand 5'>3')<br>AS (antisense strand 5'>3') |
|---|---|---|---|
| CASP2 | CASP2_37 | SEQ ID NOS: 87173-87174 | CAGAAUGUGGAACUCCUCA<br>UGAGGAGUUCCACAUUCUG |
| CASP2 | CASP2_38 | SEQ ID NOS: 87175-87176 | CAGAACAAACCAAAAAUGU<br>ACAUUUUUGGUUUGUUCUG |
| CASP2 | CASP2_39 | SEQ ID NOS: 87177-87178 | CAGAAUUUUGCACAGUUAC<br>GUAACUGUGCAAAAUUCUG |

Examples of some of the activity and or stability of compounds comprising an antisense sequence and sense sequence according to tables C1-C4 and structural modifications are shown in FIG. 23.

Example 2

Model Systems of Acute Renal Failure (ARF)

ARF is a clinical syndrome characterized by rapid deterioration of renal function that occurs within days. Without being bound by theory the acute kidney injury may be the result of renal ischemia-reperfusion injury such as renal ischemia-reperfusion injury in patients undergoing major surgery such as major cardiac surgery. The principal feature of ARF is an abrupt decline in glomerular filtration rate (GFR), resulting in the retention of nitrogenous wastes (urea, creatinine). Recent studies, support that apoptosis in renal tissues is prominent in most human cases of ARF. The principal site of apoptotic cell death is the distal nephron. During the initial phase of ischemic injury, loss of integrity of the actin cytoskeleton leads to flattening of the epithelium, with loss of the brush border, loss of focal cell contacts, and subsequent disengagement of the cell from the underlying substratum.

Testing an active siRNA compound was performed using an animal model for ischemia-reperfusion-induced ARF. Protection Against Ischemia-Reperfusion Induced ARF Ischemia-reperfusion injury was induced in rats following 45 minutes bilateral kidney arterial clamp and subsequent release of the clamp to allow reperfusion. The rats were sacrificed seven days following the reperfusion. 12 mg/kg of Casp2_4 siRNA compound (Casp2_4: Sense sequence: GCCAGAAUGUGGAACUCCU, SEQ ID NO:139; Antisense sequence: AGGAGUUCCACAUUCUGGC, SEQ ID NO:140) were injected into the jugular vein 4 hours following the clamp. ARF progression was monitored by measurement of serum creatinine levels before (day 0) and 1 day, 3 days, 5 days and 7 days post surgery. At the end of the experiment, the rats were perfused via an indwelling femoral line with warm PBS followed by 4% paraformaldehyde. The left kidneys were surgically removed and stored in 4% paraformaldehyde for subsequent histological analysis. Acute renal failure is frequently defined as an acute increase of the serum creatinine level from baseline. An increase of at least 0.5 mg per dL or 44.2 μmol per L of serum creatinine is considered as an indication for acute renal failure. Serum creatinine was measured at time zero before the surgery and 1 day, 3 days, 5 days and 7 days post ARF surgery.

A particularly preferred compound for the treatment and prevention of ARF which was used in this experiment is a CASP2_4 siRNA compound according to an embodiment of structure (IV) wherein (N')y (sense strand) comprises L-DNA at position 18 (results presented in the table headed "Group 2" below) or wherein (N')y (sense strand) comprises L-DNA at positions 17 and 18 (results presented in the table headed "Group 3" below), and wherein (N)x (antisense strand) comprises alternating modified and unmodified ribonucleotides wherein the modified ribonucleotides comprise a 2' OMe modification. The results using placebo is presented in the table headed "Group 1" below. The siRNA compound may further comprise a DNA nucleotide at position 15 and or an L-DNA nucleotide at position 2 in (N')y. As revealed from the results below, the Casp2_4 siRNA compound administered 4 hours following the clamp reduced the elevation in creatinine levels 1 and 3 days following the ischemia-reperfusion injury. Administration of the siRNA compound prior to the clamp is found to be protective as well against ischemia reperfusion.

Group 1: Creatinine levels (mg per dL) in serum in animals injected with placebo 4 hours post clamp.

| Animal No. | Body Weight before experiment (g) | Day 0 | Day 1 | Day 3 | Day 5 | Day 7 | Body Weight post experiment (g) |
|---|---|---|---|---|---|---|---|
| 1 | 286 | 0.2 | 3.8 | 1.9 | 0.9 | 0.1 | 265 |
| 2 | 294 | 0.3 | 4.9 | 2.4 | 0.7 | 0.4 | 271 |
| 3 | 281 | 0.3 | 3.9 | 2.0 | 0.6 | 0.5 | 252 |
| 4 | 273 | 0.1 | 4.5 | 1.8 | 0.7 | 0.5 | 255 |
| 5 | 264 | 0.1 | 4.0 | 1.9 | 0.6 | 0.2 | 247 |
| 6 | 287 | 0.2 | 4.0 | 2.0 | 1.0 | 0.5 | 269 |
| Mean | 281 | 0.2 | 4.2 | 2.0 | 0.7 | 0.4 | 260 |

Group 2: Creatinine levels in serum in animals treated with CASP2_4 siRNA (L-DNA at position 18 of the sense strand, 12 mg/kg) injected 4 hours post clamp.

| Animal No. | Body Weight before experiment (g) | Day 0 | Day 1 | Day 3 | Day 5 | Day 7 | Body Weight post experiment (g) |
|---|---|---|---|---|---|---|---|
| 1 | 290 | 0.2 | 1.9 | 1.1 | 0.8 | 0.7 | 276 |
| 2 | 303 | 0.1 | 3.4 | 1.4 | 0.9 | 0.8 | 282 |
| 3 | 298 | 0.3 | 4.0 | 1.6 | 0.9 | 0.8 | 238 |
| 4 | 310 | 0.3 | 2.0 | 1.2 | 0.5 | 0.4 | 296 |
| 5 | 288 | 0.1 | 1.8 | 1.1 | 0.7 | 0.8 | 269 |
| 6 | 293 | 0.3 | 1.9 | 1.0 | 0.7 | 0.8 | 261 |
| Mean | 297 | 0.2 | 2.5 | 1.2 | 0.8 | 0.7 | 270 |

Group 3: Creatinine levels in serum in animals treated with CASP2_4 siRNA (L-DNA at positions 17 and 18 of the sense strand, 12 mg/kg) injected 4 hours post clamp.

| Animal No. | Body Weight before experiment (g) | Day 0 | Day 1 | Day 3 | Day 5 | Day 7 | Body Weight post experiment (g) |
|---|---|---|---|---|---|---|---|
| 1 | 311 | 0.3 | 2.9 | 1.1 | 0.8 | 0.6 | 288 |
| 2 | 304 | 0.2 | 2.0 | 0.9 | 0.4 | 0.4 | 271 |
| 3 | 303 | 0.4 | 3.5 | 2.1 | 1.0 | 0.6 | 282 |
| 4 | 301 | 0.4 | 3.6 | 1.7 | 1.1 | 0.6 | 280 |
| 5 | 296 | 0.3 | 3.1 | 1.5 | 1.2 | 0.5 | 276 |
| 6 | 294 | 0.4 | 2.5 | 1.3 | 1.0 | 0.5 | 284 |
| Mean | 281 | 0.3 | 2.9 | 1.4 | 0.9 | 0.5 | 280 | siRNA compounds from Tables B (B1-B74), Tables C (C1-C4) and Tables D (D1-D34) in particular siRNAs directed to specific proapoptotic genes of Table A, in particular to genes TP53BP2, LRDD, CYBA, ATF3, CASP2, HRK, CIQBP, BNIP3, MAPK8, MAPK14, RAC1, GSK3B, P2RX7, TRPM2, PARG, CD38, STEAP4, BMP2, CX43, TYROBP, CTGF, and SPP1) are tested in the above model system and found to be protective against ischemia reperfusion.

Example 3

Model Systems of Pressure Sores or Pressure Ulcers

Pressure sores or pressure ulcers including diabetic ulcers, are areas of damaged skin and tissue that develop when sustained pressure (usually from a bed or wheelchair) cuts off circulation to vulnerable parts of the body, especially the skin on the buttocks, hips and heels. The lack of adequate blood flow leads to ischemic necrosis and ulceration of the affected tissue. Pressure sores occur most often in patients with diminished or absent sensation or who are debilitated, emaciated, paralyzed, or long bedridden. Tissues over the sacrum, ischia, greater trochanters, external malleoli, and heels are especially susceptible; other sites may be involved depending on the patient's situation.

Testing the active inhibitors of the invention (such as siRNA compounds) for treating pressure sore, ulcers and similar wounds is performed in the mouse model as described in Reid et al., J. Surg. Res. 116:172-180, 2004.

An additional rabbit model is described by Mustoe et al, JCI, 1991. 87(2):694-703; Aim and Mustoe, Ann P1 Surg, 1991. 24(1):17-23, and is used for testing the siRNA compounds of the invention. siRNA according to Tables B (B1-B74), Tables C (C1-C4) and Tables D (D1-D34). and specifically compounds directed to genes CIQBP, RAC1, GSK3B, P2RX7, TRPM2, PARG, CD38, STEAP4, BMP2, CX43, or TYROBP are tested in animal models where it is shown that these siRNA compounds treat and prevent pressure sores and ulcers.

Example 4

Model Systems of Chronic Obstructive Pulmonary Disease (COPD)

Chronic obstructive pulmonary disease (COPD) is characterized mainly by emphysema, which is permanent destruction of peripheral air spaces, distal to terminal bronchioles. Emphysema is also characterized by accumulation of inflammatory cells such as macrophages and neutrophils in bronchioles and alveolar structures. Emphysema and chronic bronchitis may occur as part of COPD or independently.

Testing the active inhibitors of the invention (such as siRNA) for treating COPD/emphysema/chronic bronchitis is performed in animal models such as those disclosed as follows:

Starcher and Williams, 1989. Lab. Animals, 23:234-240; Peng, et al., 2004; Am J Respir Crit. Care Med, 169:1245-1251; Jeyaseelan et al., 2004. Infect. Immunol, 72: 7247-56. Additional models are described in PCT patent publication WO 2006/023544 assigned to the assignee of the present application, which is hereby incorporated by reference into this application.

siRNA according to Tables B (B1-B74), Tables C (C1-C4) and Tables D (D1-D34), and in particular to siRNA to genes CIQBP, BNIP3, GSK3B, P2RX7, TRPM2, PARG, CD38, STEAP4, BMP2, CX43, TYROBP, CTGF, and DUOX1 are tested in these animal models, which show that these siRNA compounds may treat and/or prevent emphysema, chronic bronchitis and COPD.

Example 5

Model Systems of Spinal Cord Injury

Spinal cord injury, or myelopathy, is a disturbance of the spinal cord that results in loss of sensation and/or mobility. The two common types of spinal cord injury are due to trauma and disease. Traumatic injury can be due to automobile accidents, falls, gunshot, diving accidents inter alia, and diseases which can affect the spinal cord include polio, spina bifida, tumors and Friedreich's ataxia.

Uptake of siRNA Molecules into Neurons Following Injection into Injured Spinal-Cord:

The uptake of Cy3 labeled siRNA (injected into the injured cord) in different types of cells is examined following spinal cord contusion and in uninjured rats. Sagittal cryosections are produced and immunostaining using four different groups of antibodies is performed in order to determine whether uptake has occurred in neurons, astroglia, oligdendroglia and/or macrophages/microglia. Markers for neurons include NeuN, or GAP43; markers for astroglia and potential neural stem cells include GFAP, nestin or vimentin; markers for oligdendroglia include NG2 or APC; markers for macrophages/microglia include ED1 or Iba-1 (Hasegawa et al., 2005. Exp Neurol 193:394-410).

Rats are injected with two different doses of Cy3 labeled siRNA (1 µg/µl, 10 µg/µl) and are left for 1 and 3 days before sacrifice. Histological analyses indicate that many long filamentous profiles take up the labeled siRNA as well as other processes and cell bodies. Immunostaining with antibodies to MAP2 identifies uptake of label into dendrites and into cell bodies of neurons including motorneurons. Staining with other antibodies specific to astrocytes or macrophages reveals lower uptake of Cy3 labeled siRNA as compared to neurons. These results indicate that siRNA molecules injected to the injured spinal-cord will reach the cell body and dendrites of neurons including motorneurons.

siRNA compounds according to Tables B (B1-B74), Tables C (C1-C4) and Tables D (D1-D34) and in particular siRNA directed to genes LRDD, CYBA, ATF3, CASP2, HRK, CIQBP, BNIP3, MAPK8, MAPK14, RAC1, GSK3B, P2RX7, TRPM2, PARG, CD38, STEAP4, BMP2, CX43, TYROBP, CTGF, and RHOA are tested in this animal model, which show that these siRNA compounds promote functional recovery following spinal cord injury and thus may be used to treat spinal cord injury.

Example 6

Model Systems of Glaucoma

Testing the active inhibitors of the invention (such as siRNA) for treating or preventing glaucoma is done in the animal model for example as described by Pease et al., J. Glaucoma, 2006, 15(6):512-9 (Manometric calibration and comparison of TonoLab and TonoPen tonometers in rats with experimental glaucoma and in normal mice).

siRNA according to Tables B (B1-B74), Tables C (C1-C4) and Tables D (D1-D34) in particular to genes TP53BP2, LRDD, CYBA, ATF3, CASP2, HRK, BNIP3, MAPK8, MAPK14, RAC1, and RHOA are tested in this animal model which show that these siRNA compounds treat and/or prevent glaucoma.

Example 6A

Model Systems of Ischemic Optic Neuropathy (ION)

An animal model for Ischemic optic neuropathy was established in adults Wistar rats using a protocol of optic nerve crush injury. Seven days prior to the optic nerve crush, the retinal ganglion cells (RGC) were selectively labelled by application of the retrograde tracer FluoroGold (2%, Fluorochrome, Englewood, Colo.) to the superior colliculus. The tracer was transported by retrograde transport along RGC axons resulting in complete and specific labelling of all RGCs within 1 week post injection of the fluorescent tracer. The animals were subjected to the optic nerve crush injury 7 days post retrograde tracing. The orbital optic nerve was exposed through a supraorbital approach and all axons in the optic nerve were transected by crushing with forceps for 10 seconds, 2 mm from the lamina cribrosa. A single dose of 20 µg/5 µl of PBS of the Casp2_4 siRNA compound was microinjected into the vitreous body 2 mm anterior to the nerve head, using a glass micropipette at the time of the optic nerve crush (Casp2_4: Sense sequence: GCCAGAAUGUG-GAACUCCU, SEQ ID NO:139; Antisense sequence: AGGAGUUCCACAUUCUGGC, SEQ ID NO:140; sense strand comprises L-DNA at positions 17 and 18 and antisense strand comprises alternating modified and unmodified ribonucleotides wherein the modified ribonucleotides comprise a 2' OMe modification). The survival of RGCs was determined 7 days following the optic nerve crush by counting FluoroGold-labelled RGCs on flat-mounted retinas. The experimental animals were perfused transcardially with 4% paraformaldehyde at 1 week after the optic nerve crash. Both retinas were dissected out, fixed for an additional 30 min and flat-mounted on a glass slide for ganglion cell layer quantification. The number of fluorescent RGCs was counted in 16 distinct areas in each retina and the percent of survival of the RGCs was determined compared to samples obtained from rats which did not undergo optic nerve crush injury at all or samples obtained from rats which were injected with PBS, control siRNA or GFP siRNA along with the optic nerve crush injury. Microglia cells that may have incorporated FluoroGold after phagocytosis of dying RGCs were distinguished by their characteristic morphology and excluded from quantitative analyses. The results demonstrated in the table below revealed more than two fold increase in the % of survival of RGC in animals treated with the Casp2_4 compound compared to non-relevant siRNA compound.

| Quantification of RGC survival: | | | | |
|---|---|---|---|---|
| N = 4 retinas/treatment | PBS | siGFP | Casp2_4 siRNA | Control siRNA |
| % of survival of RGC | 25.52577 | 26.12142 | 59.04197 | 25.44345 |
| SD | 1.408675 | 1.07731 | 1.13383 | 1.19296 |

Similar results are obtained using another model of optic nerve axotomy where the entire population of RGCs are axotomized by transecting the optic nerve close to the eye. (Cheng L, Sapieha P, Kittlerova P, Hauswirth W W, Di Polo A. TrkB Gene Transfer Protects Retinal Ganglion Cells from Axotomy-Induced Death In Vivo. *J. Neurosci.* May 15, 2002 2002; 22:3977-3986).

Example 7

Model Systems of Ischemia/Reperfusion Injury Following Lung Transplantation in Rats Testing the active inhibitors of the invention (such as siRNA) for treating or preventing ischemia/reperfusion injury or hypoxic injury following lung transplantation is done in one or more of the experimental animal models, for example as described by Mizobuchi et al., 2004. J. Heart Lung Transplant, 23:889-93; Huang, et al., 1995. J. Heart Lung Transplant. 14: S49; Matsumura, et al., 1995. Transplantation 59: 1509-1517; Wilkes, et al., 1999. Transplantation 67:890-896; Naka, et al., 1996. Circulation Research, 79: 773-783.

siRNA according to Tables B (B1-B74), Tables C (C1-C4) and Tables D (D1-D34) and in particular to TP53BP2, LRDD, CYBA, CASP2, BNIP3, RAC1, and DUOX1 are tested in these animal models, which show that these siRNA compounds treat and/or prevent ischemia-reperfusion injury following lung transplantation and thus may be used in conjunction with transplant surgery.

Example 8

Model Systems of Acute Respiratory Distress Syndrome

Testing the active inhibitors of the invention (such as siRNA) for treating acute respiratory distress syndrome is done in the animal model as described by Chen et al (J Biomed Sci. 2003; 10(6 Pt 1):588-92. siRNA compounds according to Tables B (B1-B74), Tables C (C1-C4) and Tables D (D1-D34) in particular to genes CYBA, HRK, BNIP3, MAPK8, MAPK14, RAC1, GSK3B, P2RX7, TRPM2, PARG, SPP1, and DUOX1 are tested in this animal model which shows that these siRNAs treat and/or prevent acute respiratory distress syndrome and thus may be used to treat this condition.

Example 9

Model Systems of Hearing Loss Conditions (i) Distribution of Cy3-PTEN siRNA in the Cochlea Following Local Application to the Round Window of the Ear A solution of 1 µg/100 µl of Cy3-PTEN siRNA (total of 0.3-0.4 µg) PBS is applied to the round window of chinchillas.

The Cy3-labelled cells within the treated cochlea are analyzed 24-48 hours post siRNA round window application after sacrifice of the chinchillas. The pattern of labeling within the cochlea is similar following 24 h and 48 h and includes labeling in the basal turn of cochlea, in the middle turn of cochlea and in the apical turn of cochlea. Application of Cy3-PTEN siRNA onto scala tympani reveals labeling mainly in the basal turn of the cochlea and the middle turn of the cochlea. The Cy3 signal persists to up to 15 days after the application of the Cy3-PTEN siRNA. The siRNA compounds of the invention are tested in this animal model which shows that there is significant penetration of these siRNA compounds to the basal, middle and apical turns of the cochlea, and that these compounds may be used in the treatment of hearing loss.

(ii) Chinchilla Model of Carboplatin-Induced or Cisplatin-Induced Cochlea Hair Cell Death Chinchillas are pre-treated by direct administration of specific siRNA in saline to the left ear of each animal. Saline is given to the right ear of each animal as placebo. Two days following the administration of the specific siRNA compounds of the invention, the animals are treated with carboplatin (75 mg/kg ip) or cisplatin (intraperitoneal infusion of 13 mg/kg over 30 minutes). After sacrifice of the chinchillas (two weeks post carboplatin treatment) the % of dead cells of inner hair cells (IHC) and outer hair cells (OHC) is calculated in the left ear (siRNA treated) and in the right ear (saline treated). It is calculated that the % of dead cells of inner hair cells (IHC) and outer hair cells (OHC) is lower in the left ear (siRNA treated) than in the right ear (saline treated).

(iii) Chinchilla Model of Acoustic-Induced Cochlea Hair Cell Death

The activity of specific siRNA in an acoustic trauma model is studied in chinchilla. The animals are exposed to an octave band of noise centered at 4 kHz for 2.5 h at 105 dB. The left ear of the noise-exposed chinchillas is pre-treated (48 h before the acoustic trauma) with 30 μg of siRNA in ~10 μL of saline; the right ear is pre-treated with vehicle (saline). The compound action potential (CAP) is a convenient and reliable electrophysiological method for measuring the neural activity transmitted from the cochlea. The CAP is recorded by placing an electrode near the base of the cochlea in order to detect the local field potential that is generated when a sound stimulus, such as click or tone burst, is abruptly turned on. The functional status of each ear is assessed 2.5 weeks after the acoustic trauma. Specifically, the mean threshold of the compound action potential recorded from the round window is determined 2.5 weeks after the acoustic trauma in order to determine if the thresholds in the siRNA-treated ear are lower (better) than the untreated (saline) ear. In addition, the level of inner and outer hair cell loss is determined in the siRNA-treated and the control ear.

siRNA molecules according to Tables B (B1-B74), Tables C (C1-C4) and Tables D (D1-D34) in particular to genes TP53BP2, LRDD, CYBA, ATF3, CASP2, NOX3, HRK, CIQBP, BNIP3, MAPK8, MAPK14, RAC1, GSK3B, P2RX7, TRPM2, PARG, CD38, STEAP4, BMP2, CX43, TYROBP, and CTGF are tested in this animal model which shows that the thresholds in the siRNA-treated ear are lower (better) than in the untreated (saline) ear. In addition, the amount of inner and outer hair cell loss is lower in the siRNA-treated ear than in the control ear.

Example 10

Animal Models of Osteoarthritis (OA)

Collagen induced arthritis (CIA): CIA in mice is described in Trentham et al. (1977. J. Exp. Med. 146: 857-868). Adjuvant-induced arthritis (AA):AA is described in Kong et al., (1999. Nature, 402:304-308). A menisectomy model is described in Han et al., (1999. Nagoya J Med Sci 62(3-4): 115-26).

The effect of different siRNA inhibitors, such as siRNA to SSP1, on different parameters related to OA such as chondrocyte proliferation, terminal differentiation and development of arthritis, is evaluated using one or more of the above models, in addition to in vitro models known in the art. siRNA compounds directed to specific proapoptotic genes of Table A, in particular to SSP1, are tested in these animal models which show that these siRNAs treat and/or prevent OA and thus may be used to treat this condition.

Example 11

Rat Model Systems for Transplantation-Associated Acute Kidney Injury

Warm ischemia—In test rats a left nephrectomy is performed, followed by auto transplantation that results in a warm kidney graft preservation period of 45 minutes. Following auto transplantation, a right nephrectomy is performed on the same animal. Chemically modified siRNA to a target is administered intravenously via the femoral vein either before harvesting of the kidney graft (mimicking donor treatment) ("pre"), or after the kidney autotransplantation (mimicking recipient treatment), or both before harvest and after transplantation (combined donor and recipient treatment) ("pre-post").

Cold ischemia—A left nephrectomy is performed on a donor animal, followed by a cold preservation (on ice) of the harvested kidney for a period of 5 hours. At the end of this period, the recipient rat will undergo a bilateral nephrectomy, followed by transplantation of the cold-preserved kidney graft. The total warm ischemia time (including surgical procedure) is about 30 minutes. Chemically modified siRNA is administered intravenously via the femoral vein, either to the donor animal prior to the kidney harvest ("pre"), or to the recipient animal 15 minutes ("post 15 min") or 4 hours (post 4 hrs) post-transplantation.

To assess the efficacy of siRNA in improvement of post-transplantation renal function, serum creatinine levels are measured on days 1, 2, and 7 post-transplantation in both warm and cold ischemia models.

Example 12

Generation of Sequences for Active siRNA Compounds to Pro-Apoptotic Genes and Production of the siRNAs Using proprietary algorithms and the known sequence of any gene, optionally the pro-apoptotic genes disclosed herein, the sequences of many potential siRNAs were generated. In addition to the algorithm, some of the 23-mer oligomer sequences were generated by 5' and/or 3' extension of the 19-mer sequences. The sequences that have been generated using this method are fully complementary to the corresponding mRNA sequence.

Tables B (B1-B74), Tables C (C1-C4) and Tables D (D1-D34) show siRNAs for the following pro-apoptotic genes: tumor protein p53 binding protein, 2 (TP53BP2); leucine-rich repeats and death domain containing (LRDD); cytochrome b-245, alpha polypeptide (CYBA); activating transcription factor 3 (ATF3); caspase 2, apoptosis-related cysteine peptidase (neural precursor cell expressed, developmentally down-regulated 2) (CASP2); NADPH oxidase 3 (NOX3); harakiri, BCL2 interacting protein (contains only BH3 domain) (HRK); complement component 1, q subcomponent binding protein (C1QBP); BCL2/adenovirus E1B 19 kDa interacting protein 3 (BNIP3); mitogen-activated protein kinase 8 (MAPK8); mitogen-activated protein kinase 14 (MAPK14); ras-related C3 botulinum toxin substrate 1 (rho family, small GTP binding protein Rac1); glycogen synthase kinase 3 beta (GSK3B); purinergic receptor P2X, ligand-gated ion channel, 7 (P2RX7); transient receptor potential cation channel, subfamily M, member 2 (TRPM2); poly (ADP-ribose) glycohydrolase (PARG); CD38 molecule (CD38); STEAP family member 4 (STEAP4); bone morphogenetic protein 2-BMP2; gap junction protein, alpha 1, 43 kDa (connexin 43) (GJA1); TYRO protein tyrosine kinase binding protein (TYROBP); connective tissue growth factor (CTGF); secreted phosphoprotein 1 (osteopontin, SPP1); ras homolog gene family, member A (RHOA); dual oxidase 1 (DUOX1). For each gene there is a separate list of 19-mer, 21-mer and 23-mer siRNA sequences, which are prioritized based on their score in the proprietary algorithm as the best sequences for targeting human gene expression.

Example 13

Modified siRNA

Certain structural motifs useful in siRNA compounds have been tested and shown to be active and or stable. Structures C-H are shown to be active and or stable with any one of the sequences set forth in Tables B (B1-B74), Tables C (C1-C4) and Tables D (D1-D34).

Other active structures include siRNA having a structural motif according to Structures (IX)-(XI). Compounds comprising the sequences set forth in Tables B (B1-B74), Tables C (C1-C4) and Tables D (D1-D34) and the motifs set forth in Structures (I)-(XI) are shown in FIG. 23, herein.

In one example, a CASP2 siRNA where x=y=19 was tested with different structural motifs and compared for activity and stability. In the first compound (Casp2-i) the (N)x (antisense) consists of alternating 2'-OMe modified and unmodified ribonucleotides; three consecutive nucleotides at the 3' terminus of (N')y (sense strand) are joined by two 2'-5' phosphodiester bonds and three nucleotides at the 5' terminus of (N')y are LNA. In the second compound (Casp2-ii) (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA. In the third compound (Casp2-iii), in (N)x two consecutive nucleotides at the 5" terminus (the terminal and penultimate nucleotides) are 2'-OMe modified ribonucleotides and three consecutive nucleotides at the 3' terminus of (N')y are joined by two 2'-5' phosphodiester bonds and three consecutive nucleotides at the 5' terminus of (N')y are LNA. These molecules are shown herein below in Table E and their activity as denoted by a % inhibition in human HeLa cells and IC50 is presented in Table F. The compounds were shown to be active (>50% inhibition) in HeLa cells. The compounds were further tested for serum stability. Structure CASP2-i was stable for 24 hours in human serum. Casp2-ii and Casp2-iii showed stability over 24 hours, with a low level of degradation products identified. The oligomers are CASP2-based sequences that can be replaced by any sense and antisense pair or the sense and antisense pairs shown in Tables B (B1-B74), Tables C (C1-C4) or Tables D (D1-D34).

TABLE E

| Compound | | | SEQ ID No. |
|---|---|---|---|
| Casp2-i | SEN 5' | *gcc*AGAAUGUGGAACUC\*C\*U-3' | SEQ ID No: 139 |
| | AS-5'- | AGGAGUUCCACAUUCUGGC-3' | SEQ ID No: 140 |
| Casp2-ii | SEN 5' | *gcc*AGAAUGUGGAACUC\*C\*U-3' | SEQ ID No: 139 |
| | AS-5'- | AGGAGUUCCACAUUCUGGC-3' | SEQ ID No: 140 |
| Casp2-iii | SEN 5' | *gcc*AGAAUGUGGAACUC\*C\*U-3' | SEQ ID No: 139 |
| | AS-5'- | AGGAGUUCCACAUUCUGGC-3' | SEQ ID No: 140 |

\*: 2'5' bridge; italics: LNA, underlined: 2'OMe

TABLE F

| Compound | % inhibition 20 nM | % inhibition 5 nM | IC50 (nM) |
|---|---|---|---|
| Casp2-i | 89 | 81 | 0.50 |
| Casp2-ii | 90 | 87 | 0.12 |
| Casp2-iii | 78 | 55 | 2.58 |

Table G shows 19-mer and 23-mer siRNA compounds (rat p53) based on Structure (E) wherein the underlined nucleotides are L-DNA nucleotides. In those compounds each of (N)x and (N')y comprise unmodified ribonucleotides wherein the 3' penultimate nucleotide or two consecutive nucleotides at the 3' penultimate position is an L-DNA nucleotide. The oligomers are p53-based sequences that can be replaced by any sense and antisense pair or the sense and antisense pairs shown in Tables B (B1-B74), Tables C (C1-C4) or Tables D (D1-D34).

TABLE G

| _S1 | 5'-GAAGAAAAUUUCCGCA<u>AAA</u>-3' | AA | (L-DNA) | SEQ ID NO: 87179 |
|---|---|---|---|---|
| _AS1 | 5'-UUUUGCGGAAAUUUUCU<u>U</u>C-3' | U | (L-DNA) | SEQ ID NO: 87180 |
| _S2 | 5'-GAAGAAAAUUUCCGCAA<u>A</u>A-3' | A | (L-DNA) | SEQ ID NO: 87179 |
| _AS2 | 5'-UUUUGCGGAAAUUUUCU<u>U</u>C-3' | U | (L-DNA) | SEQ ID NO: 87180 |
| _S3 | 5'-GAAGAAAAUUUCCGCAA<u>A</u>A-3' | A | (L-DNA) | SEQ ID NO: 87179 |
| _AS3 | 5'-UUUUGCGGAAAUUUUC<u>UU</u>C-3' | UU | (L-DNA) | SEQ ID NO: 87180 |
| _S4 | 5'-GAAGAAAAUUUCCGCA<u>AAA</u>-3' | AA | (L-DNA) | SEQ ID NO: 87179 |
| _AS4 | 5'-UUUUGCGGAAAUUUUC<u>UU</u>C-3' | UU | (L-DNA) | SEQ ID NO: 87180 |

TABLE G-continued

| | | | | |
|---|---|---|---|---|
| _S5 | 5'-GGAAGAAGAAAAUUUCCGCAAAA-3' | AA | (L-DNA) | SEQ ID NO: 87181 |
| _AS5 | 5'-UUUUGCGGAAAUUUUCUUCUUCC-3 | C | (L-DNA) | SEQ ID NO: 87182 |
| _S6 | 5'-GGAAGAAGAAAAUUUCCGCAAAA-3' | A | (L-DNA) | SEQ ID NO: 87181 |
| _AS6 | 5'-UUUUGCGGAAAUUUUCUUCUUCC-3' | C | (L-DNA) | SEQ ID NO: 87182 |
| _S7 | 5'-GGAAGAAGAAAAUUUCCGCAAAA-3' | A | (L-DNA) | SEQ ID NO: 87181 |
| _AS7 | 5'-UUUUGCGGAAAUUUUCUUCUUCC-3' | UC | (L-DNA) | SEQ ID NO: 87182 |
| _S8 | 5'-GGAAGAAGAAAAUUUCCGCAAAA-3' | AA | (L-DNA) | SEQ ID NO: 87181 |
| _AS8 | 5'-UUUUGCGGAAAUUUUCUUCUUUCC-3 | UC | (L-DNA) | SEQ ID NO: 87182 |

Example 14

Experimental Results with 2'O-Methylated Structures of the Present Invention a) siRNAs (20 nM) directed against the p53 gene having the following structures, as shown in were tested in cells which express endogenous p53 for ability to inhibit gene expression.

Figures 4A, 4B:
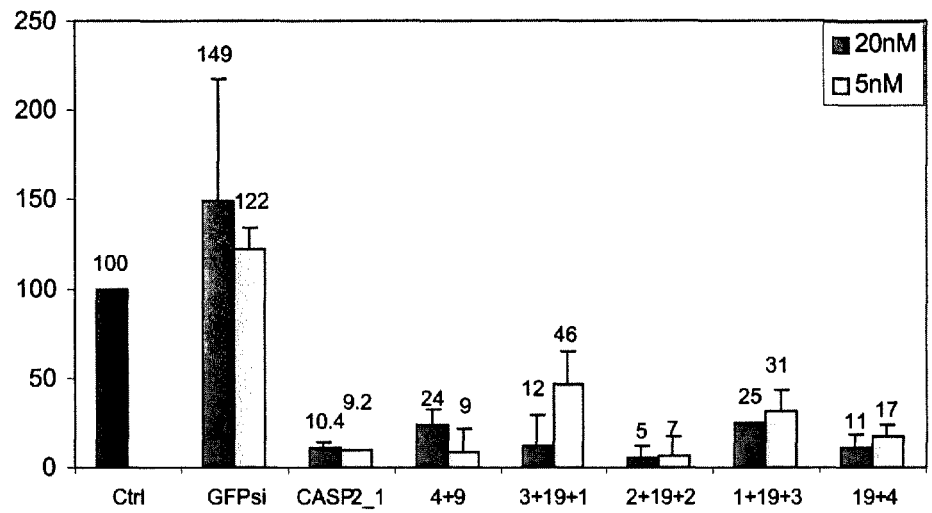
FIGS. 4A and 4B present 23-mer CASP2 siRNA structures comprising 2'-O-methylated monomers and experimental results obtained with those compounds.

FIG. 1A shows structures wherein 5=2'O-methylated riboUridine; 6=2'O-methylated riboAdenine; 7=2'O-methylated riboCytosine; and 8=2'O-methylated riboGuanine. Lower case letters refer to unmodified ribonucleotides.
Results
85-90% inhibition was observed following transfection of: structure Nos: #2; #4, #5, #6, #8 and #11.
75% inhibition was observed following transfection of structure No. #1.
60% inhibition was observed following transfection of: structure Nos: #3; #7, #10 and #12.
50% inhibition was observed following transfection of structure No. #9.
FIG. 1B presents the serum stability of some of the above structures, #4, #5, #8 and #11.
b) Further experimental results with 23-mer 2'O-Me structures of the present invention
siRNA compounds shown in FIG. 2, directed against p53 were tested in the above assay.
Nucleotides having a 2'-O-methyl modification are indicated by underlined capital letters.
90% inhibition or higher was achieved with structures #4, #5, #6, #8 and #11; 75% inhibition was achieved with structure #2.
c) siRNA compounds directed against CASP2, shown in FIG. 3A were tested in the above assay. Nucleotides having a 2'-O-methyl modification are indicated by underlined capital letters.
The activity results are presented in FIG. 3B; all the above molecules resulted in about 75-95% inhibition.
d) The siRNA compounds shown in FIG. 4A are directed against CASP2 and were tested in the above assay. Nucleotides having a 2'-O-methyl modification are indicated by underlined capital letters.
The results are presented in FIG. 4B; all the above molecules resulted in about 75-95% inhibition.
e) siRNA compounds directed against CASP2 and shown in FIG. 5A were tested in the above assay. The 2'-O-Me modified nucleotides are underlined capital letters.
The results are presented in FIG. 5B; all the above molecules resulted in about 75-90% inhibition.

Example 15

Figures 6A, 6B:
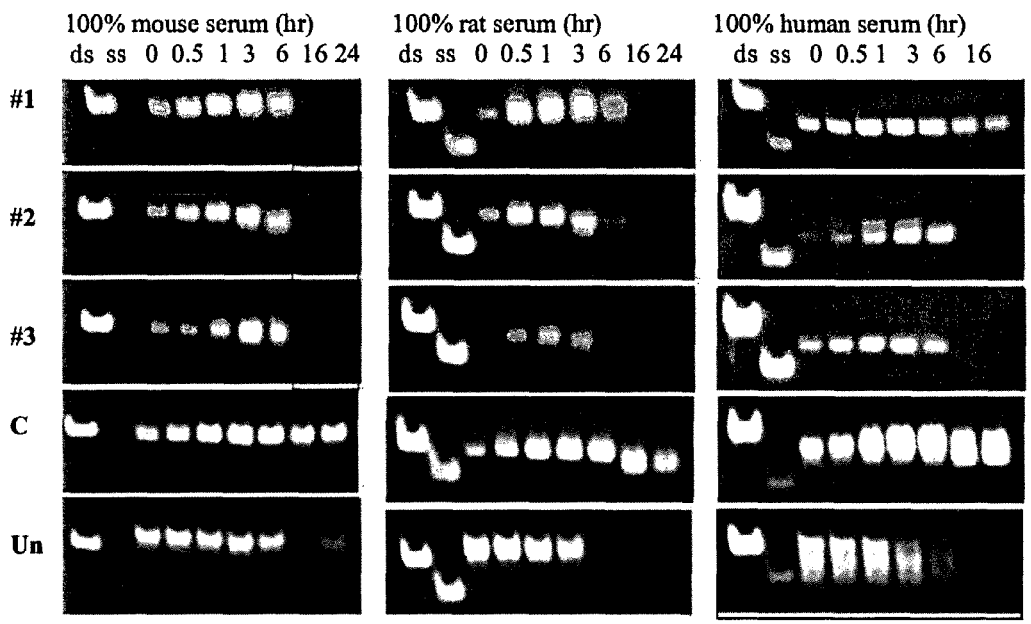
FIGS. 6A and 6B present 19-mer QM5 (targets p53) siRNA structures comprising 2'5' bridged nucleotides and experimental results obtained using those compounds.

Further Experimental Results with 2'-5' Bridged Structures a) siRNA compounds (20 nM) directed against the p53 gene having the structures shown in FIG. 6A were tested in cells which express endogenous p53 for ability to inhibit gene expression.

Figure 9C:
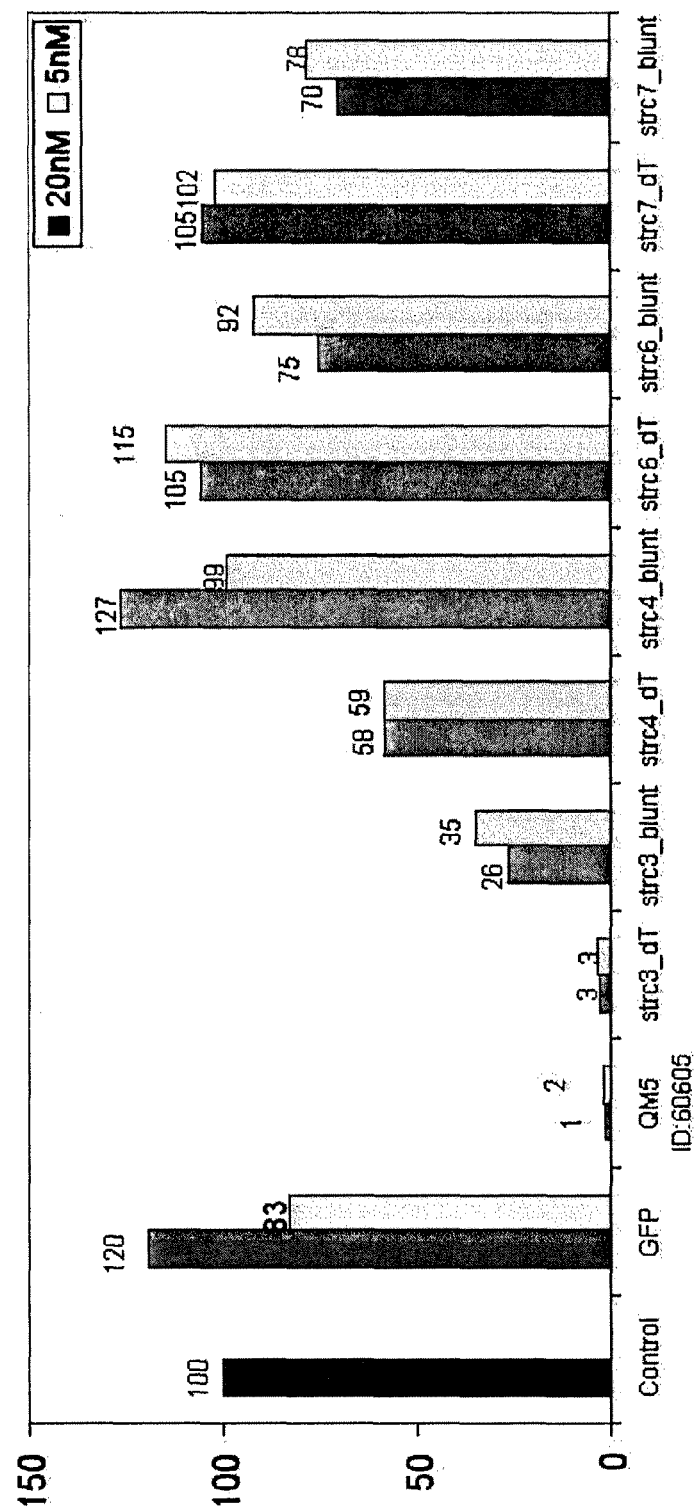
FIGS. 9C-9E show activity of those compounds.
Figure 9D:
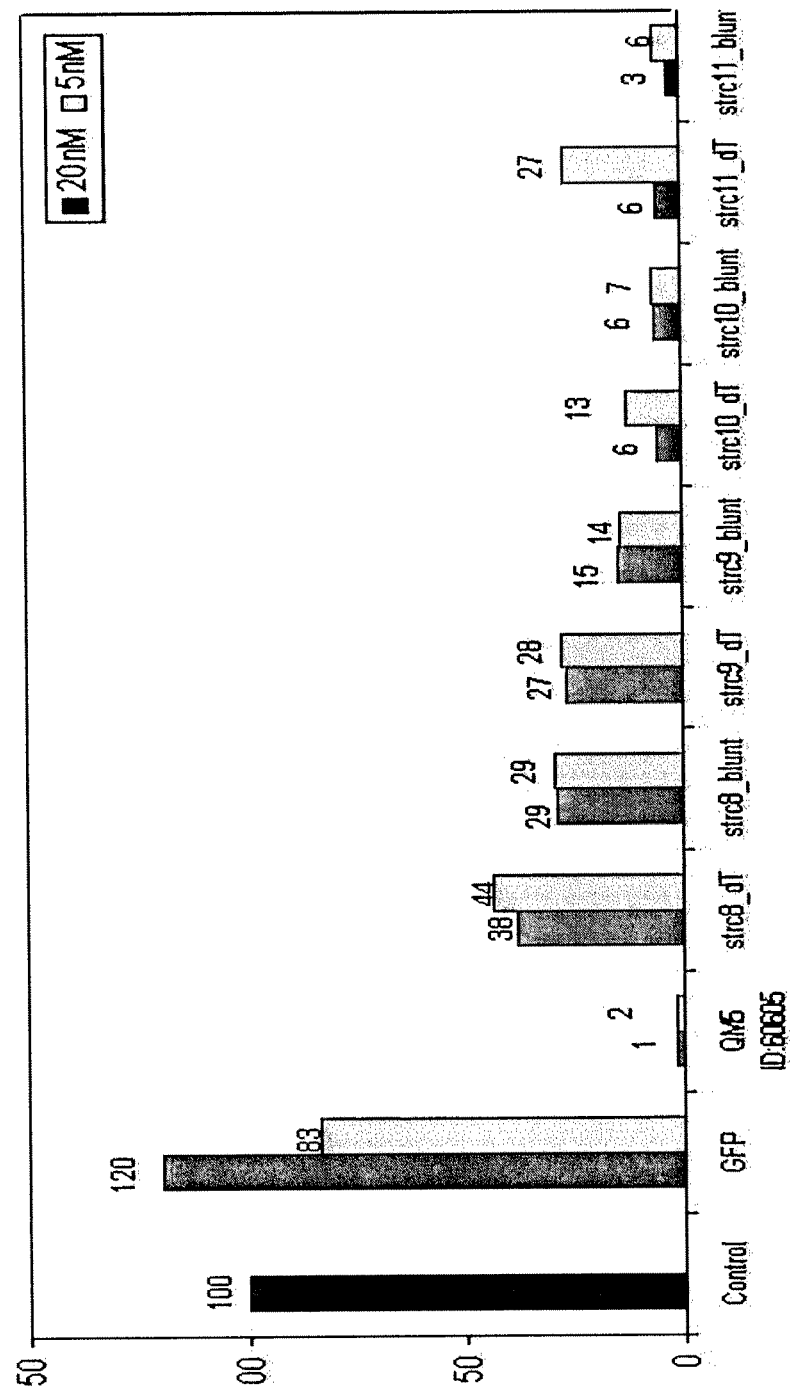
Figure 9E:
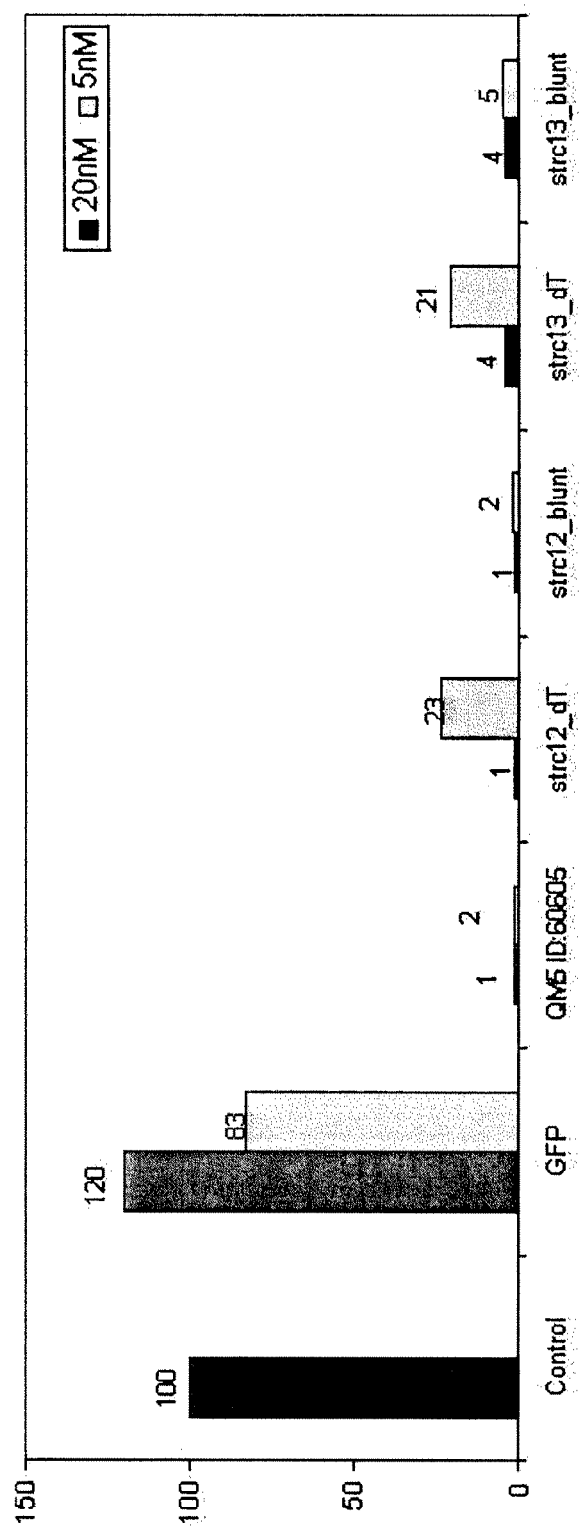

In FIG. 6A: 5=2'-5" bridged riboUridine; 6=2'-5" bridged riboAdenine; 7=2'-5" bridged riboCytosine; and 8=2'-5" bridged riboGuanine. Underlining indicates 2'-O-methylated nucleoside.
Results
90-95% inhibition was observed following transfection with structure Nos. 1-3, 10 and 12.
80-85% inhibition was observed following transfection with structures #4 and #15.
Other structures were less active. FIG. 6B presents the serum stability of some of the above structures. b) Results with 2'-5' structures relating to CASP2
siRNAs compounds directed against CASP2 and shown in FIG. 7A were tested in the above assay. Nucleotides linked by a 2'-5' bridge are indicated by an asterisk (*) between them.
The results are presented in FIG. 7B, and show that all 4 siRNAs against CASP2 were active and yielded 75-92% inhibition.
c) Results with 2'-5' structures relating to DDIT4 (REDD2)
siRNA compounds directed against DDIT4 and shown in FIG. 8A were tested in the above assay. Nucleotides linked by a 2'-5' bridge are indicated by an asterisk between them.
siRNA compounds 1 and 3 were active in the above assay and resulted in 60% inhibition of the endogenous gene.
d) Results with 2'-5' structures relating to QM5:
siRNA compounds directed against mouse p53 and shown in FIG. 8B were tested in the above assay. Nucleotides linked by a 2'-5' bridge are indicated by an asterisk between them.
Structures 1 and 3 results in 90-95% inhibition; structure 4 resulted in 70% inhibition and structure 2 resulted in about 50% inhibition.
e) Additional structures with 2'-5' and 2'-O-Methyl combination modifications
siRNA compounds directed against p53 (QM5 siRNA) and shown in FIGS. 9A-9B were tested in the above assay. Nucleotides linked by a 2'-5' bridge are indicated by an asterisk between them. The 2'-OMe modified nucleotides are underlined.
The results are shown in FIGS. 9C, 9D and 9E; many of the structures effect above 90% inhibition.

f) Additional 23-mer structures with 2'-5' and 2'-O-Methyl combination modifications siRNA compounds directed against p53 and shown in FIG. 10A were tested in the above assay. Nucleotides linked with a 2'-5' bridge are indicated by an asterisk between them. The 2'-O-Me modified nucleotides are underlined.

Figure 10C:
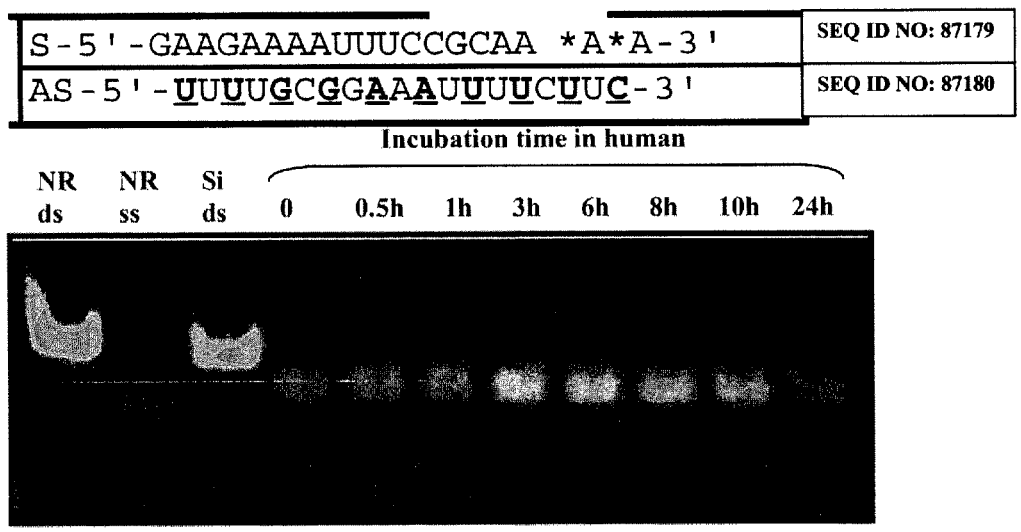
FIGS. 10C and 10D show serum stability results.
Figure 10D:
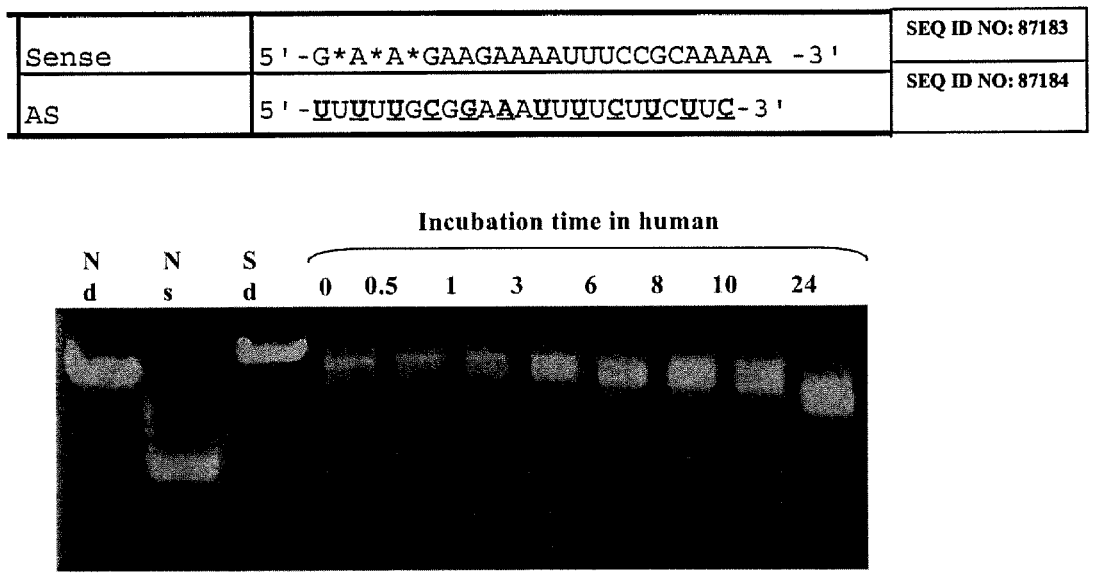

The results are presented in FIG. 10B. Structures 1-3 effected 80-95% inhibition. FIGS. 10C and 10D show serum stability results for structures having 2'5' linkages on the SS and an alternating methylation pattern on the AS.

g) siRNA compounds directed against CASP2 and shown in FIG. 11A were tested in the above assay. The 2'-OMe modified nucleotides are underlined and nucleotides linked by a 2'-5' bridge are indicated by an asterisk between them.

The results are presented in FIG. 11B, and indicate that structures 3-5 effect about 70-95% inhibition.

h) siRNA compounds directed against CASP2 and shown in FIG. 12A were tested in the above assay. Nucleotides linked by a 2'-5' bridge are indicated by an asterisk between them.

The results are presented in FIG. 12B, and indicate that structures 3-5 effect about 80-95% inhibition.

Example 16

Further Experimental Results with Mirror Nucleotide Containing Structures siRNA compounds (5 nM and 20 nM) directed against the p53 gene and having the structures as shown in FIG. 13A were tested in cells which express endogenous p53 for ability to inhibit gene expression.

Note that nucleotides which are underlined are mirror DNA nucleotides i.e. L-deoxyribonucleotides.

Results 80-95% inhibition was observed following transfection with structures 1-3, 10, 12 and 15. Structure 16, which comprises alternating nucleotides on both strands serves as positive control.

Figure 13B:
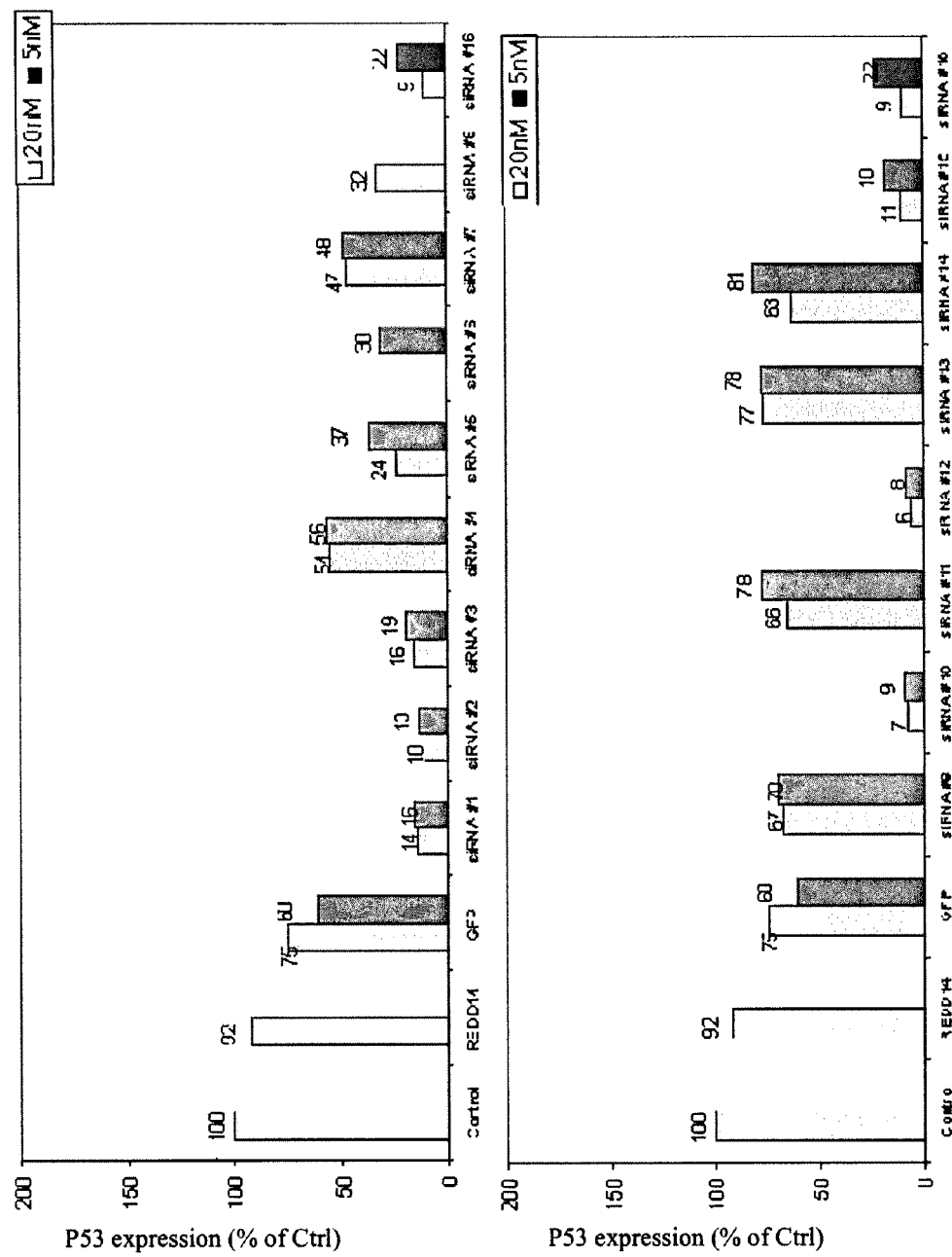
FIG. 13B shows experimental results using those compounds.

Other structures showed low to moderate activity. The results are presented in FIG. 13B. FIG. 13C shows serum stability of an siRNA compound which comprises L-DNA nucleotide monomers (covalently linked to adjacent nucleotide monomer). A further series of results in the activity assay with siRNA #1 demonstrated an IC50 of 0.09 nM. This level of activity is 2-fold greater than the same sequence with an alternating methylated structure on both strands, which had an IC50 of 0.23 nM (See FIG. 13D).

Example 17

Figure 14B:
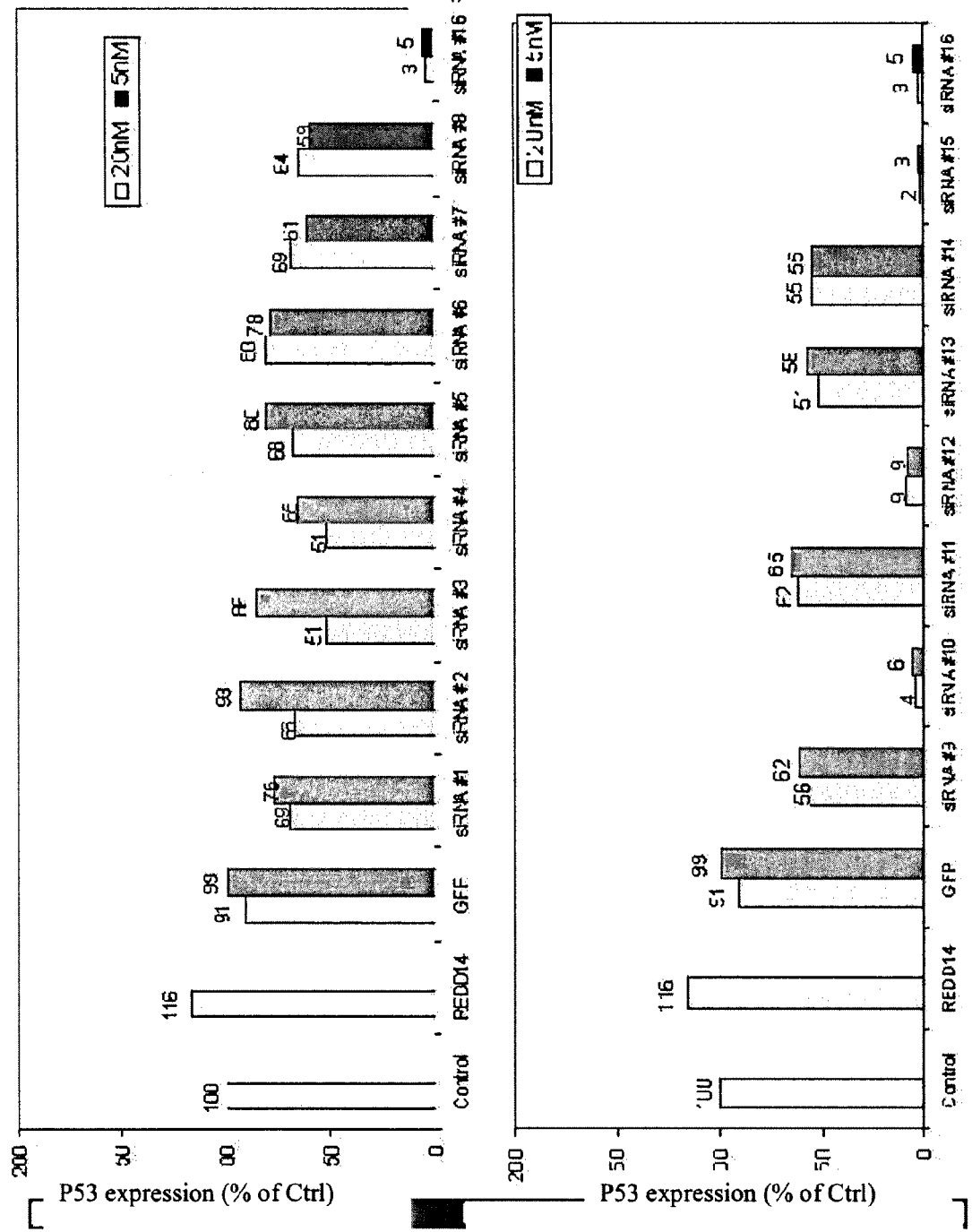
FIG. 14B shows experimental results using those compounds.

Further Experimental Results with LNA Containing Structures siRNA compounds (5 nM and 20 nM) directed against the p53 gene and having structures shown in FIG. 14A were tested in cells which express endogenous p53 for ability to inhibit gene expression. Note that underlining indicates an LNA nucleotide. The same assay presented in Example 1 was used.

Results 80-95% inhibition was observed following transfection with structures 10, 12 and 15.

Other structures showed low to moderate activity. The results are presented in FIG. 14B.

Example 18

Tandem and Star Structures

Figure 15:
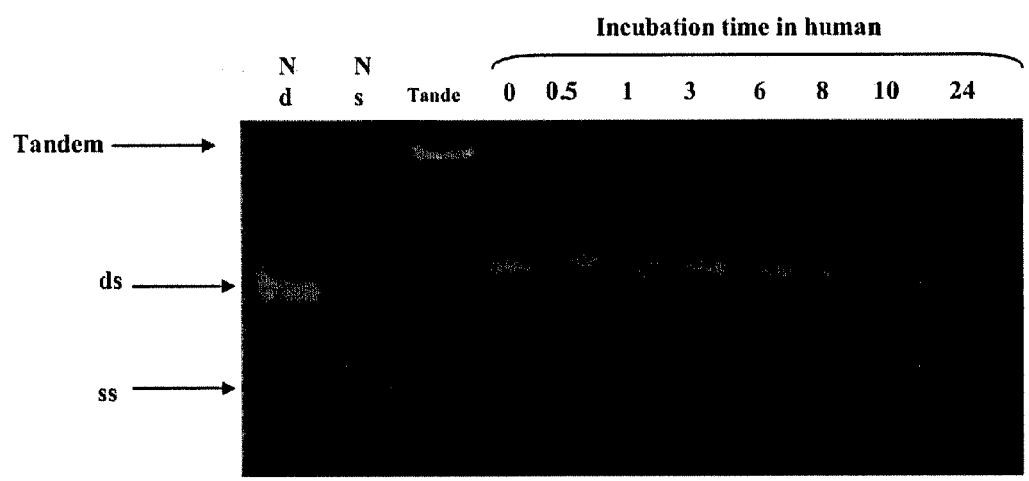
FIG. 15 shows an example of a tandem siRNA compound and serum stability results thereof.
Figure 16A:
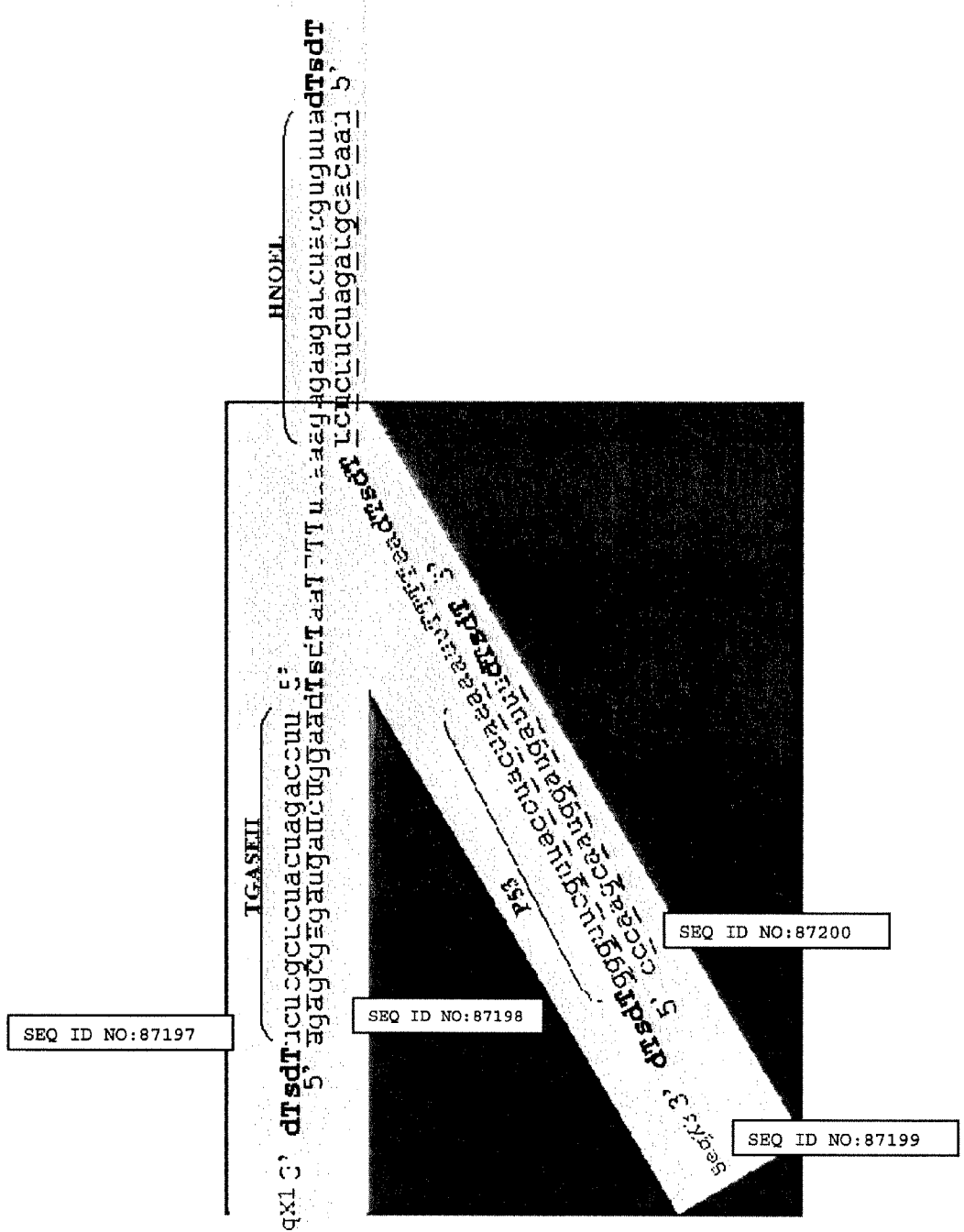
FIG. 16 shows an example of a star siRNA compound and serum stability results thereof.
Figure 16B:
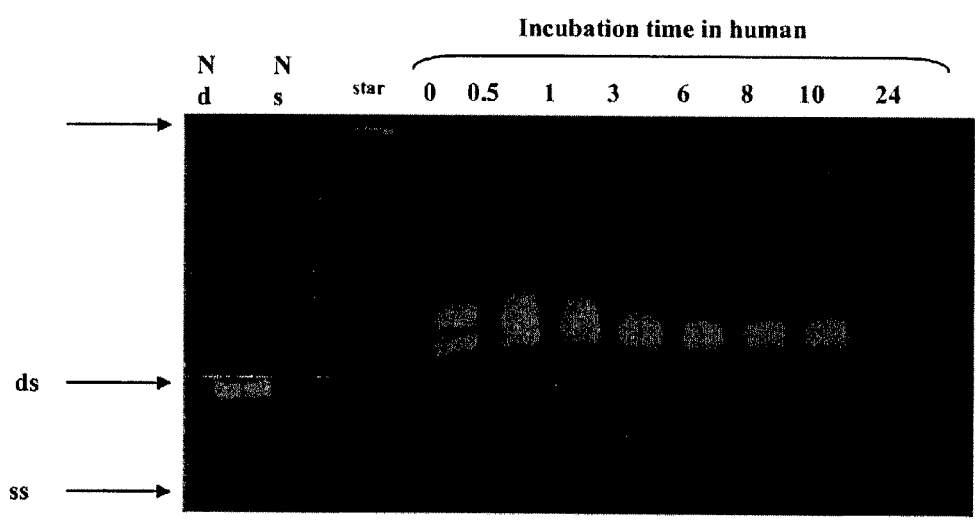

FIGS. 15 and 16 show examples and serum stability of tandem siRNA and "star" siRNA structures, respectively.

Example 19 siRNA Compounds Having Multiple Modification Types

FIGS. 17A-17C show p53 and CASP2 siRNA compounds, which comprise modified nucleotide monomers (covalently linked to adjacent nucleotide monomer) at various positions, and their activity, measured at 20 nM and showing % target gene knock down (KD). In FIG. 17A the bold underlined letters represent 2' methoxy modified nucleotides; the capital italicized letters represent nucleotides comprising 2'5' internucleotide linkages and a 3' methoxy modification. In FIG. 17B the bold underlined letters represent 2' methoxy modified nucleotides; the capital italicized letters represent nucleotides comprising P-ethoxy internucleotide linkages. In FIG. 17C the bold underlined letters represent 2' methoxy modified nucleotides; the capital italicized letters represent nucleotides comprising 2'5' internucleotide linkages, italics small letters represent L-DNA modified nucleotides and the small letters represent LNA (2'O-4'C) nucleotides.

Example 20

Deoxyribonucleotide Containing Structures

FIG. 18 show examples of CASP2_4 siRNA antisense strands (AS) and sense strands (S), which comprise DNA monomers at various positions (bolded and italicized letters and covalently linked to adjacent nucleotide monomer). siRNA compounds are synthesized by combining any sense strand with any of the antisense strands. In FIG. 18: 5=2'O methylated riboUridine; 6=2'O methylated riboAdenine; 7=2'O methylated riboCytosine; and 8=2'O methylated riboGuanine. FIGS. 19A-19E show examples of L-DNA motifs exemplified with the CASP2_4 and RhoA_24 sequences.

FIG. 19A shows two preferred double stranded duplexes targeting CASP2 useful in RNAi.

FIG. 19B shows CASP2_4 duplexes comprising L-DNA nucleotides (n=L-DNA (L-deoxyribonucleotide); N (underlined capital)-2'-OMe ribonucleotide; Lc—L-Deoxy cytidine 5'-overhang; ab—abasic pseudo deoxyribonucleotide analog.

FIG. 19C shows CASP2_4 SEN oligonucleotides comprising combinations of unmodified ribonucleotides, DNA nucleotides and L-DNA nucleotide analogs and CASP2_4 AS oligonucleotides comprising alternating unmodified and modified ribonucleotides, useful in preparing duplexes exhibiting RNAi activity.

FIG. 19D shows the activity and stability of CASP2_4 modified duplexes.

FIG. 19E shows certain duplex motifs exemplified with the RhoA_24 sequences, with and without the 3' phosphate at one or both 3' termini.

Example 21

Structures Containing Abasic, Inverted-Abasic, 2'O-Methyl, Mismatched Base Pairs and Other Modifications FIG. 20 describe such structures, which are effective in treating any of the conditions disclosed herein.

In FIGS. 20A-20G the legend of nucleotide analogs and pseudo nucleotides is as follows:

Underlined capital letter "N"—2'OMe ribonucleotide; "ab"—abasic pseudo nucleotide; I—inverted abasic pseudonucleotide; Italicized "5N"=5'OMe DNA, White capital "N"—LNA; italicized small case underlined n: L-DNA; strikethrough N— mismatches FIG. 20A: Set 1 shows AS strand comprising abasic mismatch to the target sequence; oligonucleotides lack 3' phosphate;

FIG. 20B: Set 2 shows oligonucleotides useful in preparing duplex compounds having less than 15 bp in the ds structure; oligonucleotides lack 3' phosphate;

FIG. 20C: Set 3 shows oligonucleotides having insertion of at least one mismatch to target sequence;

FIGS. 20D-20E: Sets 4 and 5 show AS strand comprising abasic pseudo nucleotide or nucleotides ("ab") paired with sense strands as in SET 1;

FIG. 20F: Set 6 shows AS strand comprising abasic pseudo nucleotide or nucleotides ("ab") paired with unmodified sense strands;

FIG. 20G: Set 7 shows unmodified AS strand paired with sense strands from SET1.

FIG. 21 shows examples of the base modifications in non-base pairing nucleotide analogs useful in preparing oligonucleotide having RNAi activity. (In the column showing the chemical structures, dR shows the point of attachment to the deoxyribose moiety; R shows the point of attachment to the ribose moiety).

SEQUENCE LISTING (87239 sequences)

SEQ ID NO: 1 - RNA, 4670 nt, Homo sapiens
gcuggggcccgacccgggauuaguugguuucggagcggaggagggagccccgaccgucacgagcgucgaagagacaaagccgcgucagggggcccggccggggcgggggagcccggggcuuguuggugccccagcccgcgcggagggcccuucggacccgcgcgccgccgcugccgccgccgccgccucgcaacagguccgggcggccucgcucuccgcuccccucccccgcauccgcgacccuccggggcaccucagcucggccggggccgcagucuggccacccgcuuccaugcgguucggguccaagaugaugccgauguuucuuaccguguaucucaguaacaaugagcagcacuucacagaaguuccaguuacuccagaaacaauaugcagagacgugguggaucugugcaaagaacccggcgagagugauugccauuuggcugaagugugguguggcucugaacguccaguugcggauaaugagcgaauguuugauguucuucaacgauuuggaagucagaggaacgaaguucgcuucuuccuucgucaugaacgccccccuggcagggacauugugaguggaccaagaucucaggauccaaguuuaaaaagaaaugguguaaaaguuccuggugaauaucgaagaaaggagaacgguguuaauaguccuaggauggaucugacucuugcugaacuucaggaaauggcaucucgccagcagcaacagauugaagcccagcaacaauugcuggcaacuaaggaacagcgcuuaaaguuuuugaaacaacaagaucagcgacaacagcaacaaguugcugagcaggagaaacuuaaaaggcuaaaagaaauagcugagaaucaggaagcuaagcuaaaaaaagugagagcacuuaaaggccacguggaacagaagagacuaagcaaugggaaacuuguggaggaaauugaacagaugaauaauuuguuccagcaaaaacagagggagcucguccuggcugugucaaaaguagaagaacugaccaggcagcuagagaugcucaagaacggcaggaucgacagccaccaugacaaucagucugcaguggcugagcuugaucgccucuauaaggagcugcagcuaagaaacaaauugaaucaagagcagaaugccaagcuacaacaacagagggaguguuugaauaagcguaauucagaaguggcagucauggauaagcguguuaaugagcugagggaccggcuguggaagaagaaggcagcucuacagcaaaaagaaaaucuaccaguuucaucugauggaaaucuuccccagcaagccgcgucagccccaagccguguggcugcaguaggucccuauauccagucgucuacuaugccucggaugcccucaaggccugaauugcuggugaagccagcccugccggaugguuccuuggucauucaggcuucagaggggccgaugaaaauacagacacugcccaacaugagaucuggggcugcuucacaaacuaaaggcucuaaaauccauccaguuggcccugauuggaguccuucaaaugcagaucuuuucccaagccaaggcucugcuucuguaccucaaagcacugggaaugcucuggaucaaguugaugauggagagguuccgcugagggagaaagagaagaaagugcguccguucucaauguuugaugcaguagaccaguccaaugccccaccuuccuuugguacucugaggaagaaccagagcagugaagauaucuugcgggaugcucagguugcaaauaaaaauguggcuaaaguaccaccuccuguuccuacaaaaccaaaacagauuaauuugccuuauuuuggacaaacuaaucagccaccuucagacauuaagccagacggaaguucucagcaguugucaacaguuguuccguccaugggaacuaaaccaaaaccagcagggcagcagccgagagugcugcuaucucccagcauaccuucgguuggccaagaccagacccuuucuccagguucuaagcaagaaaguccaccugcugcugccguccggcccuuuacuccccagccuuccaaagacaccuuacuuccacccuucagaaaaccccagaccguggcagcaaguucaauauauuccauguauacgcaacagcaggcgccaggaaaaaacuuccagcaggcugugcagagcgcguugaccaagacucauaccagagggccacacuuuucaaguguauaugguaagccuguaauugcugcugcccagaaucaacagcagcacccagagaacauuuauuccaauagccagggcaagccuggcaguccagaaccugaaacagagccuguuucuucaguucaggagaaccaugaaaacgaaagaauuccucggccacucagcccaacuaaauuacugccuuucuuaucuaauccuuaccgaaaccagagugaugcugaccuagaagccuuacgaaagaaacugucuaacgcaccaaggccucuaaagaaacguaguucuauuacagagccagaggguccuaaugggccaaauauucagaagcuuuuauaucagaggaccaccauagcggccauggagaccaucucugucccaucauacccauccaagucagcuucugugacugccagcucagaaagcccaguagaaauccagaauccauauuuacauguggagcccgaaaaggagguggucucucugguuccugaaucauuguccccagaggauguggggaaugccaguacagagaacagugacaugccagcuccuucuccaggccuugauuaugagccugagggagucccagacaacagcccaaaucuccagaauaacccagaagaaccaaauccagaggcuccacaugugcuugauguguaccuggaggaguacccuccauacccacccccaccauacccaucuggggagccugaagggcccggagaagacucggugagcaugcgcccgccugaaaucaccgggcaggucucucugccuccugguaaaaggacaaacuugcguaaaacuggcucagagcguaucgcucauggaaugagggugaaauucaacccccuugcuuuacugcuagauucgucuuuggagggagaauuugaccuuguacagagaauuauuuaugagguugaugacccaagccuccccaaugaugaaggcaucacggcucuucacaaugcugugugugcaggccacacagaaaucguuaaguuccugguacaguuugguguaaauguaaaugcugcugauagugauggauggacuccauuacauugugcugccucauguaacaacguccaaguguguaaguuuuugguggagucaggagccgcuguguuugccaugaccuacagugacaugcagacugcugcagauaagugcgaggaaauggaggaaggcuacacucagugcucccaauuucuuuauggaguucaggagaagaugggcauaaugaauaaaggagucauuuaugcgcuuugggauuaugaaccucagaaugaugaugagcugcccaugaaagaaggagacugcaugacaaucauccacagggaagacgaagaugaaaucgaaugguggugggcgcgccuuaaugauaaggagggauauguuccacguaacuugcugggacuguacccaagaauuaaaccaagacaaaggagcuuggccugaaacuuccacacagaauuuuagucaaugaagaauuaaucucuguuaagaagaaguaauacgauuauuuuuggcaaaaauuucacaagacuuauuuuaaugacaauguagcuugaaagcgaugaagaaugucucuagaagagaaugaaggauugaagaauucaccauuagaggacauuuagcgugaugaaauaaagcaucuacgucagcaggccauacuguguuggggcaaaggugucccguguagcacucagauaaguauacagcgacaauccuguuuucuacaagaauccugucuaguaaauaggaucauuuauugggcaguugggaaaucagcucucuguccuguugaguguuuucagcagcugcuccuaaaccaguccuccugccagaaaggaccagugccgucacaucgcugucucugauuguccccggcaccagcaggcccuuggggggcucaccugaaggcucgaaggcacugcacacuuguauauugucagugaagaacuguuaguugguugucagugaacaauaacuuuauuauaugaguuuuuguagcaucuuaagaauuauacauauguuugaaauauugaaacuaagcuacgguaccaguaauuagauguagaaucuuguuuguaggcugaauuuuaaucuguauuuauugucuuuuguaucucagaaauuagaaacuugcuacagacuuacccguaauauuugucaagaucauagcugacuuuaaaaacaguuguaauaaacuuuuugaugcuagcuguuuacugguuuuuguuuuugaugucauaaauagaccuuguuuaauagucacaagccguugggauaucauacccagcugaaaaagaacaaacugcuuaacauaaguauauguaucguaauaagaguuuuuuaccagcuaagugauucaauguaagugguuuuuaaaauaaaauacuguagagaucauggugaaaaaaaaaaaaaa

SEQ ID NO: 2 - RNA, 4802 nt, Homo sapiens
gcuggggcccgacccgggauuaguugguuucggagcggaggagggagccccgaccgucacgagcgucgaagagacaaagccgcgucagggggcccggccggggcgggggagcccggggcuuguuggugccccagcccgcgcggagggcccuucggacccgcgcgccgccgcugccgccgccgccgccucgcaacagguccgggcggccucgcucuccgcuccccucccccgcauccgcgacccuccggggcaccucagcucggccggggccgcagucuggccacccgcuuccaugcgguucggguccaagaugaugccgauguuucuuaccguguaucucaguaacaaugagcagcacuucacagaaguuccaguuacuccagaaacaauaugcagagacgugguggaucugugcaaagaacccggcgagagugauugccauuuggcugaagugugguguggcucuguagagauagaguuucaucauguuggccaggauggucucgaucuccugaccuugugauccgccugccucggccucccaaagugcuggauuacaggugugagccaccacgaucagccucuaguguuuaaaaaagaacguccaguugcggauaaugagcgaauguuugauguucuucaacgauuuggaagucagaggaacgaaguucgcuucuuccuucgucaugaacgccccccuggcagggacauugugaguggaccaagaucucaggauccaaguuuaaaaagaaaugguguaaaaguuccuggugaauaucgaagaaaggagaacgguguuaauaguccuaggauggaucugacucuugcugaacuucaggaaauggcaucucgccagcagcaacagauugaagcccagcaacaauugcuggcaacuaaggaacagcgcuuaaaguuuuugaaacaacaagaucagcgacaacagcaacaaguugcugagcaggagaaacuuaaaaggcuaaaagaaauagcugagaaucaggaagcuaagcuaaaaaaagugagagcacuuaaaggccacguggaacagaagagacuaagcaaugggaaacuuguggaggaaauugaacagaugaauaauuuguuccagcaaaaacagagggagcucguccuggcugugucaaaaguagaagaacugaccaggcagcuagagaugcucaagaacggcaggaucgacagccaccaugacaaucagucugcaguggcugagcuugaucgccucuauaaggagcugcagcuaagaaacaaauugaaucaagagcagaaugccaagcuacaacaacagagggaguguuugaauaagcguaauucagaaguggcagucauggauaagcguguuaaugagcugagggaccggcuguggaagaagaaggcagcucuacagcaaaaagaaaaucuaccaguuucaucugauggaaaucuuccccagcaagccgcgucagccccaagccguguggcugcaguaggucccuauauccagucgucuacuaugccucggaugcccucaaggccugaauugcuggugaagccagcccugccggaugguuccuuggucauucaggcuucagaggggccgaugaaaauacagacacugcccaacaugagaucuggggcugcuucacaaacuaaaggcucuaaaauccauccaguuggcccugauuggaguccuucaaaugcagaucuuuucccaagccaaggcucugcuucuguaccucaaagcacugggaaugcucuggaucaaguugaugauggagagguuccgcugagggagaaagagaagaaagugcguccguucucaauguuugaugcaguagaccaguccaaugccccaccuuccuuugguacucugaggaagaaccagagcagugaagauaucuugcgggaugcucagguugcaaauaaaaauguggcuaaaguaccaccuccuguuccuacaaaaccaaaacagauuaauuugccuuauuuuggacaaacuaaucagccaccuucagacauuaagccagacggaaguucucagcaguugucaacaguuguuccguccaugggaacuaaaccaaaaccagcagggcagcagccgagagugcugcuaucucccagcauaccuucgguuggccaagaccagacccuuucuccagguucuaagcaagaaaguccaccugcugcugccguccggcccuuuacuccccagccuuccaaagacaccuuacuuccacccuucagaaaaccccagaccguggcagcaaguucaauauauuccauguauacgcaacagcaggcgccaggaaaaaacuuccagcaggcugugcagagcgcguugaccaagacucauaccagagggccacacuuuucaaguguauaugguaagccuguaauugcugcugcccagaaucaacagcagcacccagagaacauuuauuccaauagccagggcaagccuggcaguccagaaccugaaacagagccuguuucuucaguucaggagaaccaugaaaacgaaagaauuccucggccacucagcccaacuaaauuacugccuuucuuaucuaauccuuaccgaaaccagagugaugcugaccuagaagccuuacgaaagaaacugucuaacgcaccaaggccucuaaagaaacguaguucuauuacagagccagaggguccuaaugggccaaauauucagaagcuuuuauaucagaggaccaccauagcggccauggagaccaucucugucccaucauacccauccaagucagcuucugugacugccagcucagaaagcccaguagaaauccagaauccauauuuacauguggagcccgaaaaggagguggucucucugguuccugaaucauuguccccagaggauguggggaaugccaguacagagaacagugacaugccagcuccuucuccaggccuugauuaugagccugagggagucccagacaacagcccaaaucuccagaauaacccagaagaaccaaauccagaggcuccacaugugcuugauguguaccuggaggaguacccuccauacccacccccaccauacccaucuggggagccugaagggcccggagaagacucggugagcaugcgcccgccugaaaucaccgggcaggucucucugccuccugguaaaaggacaaacuugcguaaaacuggcucagagcguaucgcucauggaaugagggugaaauucaacccccuugcuuuacugcuagauucgucuuuggagggagaauuugaccuuguacagagaauuauuuaugagguugaugacccaagccuccccaaugaugaaggcaucacggcucuucacaaugcugugugugcaggccacacagaaaucguuaaguuccugguacaguuugguguaaauguaaaugcugcugauagugauggauggacuccauuacauugugcugccucauguaacaacguccaaguguguaaguuuuugguggagucaggagccgcuguguuugccaugaccuacagugacaugcagacugcugcagauaagugcgaggaaauggaggaaggcuacacucagugcucccaauuucuuuauggaguucaggagaagaugggcauaaugaauaaaggagucauuuaugcgcuuugggauuaugaaccucagaaugaugaugagcugcccaugaaagaaggagacugcaugacaaucauccacagggaagacgaagaugaaaucgaaugguggugggcgcgccuuaaugauaaggagggauauguuccacguaacuugcugggacuguacccaagaauuaaaccaagacaaaggagcuuggccugaaacuuccacacagaauuuuagucaaugaagaauuaaucucuguuaagaagaaguaauacgauuauuuuuggcaaaaauuucacaagacuuauuuuaaugacaauguagcuugaaagcgaugaagaaugucucuagaagagaaugaaggauugaagaauucaccauuagaggacauuuagcgugaugaaauaaagcaucuacgucagcaggccauacuguguuggggcaaaggugucccguguagcacucagauaaguauacagcgacaauccuguuuucuacaagaauccugucuaguaaauaggaucauuuauugggcaguugggaaaucagcucucuguccuguugaguguuuucagcagcugcuccuaaaccaguccuccugccagaaaggaccagugccgucacaucgcugucucugauuguccccggcaccagcaggcccuuggggggcucaccugaaggcucgaaggcacugcacacuuguauauugucagugaagaacuguuaguugguugucagugaacaauaacuuuauuauaugaguuuuuguagcaucuuaagaauuauacauauguuugaaauauugaaacuaagcuacgguaccaguaauuagauguagaaucuuguuuguaggcugaauuuuaaucuguauuuauugucuuuuguaucucagaaauuagaaacuugcuacagacuuacccguaauauuugucaagaucauagcugacuuuaaaaacaguuguaauaaacuuuuugaugcuagcuguuuacugguuuuuguuuuugaugucauaaauagaccuuguuuaauagucacaagccguugggauaucauacccagcugaaaaagaacaaacugcuuaacauaaguauauguaucguaauaagaguuuuuuaccagcuaagugauucaauguaagugguuuuuaaaauaaaauacuguagagaucauggugaaaaaaaaaaaaaa

SEQ ID NO: 3 - RNA, 3046 nt, Homo sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaagggucgaucugggaccucggacccuggcucugagggccacauccgccuccccccuucccaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 4 - RNA, 3010 nt, Homo sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaa

SEQ ID NO: 5 - RNA, 2902 nt, Homo sapiens
gcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 6 - RNA, 743 nt, Homo sapiens
cgcgccuagcagugucccagccggguucgugucgccauggggcagaucgagugggccaugugggccaacgaacaggcgcuggcguccggccugauccucaucaccgggggcaucguggccacagcugggcgcuucacccagugguacuuuggugccuacuccauuguggcgggcguguuugugugccugcuggaguacccccgggggaagaggaagaagggcuccaccauggagcgcuggggacagaaguacaugaccgccguggugaagcuguucgggcccuuuaccaggaauuacuauguucgggccguccugcaucuccugcucucggugcccgccggcuuccugcuggccaccauccuugggaccgccugccuggccauugcgagcggcaucuaccuacuggcggcugugcguggcgagcaguggacgcccaucgagcccaagccccgggagcggccgcagaucggaggcaccaucaagcagccgcccagcaaccccccgccgcggcccccggccgaggcccgcaagaagcccagcgaggaggaggcugcgguggcggcggggggacccccgggagguccccaggucaaccccaucccggugaccgacgaggucgugugaccucgccccggaccugcccucccgccaggugcacccaccugcaauaaaugcagcgaagccgggaaaaaaaaaaaaaaaaaaaaaaaaaaaaaaaaaaaaaaaaaaaaaaaaaaaaaaaa

SEQ ID NO: 7 - RNA, 1845 nt, Homo sapiens
gacaagaagagaaauccuccucuauauaggaugcucugcuguuuccuaaggauuuucagcaccuugccccaaaaucaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguagccccugaagaagaugaaaggaaaaagaggcgacgagaaagaaauaagauugcagcugcaaagugccgaaacaagaagaaggagaagacggagugccugcagaaagagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaa

SEQ ID NO: 8 - RNA, 2049 nt, Homo sapiens
cgggaagcuauuaauagcauuacgucagccugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggagcaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguagccccugaagaagaugaaaggaaaaagaggcgacgagaaagaaauaagauugcagcugcaaagugccgaaacaagaagaaggagaagacggagugccugcagaaagagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaa

SEQ ID NO: 9 - RNA, 2200 nt, Homo sapiens
cgggaagcuauuaauagcauuacgucagccugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggagcaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguagccccugaagaagaugaaaggaaaaagaggcgacgagaaagaaauaagauugcagcugcaaagugccgaaacaagaagaaggagaagacggagugccugcagaaacugcagcuucaguauuagcagagccacaggccgccucuguggcaucaccaggguuucucugaagaagagggucugcauuuuccuaaacccagugcugcucucccaucucccaucuuccucucgcagcuugaugagccccggugugucccaggagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaa

SEQ ID NO: 10 - RNA, 4145 nt, Homo sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagcacugagggagaccaagcaaggccaccuggaggauauguugcucaccacccuuucugggcuucagcauguacucccaccguugagcugugacuacgacuugagucucccuuuuccggugugugaguccuguccccuuuacaagaagcuccgccugucgacagauacuguggaacacucccuagacaauaaagaugguccugucugccuucaggugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 11 - RNA, 3927 nt, Homo sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 12 - RNA, 2044 nt, Homo sapiens
caaagacaaaauaauuuacuagggaagcccuuacuaacgacccaacauccagacacaggugagggagaagaaauuuccugacagccgaagagcaacaaguaucaugauggggugcuggauuuugaaugagggucucuccaccauauuaguacucucauggcugggaauaaauuuuuaucuguuuauugacacguucuacugguaugaagaggaggagucuuuccauuacacacgaguuauuuuggguucaacacuggcuugggcacgagcauccgcacugugccugaauuuuaacugcaugcuaauucuaauaccugucagucgaaaccuuauuucauucauaagaggaacaaguauuugcugcagaggaccguggaggaggcaauuagacaaaaaccucagauuucacaaacuggucgccuaugggauagcuguuaaugcaaccauccacaucguggcgcauuucuucaaccuggaacgcuaccacuggagccaguccgaggaggcccagggacuucuggccgcacuuuccaagcugggcaacaccccuaacgagagcuaccucaacccuguccggaccuuccccacaaacacaaccacugaauugcuaaggacaauagcaggcgucaccggucuggugaucucucuggcuuuagucuugaucaugaccucgucaacugaguucaucagacaggccuccuaugaguuguucugguacacacaccauguuuucaucgucuucuuucucagccuggccauccaugggacgggucggauuguucgaggccaaacccaagacagucucucucugcacaacaucaccuucuguagagaccgcuaugcagaauggcagacaguggcccaaugccccgugccucaauuuucuggcaaggaacccucggcuuggaaauggauuuuaggcccuguggucuuguaugcaugugaaagaauaauuagguucuggcgauuucaacaagaaguugucauuaccaaggugguaagccaccccucuggaguccuggaacuucacaugaaaaagcguggcuuuaaaauggcgccagggcaguacaucuuggugcagugcccagccauaucuucgcuggaguggcaccccuucacccuuaccucugccccccaggaagacuuuuucagcgugcacauccgggcagcaggagacuggacagcagcgcuacuggaggccuuuggggcagagggacaggcccuccaggagcccuggagccugccaaggcuggcaguggacgggcccuuuggaacugcccugacagauguauuucacuacccagugugugugugcguugccgcggggaucggagucacucccuucgcugcucuucugaaaucuauaugguacaaaugcagugaggcacagaccccacugaagcugagcaagguguauuucuacuggauuugccgggaugcaagagcuuuugagugguuugcugaucucuuacucucccuggaaacacggaugagugagcaggggaaaacucacuuucugaguuaucauauauuucuuaccggcugggaugaaaaucaggcucuucacauagcuuuacacugggacgaaaauacugacgugauuacaggcuuaaagcagaagaccuucuaugggaggcccaacuggaacaaugaguucaagcagauugccuacaaucaccccagcagcaguauuggcguguucuucuguggaccuaaagcucucucgaggacacuucaaaagaugugccacuuguauucaucagcugaccccagagguguucauuucuauuacaacaaggagagcuucuagacuuuggaggucaaguccaggcauuguguuuucaaucaaguuauugauuccaaagaacuccaccaggaauuccugugacggccuguugauaugagcucccaguugggaacuggugaauaauaauuaacuauugugaacaguacacuauaccauacuuccuuagcuuauaaauaacaugucauauacaacagaacaaaaacauuuacugaaauuaaaauauauuauguuucucca

SEQ ID NO: 13 - RNA, 716 nt, Homo sapiens
gaaacuugguguccaggggaggcccccggcggcuggagcgcggcggcagcgggcgcagaggccggagggagaggaggcgaggggcggcccgagcgcggggcgggagcgaggccagcggucaugugcccgugcccccugcaccgcggccgcggccccccggccgugugcgccugcagcgcgggucgccuggggcugcgcucguccgccgcgcagcucaccgccgcccggcucaaggcgcuaggcgacgagcugcaccagcgcaccauguggcggcgccgcgcgcggagccggagggcgccggcgcccggcgcgcuccccaccuacuggccuuggcugugcgcggccgcgcagguggcggcgcuggcggccuggcugcucggcaggcggaacuuguaggaacgcggggcuucuugguggggccggagccgagacccagccggagcgagcaacagguuggugaaaacccuguguccuuggagaaagcugguucccguuuuccagagggggagcccagagcuugaaaggccgcgguuggcacuucgagaaggaaguggagaguaaagacagcgccuggagcgaucguagaaacacagaaugggacuggggaagcccuuuggaaauccagcugcagaaacagacaccccaaugcuauuuacauacagcucuauauauauaaaaaaagaaaauaugaauauuaaaaaaaaaaaaaaaaaaaa

SEQ ID NO: 14 - RNA, 1163 nt, Homo sapiens
ccggcggcgccucaggucgcggggcgccuaggccuggguuguccuuugcaucugcacguguucgcagucguuuccgcgaugcugccucugcugcgcugcgugccccgugugcugggcuccuccgucgccggccuccgcgcugccgcgcccgccucgccuuuccggcagcuccugcagccggcaccccggcugugcacccggcccuucgggcugcucagcgugcgcgcagguuccgagcggcggccgggccuccugcggccucgcggacccugcgccuguggcuguggcugcggcucgcugcacaccgacggagacaaagcuuuuguugauuuccugagugaugaaauuaaggaggaaagaaaaauucagaagcauaaaacccucccuaagaugucuggagguugggagcuggaacugaaugggacagaagcgaaauuagugcggaaaguugccggggaaaaaaucacggucacuuucaacauuaacaacagcaucccaccaacauuugauggugaggaggaacccucgcaagggcagaagguugaagaacaggagccugaacugacaucaacucccaauuucgugguugaaguuauaaagaaugaugauggcaagaaggcccuuguguuggacugucauuauccagaggaugagguuggacaagaagacgaggcugagagugacaucuucucuaucagggaaguuagcuuucaguccacuggcgagucugaauggaaggauacuaauuauacacucaacacagauuccuuggacugggccuuauaugaccaccuaauggauuuccuugccgaccgagggguggacaacacuuuugcagaugagcugguggagcucagcacagcccuggagcaccaggaguacauuacuuuucuugaagaccucaagaguuuugucaagagccaguagagcagacagaugcugaaagccauaguuucauggcaggcuuuggccagugaacaaauccuacucugaagcuagacaugugcuuugaaaugauuaucauccuaauaucaugggggaaaaaauaccaaauuuaaauuauauguuuuguguucucauuuauuaucauuuuuuucuguacaaaucuauuauuucuagauuuuuguauaacaugauagacauaaaauugguuuaucuccucc

SEQ ID NO: 15 - RNA, 1535 nt, Homo sapiens
ccuccgcucaguccgggagcgcacgugggccgcggcgcuccgaccuccgcuuucccaccgcccgcagcugaagcacaucccgcagcccggcgcggacuccgaucgccgcaguugcccucuggcgccaugucgcagaacggagcgcccgggaugcaggaggagagccugcagggcuccuggguagaacugcacuucagcaauaaugggaacgggggcagcguuccagccucgguuucuauuuauaauggagacauggaaaaaauacugcuggacgcacagcaugagucuggacggaguagcuccaagagcucucacugugacagcccaccucgcucgcagacaccacaagauaccaacagggcuucugaaacagauacccauagcauuggagagaaaaacagcucacagucugaggaagaugauauugaaagaaggaaagaaguugaaagcaucuugaagaaaaacucagauuggauaugggauuggucaagucggccggaaaauauuccccccaaggaguuccucuuuaaacacccgaagcgcacggccacccucagcaugaggaacacgagcgucaugaagaaagggggcauauucucugcagaauuucugaaaguuuuccuuccaucucugcugcucucucauuugcuggccaucggauuggggaucuauauuggaaggcgucugacaaccuccaccagcaccuuuugaugaagaacuggagucugacuugguucguuaguggauuacuucugagcuugcaacauagcucacugaagagcuguuagauccugggguggccacgucacuuguguuuauuuguucuguaaaugcugcguuccuaauuuaguaaaauaaaagaauagacacuaaaaucauguugaucuauaauuacaccuaugggaucaauaagcaugucagacugauuaaugucuacugugaaaauuugguaguaaauuuucauuugauauuagauauaaauaucugaauauaaauaauuuuaauauacuagucaugauguguguuguauuuuaaaaauuaucugcaaccuuaauucagcugaaguacuuuauauuucaaaagaaugaauaacauugauaauaaaaucgcuacuuuaagggguuuguccaaaauaaauauuguggccuuauauaucacacuauuguagaaaguauuauuuaauuuaaauggaugcagguugucuacuaaagaaagauuauauauaacuaugcuaauuguucauaaucaacagaaaccaagauagagcuacaaacucagcuguacaguucguacacuaaacucuucuugcuuuugcauuauaaggaauuaagucuccgauuauuaggugaucacccuggaugaucaguuuucugcugaaggcaccuacucaguaucuuuuccucuuuaucacucugcauuggugaauuuaauccucuccuuuguguucaacuuuugugugcuuuuaaaaucagcuuuauucuaagcaaaucugugucuacuuuaaaaaacuggaaauggaaaaaaaaauaaaucuu

SEQ ID NO: 16 - RNA, 1417 nt, Homo sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguggauuuauggucuguggggugcauuaugggagaaaugguuugccacaaaauccucuuuccaggaagggacuauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuagcacaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 17 - RNA, 1412 nt, Homo sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguggauuuauggucuguggggugcauuaugggagaaaugguuugccacaaaauccucuuuccaggaagggacuauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 18 - RNA, 1417 nt, Homo sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguugacauuuggucaguugggugcaucaugggagaaaugaucaaaggugguguuuuguucccagguacagaucauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuagcacaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 19 - RNA, 1412 nt, Homo sapiens
auuaauugcuugccaucaugagcagaagcaagcgugacaacaauuuuuauaguguagagauuggagauucuacauucacaguccugaaacgauaucagaauuuaaaaccuauaggcucaggagcucaaggaauaguaugcgcagcuuaugaugccauucuugaaagaaauguugcaaucaagaagcuaagccgaccauuucagaaucagacucaugccaagcgggccuacagagagcuaguucuuaugaaauguguuaaucacaaaaauauaauuggccuuuugaauguuuucacaccacagaaaucccuagaagaauuucaagauguuuacauagucauggagcucauggaugcaaaucuuugccaagugauucagauggagcuagaucaugaaagaauguccuaccuucucuaucagaugcuguguggaaucaagcaccuucauucugcuggaauuauucaucgggacuuaaagcccaguaauauaguaguaaaaucugauugcacuuugaagauucuugacuucggucuggccaggacugcaggaacgaguuuuaugaugacgccuuauguagugacucgcuacuacagagcacccgaggucauccuuggcaugggcuacaaggaaaacguugacauuuggucaguugggugcaucaugggagaaaugaucaaaggugguguuuuguucccagguacagaucauauugaucaguggaauaaaguuauugaacagcuuggaacaccauguccugaauucaugaagaaacugcaaccaacaguaaggacuuacguugaaaacagaccuaaauaugcuggauauagcuuugagaaacucuucccugauguccuuuucccagcugacucagaacacaacaaacuuaaagccagucaggcaagggauuuguuauccaaaaugcugguaauagaugcaucuaaaaggaucucuguagaugaagcucuccaacacccguacaucaaugucugguaugauccuucugaagcagaagcuccaccaccaaagaucccugacaagcaguuagaugaaagggaacacacaauagaagaguggaaagaauugauauauaaggaaguuauggacuuggaggagagaaccaagaauggaguuauacgggggcagcccucuccuuuaggugcagcagugaucaauggcucucagcauccaucaucaucgucgucugucaaugaugugucuucaaugucaacagauccgacuuuggccucugauacagacagcagucuagaagcagcagcugggccucugggcugcuguagaugacuacuugggccaucggggggugggagggauggggagucgguuagucauugauagaacuacuuugaaaacaauucaguggucuuauuuuugggugauuuuucaaaaaaugua

SEQ ID NO: 20 - RNA, 3757 nt, Homo sapiens
ggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaaucccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuu

SEQ ID NO: 21 - RNA, 3679 nt, Homo sapiens
ggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucucugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaaccucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaaucccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuu

SEQ ID NO: 22 - RNA, 3757 nt, Homo sapiens
ggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauuaaccagcuucagcagauuaugcgucugacaggaacaccccccgcuuaucucauuaacaggaugccaagccaugaggcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaaucccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuu

SEQ ID NO: 23 - RNA, 1312 nt, Homo sapiens
ggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggguaaguugaccauauauccucaccucauggauauugaauugguuaugauauaaauuggggauuugaagaagaguuucuccuuuugaccaaauaaaguaccauuaguuga

SEQ ID NO: 24 - RNA, 2413 nt, Homo sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggaaacaagaaucucaguguaacccgagcaaaaucgcgcgucucagcguugcuuguauagagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucauaaaaaaaaaaaaaaa

SEQ ID NO: 25 - RNA, 2412 nt, Homo sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacaguuggagaaacguacgguaaggauauaaccucccggggcaaagacaagccgauugccgauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucauaaaaaaaaaaaaaaa

SEQ ID NO: 26 - RNA, 2355 nt, Homo sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucauaaaaaaaaaaaaaaa

SEQ ID NO: 27 - RNA, 1639 nt, Homo sapiens
aucaucuauauguuaaauauccgugccgaucugucuugaaggagaaauauaucgcuuguuuuguuuuuuauaguauacaaaaggagugaaaagccaagaggacgaagucuuuuucuuuuucuucugugggagaacuuaaugcugcauuuaucguuaaccuaacaccccaacauaaagacaaaaggaagaaaaggaggaaggaaggaaaaggugauucgcgaagagagugaucaugucagggcggcccagaaccaccuccuuugcggagagcugcaagccggugcagcagccuucagcuuuuggcagcaugaaaguuagcagagacaaggacggcagcaaggugacaacagugguggcaacuccugggcaggguccagacaggccacaagaagucagcuauacagacacuaaagugauuggaaauggaucauuuggugugguauaucaagccaaacuuugugauucaggagaacuggucgccaucaagaaaguauugcaggacaagagauuuaagaaucgagagcuccagaucaugagaaagcuagaucacuguaacauaguccgauugcguuauuucuucuacuccaguggugagaagaaagaugaggucuaucuuaaucuggugcuggacuauguuccggaaacaguauacagaguugccagacacuauagucgagccaaacagacgcucccugugauuuaugucaaguuguauauguaucagcuguuccgaaguuuagccuauauccauuccuuuggaaucugccaucgggauauuaaaccgcagaaccucuuguuggauccugauacugcuguauuaaaacucugugacuuuggaagugcaaagcagcugguccgaggagaacccaauguuucguauaucuguucucgguacuauagggcaccagaguugaucuuuggagccacugauuauaccucuaguauagauguauggucugcuggcuguguguuggcugagcuguuacuaggacaaccaauauuuccaggggauagugguguggaucaguugguagaaauaaucaagguccugggaacuccaacaagggagcaaaucagagaaaugaacccaaacuacacagaauuuaaauucccucaaauuaaggcacauccuuggacuaaggauucgucaggaacaggacauuucaccucaggagugcgggucuuccgaccccgaacuccaccggaggcaauugcacuguguagccgucugcuggaguauacaccaacugcccgacuaacaccacuggaagcuugugcacauucauuuuuugaugaauuacgggacccaaaugucaaacuaccaaaugggcgagacacaccugcacucuucaacuucaccacucaagaacugucaaguaauccaccucuggcuaccauccuuauuccuccucaugcucggauucaagcagcugcuucaacccccacaaaugccacagcagcgucagaugcuaauacuggagaccguggacagaccaauaaugcugcuucugcaucagcuuccaacuccaccugaacagucccgagcagccagcugcacaggaaaaaccaccaguuacuugagugucacucagcaacacuggucacguuuggaaagaauauuaaaaaaaaaaaaaaaaaa

SEQ ID NO: 28 - RNA, 3155 nt, Homo sapiens
guuucauuuugcaguuacugggagggggcuugcuguggcccugucaggaagaguagagcucugguccagcuccgcgcagggagggaggcugucaccaugccggccugcugcagcugcagugauguuuuccaguaugagacgaacaaagucacucggauccagagcaugaauuauggcaccauuaagugguucuuccacgugaucaucuuuuccuacguuugcuuugcucuggugagugacaagcuguaccagcggaaagagccugucaucaguucugugcacaccaaggugaaggggauagcagaggugaaagaggagaucguggagaauggagugaagaaguuggugcacagugucuuugacaccgcagacuacaccuucccuuugcaggggaacucuuucuucgugaugacaaacuuucucaaaacagaaggccaagagcagcgguugugucccgaguaucccacccgcaggacgcucuguuccucugaccgagguuguaaaaagggauggauggacccgcagagcaaaggaauucagaccggaagguguguaguguaugaagggaaccagaagaccugugaagucucugccuggugccccaucgaggcaguggaagaggccccccggccugcucucuugaacagugccgaaaacuucacugugcucaucaagaacaauaucgacuuccccggccacaacuacaccacgagaaacauccugccagguuuaaacaucacuuguaccuuccacaagacucagaauccacagugucccauuuuccgacuaggagacaucuuccgagaaacaggcgauaauuuuucagauguggcaauucagggcggaauaaugggcauugagaucuacugggacugcaaccuagaccguugguuccaucacugccgucccaaauacaguuuccgucgccuugacgacaagaccaccaacguguccuuguacccuggcuacaacuucagauacgccaaguacuacaaggaaaacaauguugagaaacggacucugauaaaagucuucgggauccguuuugacauccugguuuuuggcaccggaggaaaauuugacauuauccagcugguuguguacaucggcucaacccucuccuacuucggucuggccgcuguguucaucgacuuccucaucgacacuuacuccaguaacugcugucgcucccauauuuaucccuggugcaagugcugucagcccuguguggucaacgaauacuacuacaggaagaagugcgaguccauuguggagccaaagccgacauuaaaguauguguccuuuguggaugaaucccacauuaggauggugaaccagcagcuacuagggagaagucugcaagaugucaagggccaagaagucccaagaccugcgauggacuucacagauuuguccaggcugccccuggcccuccaugacacacccccgauuccuggacaaccagaggagauacagcugcuuagaaaggaggcgacuccuagauccagggauagccccgucuggugccaguguggaagcugccucccaucucaacucccugagagccacaggugccuggaggagcugugcugccggaaaaagccgggggccugcaucaccaccucagagcuguucaggaagcugguccuguccagacacguccugcaguuccuccugcucuaccaggagcccuugcuggcgcuggauguggauuccaccaacagccggcugcggcacugugccuacaggugcuacgccaccuggcgcuucggcucccaggacauggcugacuuugccaaccugcccagcugcugccgcuggaggauccggaaagaguuuccgaagagugaagggcaguacaguggcuucaagaguccuuacugaagccaggcaccguggcucacgucuguaaucccagcgcuuugggaggccgaggcaggcagaucaccugaggucgggaguuggagacccgccuggcuaacaaggcgaaauccugucuguacuaaaaauacaaaaaucagccagacaugguggcaugcaccugcaaucccagcuacucgggaggcugaggcacaagaaucacuugaacccgggaggcagagguuguagugagcccagauugugccacugcucuccagccugggaggcacagcaaacugucccccaaaaaaaaaaaagaguccuuaccaauagcaggggcugcaguagccauguuaacaugacauuuaccagcaacuugaacuucaccugcaaagcucuguggccacauuuucagccaaagggaaauaugcuuucaucuucuguugcucucugugucugagagcaaagugaccugguuaaacaaaccagaaucccucuacauggacucagagaaaagagauugagauguaagucucaacucuguccccaggaaguugugugacccuaggccucucaccucugugccucugucuccuuguugcccaacuacuaucucagagauauugugaggacaaauugagacagugcacaugaacugucuuuuaauguguaaagaucuacaugaaugcaaaacauuucauuaugaggucagacuaggauaauguccaacuaaaaacaaacccuuuucauccuggcuggagaauguggagaacuaaagguggccacaaauucuuugacacucaagucccccaagaccuaaggguuuuaucuccuccccuugaauauggguggcucugauugcuuuauccaaaaguggaagugacauugugucaguuucagauccugaucuuaagaggcugacagcuucuacuugcugucccuuggaacucuugcuaucggggaagccagacgccauuuaaaagucugccuauccuggccaggugugguggcucacaccuguaaucccagcacuuugggagaccaaggcgggcggaucacuuaaagucaggaguccaagaccagacucgccaacauggugaaaccguaucucuaauaaaaauacaaaaauuagcugggcauggugcgggcaccuguaguccuagcuaucaagaggcugagacaggagaaacacuugaaccugggagguggagguugcauugagcugagaucgugccacugcacuccaggcugggugacagagcgagacuccaucucaaaaaaaaaaaaaagaaaaa

SEQ ID NO: 29 - RNA, 5876 nt, Homo sapiens
caaccaccccaugugucucuagaaccccaguguagcgagcuggagagaggacuguccugagggcagcaggccugguugcagcuggcgugggggucucagaauggagcccucagcccugaggaaagcuggcucggagcaggaggagggcuuugaggggcugcccagaagggucacugaccuggggauggucuccaaucuccggcgcagcaacagcagccucuucaagagcuggaggcuacagugccccuucggcaacaaugacaagcaagaaagccucaguucguggauuccugaaaacaucaagaagaaagaaugcguguauuuuguggaaaguuccaaacugucugaugcugggaagguggugugucaguguggcuacacgcaugagcagcacuuggaggaggcuaccaagccccacaccuuccagggcacacagugggacccaaagaaacauguccaggagaugccaaccgaugccuuuggcgacaucgucuucacgggccugagccagaaggugaaaaaguacguccgagucucccaggacacgcccuccagcgugaucuaccaccucaugacccagcacugggggcuggacguccccaaucucuugaucucggugaccgggggggccaagaacuucaacaugaagccgcggcugaagagcauuuuccgcagaggccuggucaagguggcucagaccacaggggccuggaucaucacaggggggucccacaccggcgucaugaagcagguaggcgaggcggugcgggacuucagccugagcagcagcuacaaggaaggcgagcucaucaccaucggagucgccaccuggggcacuguccaccgccgcgagggccugauccaucccacgggcagcuuccccgccgaguacauacuggaugaggauggccaagggaaccugaccugccuagacagcaaccacucucacuucauccucguggacgacgggacccacggccaguacgggguggagauuccucugaggaccaggcuggagaaguucauaucggagcagaccaaggaaagaggagguguggccaucaagauccccaucgugugcguggugcuggagggcggcccgggcacguugcacaccaucgacaacgccaccaccaacggcacccccugugugguuguggagggcucgggccgcguggccgacgucauugcccagguggccaaccugccugucucggacaucacuaucucccugauccagcagaaacugagcguguucuuccaggagauguuugagaccuucacggaaagcaggauugucgaguggaccaaaaagauccaagauaucguccggaggcggcagcugcugacugucuuccgggaaggcaaggauggucagcaggacguggauguggccaucuugcaggccuugcugaaagccucacggagccaagaccacuuuggccacgagaacugggaccaccagcugaaacuggcaguggcauggaaucgcguggacauugcccgcagugagaucuucauggaugaguggcaguggaagccuucagaucugcaccccacgaugacagcugcacucaucuccaacaagccugaguuugugaagcucuuccuggagaacggggugcagcugaaggaguuugucaccugggacaccuugcucuaccuguacgagaaccuggaccccuccugccuguuccacagcaagcugcagaaggugcugguggaggaucccgagcgcccggcuugcgcgcccgcggcgccccgccugcagaugcaccacguggcccaggugcugcgggagcugcugggggacuucacgcagccgcuuuauccccggccccggcacaacgaccggcugcggcuccugcugcccguuccccacgucaagcucaacgugcagggagugagccuccggucccucuacaagcguuccucaggccaugugaccuucaccauggaccccauccgugaccuucucauuugggccauuguccagaaccgucgggagcuggcaggaaucaucugggcucagagccaggacugcaucgcagcggccuuggccugcagcaagauccugaaggaacuguccaaggaggaggaggacacggacagcucggaggagaugcuggcgcuggcggaggaguaugagcacagagccaucggggucuucaccgagugcuaccggaaggacgaagagagagcccagaaacugcucacccgcguguccgaggccugggggaagaccaccugccugcagcucgcccuggaggccaaggacaugaaguuugugucucacgggggcauccaggccuuccugaccaaggugugguggggccagcucuccguggacaaugggcuguggcgugugacccugugcaugcuggccuucccgcugcuccucaccggccucaucuccuucagggagaagaggcugcaggaugugggcacccccgcggcccgcgcccgugccuucuucaccgcacccgugguggucuuccaccugaacauccucuccuacuucgccuuccucugccuguucgccuacgugcucaugguggacuuccagccugugcccuccuggugcgagugugccaucuaccucuggcucuucuccuuggugugcgaggagaugcggcagcucuucuaugacccugacgagugcgggcugaugaagaaggcagccuuguacuucagugacuucuggaauaagcuggacgucggcgcaaucuugcucuucguggcagggcugaccugcaggcucaucccggcgacgcuguaccccgggcgcgucauccucucucuggacuucauccuguucugccuccggcucaugcacauuuuuaccaucaguaagacgcuggggcccaagaucaucauugugaagcggaugaugaaggacgucuucuucuuccucuuccugcuggcugugugggugguguccuucgggguggccaagcaggccauccucauccacaacgagcgccggguggacuggcuguuccgaggggccgucuaccacuccuaccucaccaucuucgggcagaucccgggcuacaucgacggugugaacuucaacccggagcacugcagccccaauggcaccgaccccuacaagccuaagugccccgagagcgacgcgacgcagcagaggccggccuucccugaguggcugacgguccuccuacucugccucuaccugcucuucaccaacauccugcugcucaaccuccucaucgccauguucaacuacaccuuccagcaggugcaggagcacacggaccagauuuggaaguuccagcgccaugaccugaucgaggaguaccacggccgccccgccgcgccgccccccuucauccuccucagccaccugcagcucuucaucaagagggugguccugaagacuccggccaagaggcacaagcagcucaagaacaagcuggagaagaacgaggaggcggcccugcuauccugggagaucuaccugaaggagaacuaccuccagaaccgacaguuccagcaaaagcagcggcccgagcagaagaucgaggacaucagcaauaagguugacgccaugguggaccugcuggaccuggacccacugaagaggucgggcuccauggagcagagguuggccucccuggaggagcagguggcccagacagcccgagcccugcacuggaucgugaggacgcugcgggccagcggcuucagcucggaggcggacguccccacucuggccucccagaaggccgcggaggagccggaugcugagccgggaggcaggaagaagacggaggagccgggcgacagcuaccacgugaaugcccggcaccuccucuaccccaacugcccugucacgcgcuuccccgugcccaacgagaaggugcccugggagacggaguuccugaucuaugacccacccuuuuacacggcagagaggaaggacgcggccgccauggaccccaugggagacacccuggagccacuguccacgauccaguacaacgugguggauggccugagggaccgccggagcuuccacgggccguacacagugcaggccggguugccccugaaccccaugggccgcacaggacugcgugggcgcgggagccucagcugcuucggacccaaccacacgcuguaccccauggucacgcgguggaggcggaacgaggauggagccaucugcaggaagagcauaaagaagaugcuggaagugcugguggugaagcucccucucuccgagcacugggcccugccugggggcucccgggagccaggggagaugcuaccucggaagcugaagcggauccuccggcaggagcacuggccgucuuuugaaaacuugcugaagugcggcauggagguguacaaaggcuacauggaugacccgaggaacacggacaaugccuggaucgagacgguggccgucagcguccacuuccaggaccagaaugacguggagcugaacaggcugaacucuaaccugcacgccugcgacucgggggccuccauccgauggcaggugguggacaggcgcaucccacucuaugcgaaccacaagacccuccuccagaaggcagccgcugaguucggggcucacuacugacugugcccucaggcugggcggcuccaguccauagacguuccccccagaaaccagggcuucucucuccugagccuggccaggacucaggcuguuccugggcccugcacaugaugggguuugguggacccagugccccucacggcugccgcaagucugcugcagaugaccucaugaacuggaaggggucaaggugacccgggaggagagcucaagacagggcacaggcuacucagagcugaggggccccugggacccuuggccaucaggcgaggggcugggccugugcagcugggcccuuggccagaguccacucccuuccuggcugugucaccccgagcagcucauccaccauggaggucauuggccugaggcaaguuccccggagagucgggguccccuguggcccccucaggccuaugucugugaggaaggggcccugccacucuccccaagagggccuccauguuucgaggugccucaacauggagccuugccuggccugggcuaggggcacugucugaacuccugacugucaggauaaacuccguggggguacaggagcccagacaaagcccaggccugucaagagacgcagagggccccugccaggguuggccccagggacccugggacgaggcugcagaagcucucccucccuacucccugggagccacgugcuggccauguggccagggacggcaugagcaggaggcggggacgugggggccuucugguuuggugucaacagcucacaggagcgugaaccaugagggcccucaggaggggaacgugguaaaacccaagacauuaaaucugccaucucaggccuggcuggcucuucugugcuuuccacaaauaaaguuccugacacguccagggccaggggcugugugacggcugccugaaguucuccucgaucccccggugagcuuccugcagccuguggauguccugcagccccucagcccuacccccaaguuucuccucugacccaucagcucccugucuucauuuuccuaaaccugggcuccagcaucguccccaagcccaccaggccaggaugcaggcauccacaugcccuccuccuuggcuuccccugcgugguggugccaaugugcccuggcaccccugcagaggcuccggauggagccuggggcugccuggccacugagcacuggccgaggugaugcccacccuucccuggacaggccucugucuuccaccugacccaaagcucucuagccacccccuuguccccagguau

SEQ ID NO: 30 - RNA, 5876 nt, Homo sapiens; identical to SEQ ID NO: 29

SEQ ID NO: 31 - RNA, 4276 nt, Homo sapiens
cgguggugggaaagugaacgaaucccgaaucaaagcggcgcauugaggcagguggggugccaguggaagagagaaagcaggcgaguguuuacggccugacuugggaggccggcggaucagcaauugcagaagcaggcagcggcagagagggaauggugcaggcaggcgcugagaaggacgcgcaguccaucucucucagguuagugaaaugaggcucuccgcccggggccggcccggggacagugcgcugcuggucccagcaugaaugcgggccccggcugugaacccugcaccaagcgaccccgcuggggcgccgcuacaacuucgccggcugcuucggacgcccggagcuuucccagcaggcagaggcgcguccucgaccccaaggacgcucacgugcaguucagggucccaccguccucgccagccugcgucccagggcgggcgggacagcacagaggcagcgccaccucgcuuguuuucaaacaaaagacuauuaccaguuggauggacacuaaaggaaucaagacagcggaaucagaaaguuuggauaguaaagaaaacaacaauacaagaauagaauccaugaugaguucuguacaaaaagauaacuuuuaccaacauaauguagaaaaauuagaaaauguuucucagcuaagucuugauaagucacccacugaaaaaaguacacaguauuugaaccagcaucagacugcagcaauguguaaguggcaaaaugaagggaaacacacggagcagcuuuuggaaagugaaccucaaacaguaacccugguaccagagcaguuuaguaaugcuaacauugaucggucaccucaaaaugaugaucacagugacacagauagugaagagaauagagacaaucaacaguuucucacaacuguaaagcuugcaaaugcaaagcagacuacggaagaugaacaggccagagaagccaaaagccaccagaagugcagcaagucuugcgauccuggggaagacugugcaaguugucagcaagaugagauagauguggugccagagaguccauugucagauguuggcucugaggauguugguacugggccaaaaaaugacaacaaauugacuagacaagaaaguugccuaggaaauucuccuccauuugagaaggaaagugaacccgagucaccgauggauguggauaauucuaaaaauaguugucaagacucagaagcagaugaggagacaaguccagguuuugaugaacaagaagaugguaguuccucccaaacagcaaauaaaccuucaagguuccaagcaagagacgcugacauugaauuuaggaaacgguacucuacuaagggcggugaaguuagauuacauuuccaauuugaaggaggagagagucgcacuggaaugaaugauuuaaaugcuaaacuaccuggaaauauuucuagccugaauguagaaugcagaaauucuaagcaacauggaaaaaaggauucuaaaaucacagaucauuucaugagacugcccaaagcagaggacagaagaaaagaacagugggaaaccaaacaucaaagaacagaaaggaagaucccuaaauacguuccaccucaccuuucuccagauaagaaguggcuuggaacucccauugaggagaugagaagaaugccucggugugggauccggcugccucucuugagaccaucugccaaucacacaguaacuauucggguagaucuuuugcgagcaggagaaguuccuaaaccuuuuccaacacauuauaaagauuugugggauaacaagcauguuaaaaugccuuguucagaacaaaauuuguacccaguggaagaugagaauggugagcgaacugcggggagccggugggagcucauucagacugcacuucucaacaaauuuacacgaccccaaaacuugaaggaugcuauucugaaauacaauguggcauauucuaagaaaugggacuuuacagcuuugaucgauuucugggauaagguacuugaagaagcagaagcucaacauuuauaucaguccaucuugccugauauggugaaaauugcacucugucugccaaauauuugcacccagccaauaccacuccugaaacagaagaugaaucauuccaucacaaugucgcaggaacagauugccagucuuuuagcuaaugcuuucuucugcacauuuccacgacgaaaugcuaagaugaaaucggaguauucuaguuacccagacauuaacuucaaucgauuguuugagggacguucaucaaggaaaccggagaaacuuaaaacgcucuucugcuacuuuagaagagucacagagaaaaaaccuacuggguuggugacauuuacaagacagagucuugaagauuuuccagaaugggaaagaugugaaaaacccuugacacgauugcaugucacuuacgaagguaccauagaagaaaauggccaaggcaugcuacagguggauuuugcaaaucguuuuguuggaggugguguaaccagugcaggacuugugcaagaagaaauccgcuuuuuaaucaauccugaguugauuauuucacggcucuucacugaggugcuggaucacaaugaaugucuaauuaucacagguacugagcaguacagugaauacacaggcuaugcugagacauaucguuggucccggagccacgaagaugggagugaaagggacgacuggcagcggcgcugcacugagaucguugccaucgaugcucuucacuucagacgcuaccucgaucaguuugugccugagaaaaugagacgcgagcugaacaaggcuuacuguggauuucuccguccuggaguuucuucagagaaucuuucugcaguggccacaggaaacuggggcuguggugccuuugggggugaugccagguuaaaagccuuaauacagauauuggcagcugcugcagcugagcgagaugugguuuauuucaccuuuggggacucagaauugaugagagacauuuacagcaugcacauuuuccuuacugaaaggaaacucacuguuggagauguguauaagcuguugcuacgauacuacaaugaagaaugcagaaacuguuccaccccuggaccagacaucaagcuuuauccauucauauaccaugcugucgaguccugugcagagaccgcugaccauucagggcaaaggacagggaccugaggagccgagcgaauagcaucuccucccaccucccaccagagacguccuguuugagcugucagguguaauauaugaauugacuuaaguuaauauaaauguguacauaauccacauuuguagucaaggacgcaaucucuuccacacaugugcaguugucaguugguacaucuaaacucccuccauccugacucacguggacuuagauauguuuuguuucuauuuucuucuauuucaguuuuucauucuuugauguuuauuucuuuuguccaucagaucucuugugaaaucccauggaagguugugcucagccugucgggucucuuucuuccugcccauauauuauaccaguugcuucugcagcccgcagaugccagcgaugccaggaaacaaguugaaauccaggaaucucuuuaacugauuuugcuaaaaaucucccugugagccuuccacucaacucuuaauaugcuugcauuguuuaaguuuuuaaauucugaaaauuaauaauuaggguuuuuuucauauguguugcauaaugcaaaccuccuagguuaaaauaguuucuuuauuuaagauagaauaauuuccagaaauuguacuuuugagguaucauuuuuaucuguaaugguuugucugucuuuuuuccucugaucaguauuuuuuuauaccaguuuuggagacuggcugagaugaaaggaaauguggaauaaaaggagguuuuccugaugugguguaaagaaaacagauucaagagaauugaagauuuuuuuuguuucuugguacuuuuuucuuuuuaaauuaggacuaauguuucuuuuguggugcuugaggcauauucauauaaccaaaguuugagaacugggaacuucaugcugauuuguacauauugaaguuucucugguauucaaagguuauauagugaaugaauuuucauuaauaaaucacuuugucagaaacucccauaucaucuauauuuuauauauguauauauaaacguaugcucuuuaagugugucuauaugugagcacauaaaaucuaaauaaaauuggacuggugggaaacaaaaaaaaaaaaaaaaaaaaaaaaa

SEQ ID NO: 32 - RNA, 1494 nt, Homo sapiens
agugaaacagaaggggaggugcaguuucagaacccagccagccucucucuugcugccuagccuccugccggccucaucuucgcccagccaaccccgccuggagcccuauggccaacugcgaguucagcccgguguccggggacaaacccugcugccggcucucuaggagagcccaacucugucuuggcgucaguauccugguccugauccucgucguggugcucgcgguggucgucccgagguggcgccagcaguggagcgguccgggcaccaccaagcgcuuucccgagaccguccuggcgcgaugcgucaaguacacugaaauucauccugagaugagacauguagacugccaaaguguaugggaugcuuucaagggugcauuuauuucaaaacauccuugcaacauuacugaagaagacuaucagccacuaaugaaguugggaacucagaccguaccuugcaacaagauucuucuuuggagcagaauaaaagaucuggcccaucaguucacacagguccagcgggacauguucacccuggaggacacgcugcuaggcuaccuugcugaugaccucacaugguguggugaauucaacacuuccaaaauaaacuaucaaucuugcccagacuggagaaaggacugcagcaacaacccuguuucaguauucuggaaaacgguuucccgcagguuugcagaagcugccugugaugugguccaugugaugcucaauggaucccgcaguaaaaucuuugacaaaaacagcacuuuugggaguguggaaguccauaauuugcaaccagagaagguucagacacuagaggccugggugauacaugguggaagagaagauuccagagacuuaugccaggaucccaccauaaaagagcuggaaucgauuauaagcaaaaggaauauucaauuuuccugcaagaauaucuacagaccugacaaguuucuucagugugugaaaaauccugaggauucaucuugcacaucugagaucugagccagucgcugugguuguuuuagcuccuugacuccuugugguuuaugucaucauacaugacucagcauaccugcuggugcagagcugaagauuuuggaggguccuccacaauaaggucaaugccagagacggaagccuuuuuccccaaagucuuaaaauaacuuauaucaucagcauaccuuuauugugaucuaucaauagucaagaaaaauuauuguauaagauuagaaugaaaauuguauguuaaguuacuucacuuuaauucucaugugauccuuuuauguuauuuauauauugguaacauccuuucuauugaaaaaucaccacaccaaaccucucuuauuagaacaggcaagugaagaaaagugaaugcucaaguuuuucagaaagcauuacauuuccaaaugaaugaccuuguugcaugauguauuuuuguacccuuccuacagauagucaaaccauaaacuucauggucauggguaaa

SEQ ID NO: 33 - RNA, 2462 nt, Homo sapiens
gcugagcugcaggcgcggcgaaacuucccucuacccgcccggcccgcggcgcgcaccguuggcgcuggacgcuuccuccuuggaagcgcccucucccucagucauggagaaaacuuguauagaugcacuuccucuuacuaugaauucuucagaaaagcaagagacuguauguauuuuuggaacuggugauuuuggaagaucacugggauugaaaaugcuccagugugguuauucuguuguuuuuggaagucgaaacccccagaagaccacccuacugcccaguggugcagaagucuugagcuauucagaagcagccaagaagucugacaucauaaucauagcaauccacagagagcauuaugauuuucucacagaauuaacugagguucucaauggaaaaauauugguagacaucagcaacaaccucaaaaucaaucaauauccagaaucuaaugcagaguaccuugcucauuuggugccaggagcccacgugguaaaagcauuuaacaccaucucagccugggcucuccagucaggagcacuggaugcaagucggcagguguuuguguguggaaaugacagcaaagccaagcaaagagugauggauauuguucguaaucuuggacuuacuccaauggaucaaggaucacucauggcagccaaagaaauugaaaaguacccccugcagcuauuuccaauguggagguuccccuucuauuugucugcugugcugugugucuucuuguuuuucuauuguguuauaagagacguaaucuacccuuauguuuaugaaaagaaagauaauacauuucguauggcuauuuccauuccaaaucguaucuuuccaauaacagcaccuuacacugcuugcuuugguuuaccucccugguguuauugcugccauucuacaacuguaccgaggcacaaaauaccgucgauucccagacuggcuugaccacuggaugcuuugccgaaagcagcuuggcuugguagcucugggauuugccuuccuucauguccucuacacacuugugauuccuauucgauauuauguacgauggagauugggaaacuuaaccguuacccaggcaauacucaagaaggagaauccauuuagcaccuccucagccuggcucagugauucauauguggcuuugggaauacuuggguuuuuucuguuuguacucuuggggaaucacuucuuugccaucuguuagcaaugcagucaacuggagagaguuccgauuuguccaguccaaacuggguuauuugacccugaucuuguguacagcccacacccugguguacggugggaagagauuccucagcccuucaaaucucagaugguaucuuccugcagccuacguguuagggcuuaucauuccuugcacugugcuggugaucaaguuuguccuaaucaugccauguguagacaacacccuuacaaggauccgccagggcugggaaaggaacucaaaacacuagaaaaagcauugaauggaaaaucaauauuuaaaacaaaguucaauuuagcuggauuucugaacuaugguuuugaauguuuaaagaagaaugauggguacaguuaggaaaguuuuuuucuuacaccgugacugagggaaacauugcuugucuuugagaaauugacugacauacuggaagagaacaccauuuuaucucagguuagugaagaaucagugcaggucccugacucuuauuuucccagaggccauggagcugagauugagacuagccuugugguuucacacuaaagaguuuccuuguuaugggcaacaugcaugaccuaaugucuugcaaaauccaauagaaguauugcagcuuccuucucuggcucaagggcugaguuaagugaaaggaaaaacagcacaauggugaccacugauaaaggcuuuauuagguauaucugaggaagugggucacaugaaauguaaaaagggaaugagguuuuuguuguuuuuuggaaguaaaggcaaacauaaauauuaccaugaugaauucuagugaaaugaccccuugacuuugcuuuucuuaauacagauauuuacugagaggaacuauuuuuauaacacaagaaaaauuuacaauugauuaaaaguauccaugucuuggauacauacguaucuauagagcuggcauguaauucuuccucuauaaagaauagguauaggaaagacugaauaaaaauggagggauauccccuuggauuucacuugcauugugcaauaagcaaagaaggguugauaaaaguucuugaucaaaaaguucaaagaaaccagaauuuuagacagcaagcuaaauaaauauuguaaaauugcacuauauuagguuaaguauuauuuagguauuauaauaugcuuuguaaauuuuauauuccaaauauugcucaauauuuuucaucuauuaaauuaauuucuaguguaaaaaaaaaaaaaaaaaaaaaa

SEQ ID NO: 34 - RNA, 3150 nt, Homo sapiens
ccacaaagggcacuuggccccagggcuaggagagcgaggggagagcacagccacccgccucggcggcccgggacucggcucgacucgccggagaaugcgcccgaggacgacggggcgccagagccgcggugcuuucaacuggcgagcgcgaaugggggugcacuggaguaaggcagagugaugcgggggggcaacucgccuggcaccgagaucgccgccgugcccuucccuggacccggcgucgcccaggauggcugccccgagccaugggccgcggcggagcuagcgcggagcgcccgacccucgacccccgagucccggagccggccccgcgcggggccacgcgucccucgggcgcugguuccuaaggaggacgacagcaccagcuucuccuuucucccuucccuucccugccccgcacuccucccccugcucgcuguuguugugugucagcacuuggcuggggacuucuugaacuugcagggagaauaacuugcgcaccccacuuugcgccggugccuuugccccagcggagccugcuucgccaucuccgagccccaccgccccuccacuccucggccuugcccgacacugagacgcuguucccagcgugaaaagagagacugcgcggccggcacccgggagaaggaggaggcaaagaaaaggaacggacauucgguccuugcgccagguccuuugaccagaguuuuuccauguggacgcucuuucaauggacguguccccgcgugcuucuuagacggacugcggucuccuaaaggucgaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuaguacagcaaaauuaaauacauaaauauauauauauauauauauuuuagaaaaaagaaaaaaacaaacaaacaaaaaaaccccaccccaguugacacuuuaauauuucccaaugaagacuuuauuuauggaauggaauggaaaaaaaaacagcuauuuugaaaauauauuuauaucuacgaaaagaaguugggaaaacaaauauuuuaaucagagaauuauuccuuaaagauuuaaaauguauuuaguuguacauuuuauauggguucaaccccagcacaugaaguauaauggucagauuuauuuuguauuuauuuacuauuauaaccacuuuuuaggaaaaaaauagcuaauuuguauuuauauguaaucaaaagaaguaucggguuuguacauaauuuuccaaaaauuguaguuguuuucaguuguguguauuuaagaugaaaagucuacauggaagguuacucuggcaaagugcuuagcacguuugcuuuuuugcagugcuacuguugaguucacaaguucaaguccagaaaaaaaaaguggauaauccacucugcugacuuucaagauuauuauauuauucaauucucaggaauguugcagagugauuguccaauccaugagaauuuacauccuuauuagguggaauauuuggauaagaaccagacauugcugaucuauuauagaaacucuccuccugccccuuaauuuacagaaagaauaaagcaggauccauagaaauaauuaggaaaacgaugaaccugcaggaaagugaaugaugguuuguuguucuucuuuccuaaauuagugaucccuucaaaggggcugaucuggccaaaguauucaauaaaacguaagauuucuucauuauugauauuguggucauauauauuuaaaauugauaucucguggcccucaucaaggguuggaaauuuauuuguguuuuaccuuuaccucaucugagagcucuuuauucuccaaagaacccaguuuucuaacuuuuugcccaacacgcagcaaaauuaugcacaucguguuuucugcccacccucuguucucugaccuaucagcuugcuuuucuuuccaagguuguguguuugaacacauuucuccaaauguuaaaccuauuucagauaauaaauaucaaaucucuggcauuucauucuauaaaguc

SEQ ID NO: 35 - RNA, 3088 nt, Homo sapiens
acaaaaaagcuuuuacgagguaucagcacuuuucuuucauuagggggaaggcgugaggaaaguaccaaacagcagcggaguuuuaaacuuuaaauagacaggucugagugccugaacuugccuuuucauuuuacuucauccuccaaggaguucaaucacuuggcgugacuucacuacuuuuaagcaaaagaguggugcccaggcaacaugggugacuggagcgccuuaggcaaacuccuugacaagguucaagccuacucaacugcuggagggaagguguggcugucaguacuuuucauuuuccgaauccugcugcuggggacagcgguugagucagccuggggagaugagcagucugccuuucguuguaacacucagcaaccugguugugaaaaugucugcuaugacaagucuuucccaaucucucaugugcgcuucuggguccugcagaucauauuugugucuguacccacacucuuguaccuggcucauguguucuaugugaugcgaaaggaagagaaacugaacaagaaagaggaagaacucaagguugcccaaacugauggugucaauguggacaugcacuugaagcagauugagauaaagaaguucaaguacgguauugaagagcaugguaaggugaaaaugcgagggggguugcugcgaaccuacaucaucaguauccucuucaagucuaucuuugagguggccuucuugcugauccagugguacaucuauggauucagcuugagugcuguuuacacuugcaaaagagaucccugcccacaucagguggacuguuuccucucucgccccacggagaaaaccaucuucaucaucuucaugcuggugguguccuuggugucccuggccuugaauaucauugaacucuucuauguuuucuucaagggcguuaaggaucggguuaagggaaagagcgacccuuaccaugcgaccaguggugcgcugagcccugccaaagacugugggucucaaaaauaugcuuauuucaauggcugcuccucaccaaccgcuccccucucgccuaugucuccuccuggguacaagcugguuacuggcgacagaaacaauucuucuugccgcaauuacaacaagcaagcaagugagcaaaacugggcuaauuacagugcagaacaaaaucgaauggggcaggcgggaagcaccaucucuaacucccaugcacagccuuuugauuuccccgaugauaaccagaauucuaaaaaacuagcugcuggacaugaauuacagccacuagccauuguggaccagcgaccuucaagcagagccagcagucgugccagcagcagaccucggccugaugaccuggagaucuagauacaggcuugaaagcaucaagauuccacucaauuguggagaagaaaaaaggugcuguagaaagugcaccagguguuaauuuugauccgguggaggugguacucaacagccuuauucaugaggcuuagaaaacacaaagacauuagaauaccuagguucacuggggguguaugggguagauggguggagagggaggggauaagagaggugcauguugguauuuaaaguaguggauucaaagaacuuagauuauaaauaagaguuccauuaggugauacauagauaagggcuuuuucuccccgcaaacaccccuaagaaugguucuguguaugugaaugagcgggugguaauuguggcuaaauauuuuuguuuuaccaagaaacugaaauaauucuggccaggaauaaauacuuccugaacaucuuaggucuuuucaacaagaaaaagacagaggauuguccuuaagucccugcuaaaacauuccauuguuaaaauuugcacuuugaagguaagcuuucuaggccugacccuccaggugucaauggacuugugcuacuauauuuuuuuauucuugguaucaguuuaaaauucagacaaggcccacagaauaagauuuuccaugcauuugcaaauacguauauucuuuuuccauccacuugcacaauaucauuaccaucacuuuuucaucauuccucagcuacuacucacauucauuuaaugguuucuguaaacauuuuuaagacaguugggaugucacuuaacauuuuuuuuuuuugagcuaaagucagggaaucaagccaugcuuaauauuuaacaaucacuuauaugugugucgaagaguuuguuuuguuugucauguauugguacaagcagauacaguauaaacucacaaacacagauuugaaaauaaugcacauaugguguucaaauuugaaccuuucucauggauuuuuguggugugggccaauaugguguuuacauuauauaauuccugcuguggcaaguaaagcacacuuuuuuuuucuccuaaaauguuuuucccuguguauccuauuauggauacugguuuuguuaauuaugauucuuuauuuucucuccuuuuuuuaggauauagcaguaaugcuauuacugaaaugaauuuccuuuuucugaaauguaaucauugaugcuugaaugauagaauuuuaguacuguaaacaggcuuuagucauuaaugugagagacuuagaaaaaaugcuuagaguggacuauuaaaugugccuaaaugaauuuugcaguaacugguauucuuggguuuuccuacuuaauacacaguaauucagaacuuguauucuauuaugaguuuagcagucuuuuggagugaccagcaacuuugauguuugcacuaagauuuuauuuggaaugcaagagagguugaaagaggauucaguaguacacauacaacuaauuuauuugaacuauauguugaagacaucuaccaguuucuccaaaugccuuuuuuaaaacucaucacagaagauuggugaaaaugcugaguaugacacuuuucuucuugcaugcaugucagcuacauaaacaguuuuguacaaugaaaauuacuaauuuguuugacauuccauguuaaacuacggucauguucagcuucauugcauguaauguagaccuaguccaucagaucauguguucuggagaguguucuuuauucaauaaaguuuuaauuuaguauaaacau

SEQ ID NO: 36 - RNA, 583 nt, Homo sapiens
cgcugcgccacaucccaccggcccuuacacugugguguccagcagcauccggcuucauggggggacuugaacccugcagcaggcuccugcuccugccucuccugcuggcuguaaguggucuccguccuguccaggcccaggcccagagcgauugcaguugcucuacggugagcccgggcgugcuggcagggaucgugaugggagaccuggugcugacagugcucauugcccuggccguguacuuccugggccggcuggucccucgggggcgaggggcugcggaggcagcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 37 - RNA, 580 nt, Homo sapiens
cgcugcgccacaucccaccggcccuuacacugugguguccagcagcauccggcuucauggggggacuugaacccugcagcaggcuccugcuccugccucuccugcuggcuguaaguggucuccguccuguccaggcccaggcccagagcgauugcaguugcucuacggugagcccgggcgugcuggcagggaucgugaugggagaccuggugcugacagugcucauugcccuggccguguacuuccugggccggcuggucccucgggggcgaggggcugcggaggcgacccggaaacagcguaucacugagaccgagucgccuuaucaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacaaaaaaaaaaaaaaaaaa

SEQ ID NO: 38 - RNA, 2312 nt, Homo sapiens
uccagugacggagccgcccggccgacagccccgagacgacagcccggcgcgucccgguccccaccuccgaccaccgccagcgcuccaggccccgcgcuccccgcucgccgccaccgcgcccuccgcuccgcccgcagugccaaccaugaccgccgccaguaugggccccguccgcgucgccuucgugguccuccucgcccucugcagccggccggccgucggccagaacugcagcgggccgugccggugcccggacgagccggcgccgcgcugcccggcgggcgugagccucgugcuggacggcugcggcugcugccgcgucugcgccaagcagcugggcgagcugugcaccgagcgcgaccccugcgacccgcacaagggccucuucugugacuucggcuccccggccaaccgcaagaucggcgugugcaccgccaaagauggugcucccugcaucuucggugguacgguguaccgcagcggagaguccuuccagagcagcugcaaguaccagugcacgugccuggacggggcggugggcugcaugccccugugcagcauggacguucgucugcccagcccugacugccccuucccgaggagggucaagcugcccgggaaaugcugcgaggagugggugugugacgagcccaaggaccaaaccgugguugggccugcccucgcggcuuaccgacuggaagacacguuuggcccagacccaacuaugauuagagccaacugccugguccagaccacagaguggagcgccuguuccaagaccugugggaugggcaucuccacccggguuaccaaugacaacgccuccugcaggcuagagaagcagagccgccugugcauggucaggccuugcgaagcugaccuggaagagaacauuaagaagggcaaaaagugcauccguacucccaaaaucuccaagccuaucaaguuugagcuuucuggcugcaccagcaugaagacauaccgagcuaaauucuguggaguauguaccgacggccgaugcugcaccccccacagaaccaccacccugccgguggaguucaagugcccugacggcgaggucaugaagaagaacaugauguucaucaagaccugugccugccauuacaacugucccggagacaaugacaucuuugaaucgcuguacuacaggaagauguacggagacauggcaugaagccagagagugagagacauuaacucauuagacuggaacuugaacugauucacaucucauuuuuccguaaaaaugauuucaguagcacaaguuauuuaaaucuguuuuucuaacugggggaaaagauucccacccaauucaaaacauugugccaugucaaacaaauagucuaucuuccccagacacugguuugaagaauguuaagacuugacaguggaacuacauuaguacacagcaccagaauguauauuaagguguggcuuuaggagcagugggaggguaccagcagaaagguuaguaucaucagauagcucuuauacgaguaauaugccugcuauuugaaguguaauugagaaggaaaauuuuagcgugcucacugaccugccuguagccccagugacagcuaggaugugcauucuccagccaucaagagacugagucaaguuguuccuuaagucagaacagcagacucagcucugacauucugauucgaaugacacuguucaggaaucggaauccugucgauuagacuggacagcuuguggcaagugaauuuccuguaacaagccagauuuuuuaaaauuuauauuguaaauauuguguguguguguguguguguauauauauauauauauguacaguuaucuaaguuaauuuaaaguuguuugugccuuuuuauuuuuguuuuuaaugcuuugauauuucaauguuagccucaauuucugaacaccauagguagaauguaaagcuugucugaucguucaaagcaugaaauggauacuuauauggaaauucucucagauagaaugacaguccgucaaaacagauuguuugcaaaggggaggcaucaguguccuuggcaggcugauuucuagguaggaaaugugguagcucacgcucacuuuuaaugaacaaauggccuuuauuaaaaacugagugacucuauauagcugaucaguuuuuucaccuggaagcauuuguuucuacuuugauaugacuguuuuucggacaguuuauuuguugagagugugaccaaaaguuacauguuugcaccuuucuaguugaaaauaaaguauauuuuuucuaaaaaaaaaaaaaaacgacagcaacggaauuc

SEQ ID NO: 39 - RNA, 1641 nt, Homo sapiens
cucccuguguugguggaggaugucugcagcagcauuuaaauucugggagggcuugguugucagcagcagcaggaggaggcagagcacagcaucgucgggaccagacucgucucaggccaguugcagccuucucagccaaacgccgaccaaggaaaacucacuaccaugagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaauuugguggugucaauugcuuauuuguuuucccacgguuguccagcaauuaauaaaacauaaccuuuuuuacugccuaaaaaaaaaaaaaaaaa

SEQ ID NO: 40 - RNA, 1616 nt, Homo sapiens
cucccuguguugguggaggaugucugcagcagcauuuaaauucugggagggcuugguugucagcagcagcaggaggaggcagagcacagcaucgucgggaccagacucgucucaggccaguugcagccuucucagccaaacgccgaccaaggaaaacucacuaccaugagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaauuugguggugucaauugcuuauuuguuuucccacgguuguccagcaauuaauaaaacauaaccuuuuuuacugccuaaaaaaaaaaaaaaaaaaaaaaaaaaaaaaaaaa

SEQ ID NO: 41 - RNA, 1560 nt, Homo sapiens
cucccuguguugguggaggaugucugcagcagcauuuaaauucugggagggcuugguugucagcagcagcaggaggaggcagagcacagcaucgucgggaccagacucgucucaggccaguugcagccuucucagccaaacgccgaccaaggaaaacucacuaccaugagaauugcagugauuugcuuuugccuccuaggcaucaccugugccauaccaguuaaacaggcugauucuggaaguucugaggaaaagcagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaauuugguggugucaauugcuuauuuguuuucccacgguuguccagcaauuaauaaaacauaaccuuuuuuacugccuaaaaaaaaaaaaaaaaa

SEQ ID NO: 42 - RNA, 1924 nt, Homo sapiens
cugugcgcccugcgcgcccugcgcacccgcggcccgagcccagccagagccgggcggagcggagcgcgccgagccucgucccgcggccgggccggggccgggccguagcggcggcgccuggaugcggacccggccgcggggagacgggcgcccgccccgaaacgacuuucaguccccgacgcgccccgcccaaccccuacgaugaagagggcguccgcuggagggagccggcugcuggcaugggugcuguggcugcaggccuggcagguggcagccccaugcccaggugccugcguaugcuacaaugagcccaaggugacgacaagcugcccccagcagggccugcaggcugugcccgugggcaucccugcugccagccagcgcaucuuccugcacggcaaccgcaucucgcaugugccagcugccagcuuccgugccugccgcaaccucaccauccuguggcugcacucgaaugugcuggcccgaauugaugcggcugccuucacuggccuggcccuccuggagcagcuggaccucagcgauaaugcacagcuccggucuguggacccugccacauuccacggccugggccgccuacacacgcugcaccuggaccgcugcggccugcaggagcugggcccggggcuguuccgcggccuggcugcccugcaguaccucuaccugcaggacaacgcgcugcaggcacugccugaugacaccuuccgcgaccugggcaaccucacacaccucuuccugcacggcaaccgcaucuccagcgugcccgagcgcgccuuccgugggcugcacagccucgaccgucuccuacugcaccagaaccgcguggcccaugugcacccgcaugccuuccgugaccuuggccgccucaugacacucuaucuguuugccaacaaucuaucagcgcugcccacugaggcccuggccccccugcgugcccugcaguaccugaggcucaacgacaaccccugggugugugacugccgggcacgcccacucugggccuggcugcagaaguuccgcggcuccuccuccgaggugcccugcagccucccgcaacgccuggcuggccgugaccucaaacgccuagcugccaaugaccugcagggcugcgcuguggccaccggcccuuaccaucccaucuggaccggcagggccaccgaugaggagccgcuggggcuucccaagugcugccagccagaugccgcugacaaggccucaguacuggagccuggaagaccagcuucggcaggcaaugcgcugaagggacgcgugccgcccggugacagcccgccgggcaacggcucuggcccacggcacaucaaugacucacccuuugggacucugccuggcucugcugagcccccgcucacugcagugcggcccgagggcuccgagccaccaggguuccccaccucgggcccucgccggaggccaggcuguucacgcaagaaccgcacccgcagccacugccgucugggccaggcaggcagcggggguggcgggacuggugacucagaaggcucaggugcccuacccagccucaccugcagccucaccccccugggccuggcgcuggugcuguggacagugcuugggcccugcugacccccagcggacacaagagcgugcucagcagccagguguguguacauacggggucucucuccacgccgccaagccagccgggcggccgacccguggggcaggccaggccagguccucccugauggacgccugccgcccgccacccccaucuccaccccaucauguuuacaggguucggcggcagcguuuguuccagaacgccgccucccacccagaucgcgguauauagagauaugcauuuuauuuuacuuguguaaaaauaucggacgacguggaauaaagagcucuuuucuuaaaaaaa

SEQ ID NO: 43 - RNA, 1635 nt, Homo sapiens
gcucagcauuuggggacgcucucagcucucggcgcacggcccagguaagcggggcgcgcccugcccgcccgcgaugggccgccagcuagcggggugcggagacgcugggaagaaggcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaaaaa

SEQ ID NO: 44 - RNA, 1563 nt, Homo sapiens
gcucagcauuuggggacgcucucagcucucggcgcacggcccagcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaaaaa

SEQ ID NO: 45 - RNA, 1644 nt, Homo sapiens
gcucagcauuuggggacgcucucagcucucggcgcacggcccagguuaucuuguagcauagcaacuucggauuucacucuacccggagaguuucccgcuugguugaacacauuggccucaggaagcuuccuucaaaaugucuacuguucacgaaauccugugcaagcucagcuuggagggugaucacucuacacccccaagugcauaugggucugucaaagccuauacuaacuuugaugcugagcgggaugcuuugaacauugaaacagccaucaagaccaaagguguggaugaggucaccauugucaacauuuugaccaaccgcagcaaugcacagagacaggauauugccuucgccuaccagagaaggaccaaaaaggaacuugcaucagcacugaagucagccuuaucuggccaccuggagacggugauuuugggccuauugaagacaccugcucaguaugacgcuucugagcuaaaagcuuccaugaaggggcugggaaccgacgaggacucucucauugagaucaucugcuccagaaccaaccaggagcugcaggaaauuaacagagucuacaaggaaauguacaagacugaucuggagaaggacauuauuucggacacaucuggugacuuccgcaagcugaugguugcccuggcaaaggguagaagagcagaggauggcucugucauugauuaugaacugauugaccaagaugcucgggaucucuaugacgcuggagugaagaggaaaggaacugauguucccaaguggaucagcaucaugaccgagcggagcgugccccaccuccagaaaguauuugauagguacaagaguuacagcccuuaugacauguuggaaagcaucaggaaagagguuaaaggagaccuggaaaaugcuuuccugaaccugguucagugcauucagaacaagccccuguauuuugcugaucggcuguaugacuccaugaagggcaaggggacgcgagauaagguccugaucagaaucauggucucccgcagugaaguggacauguugaaaauuaggucugaauucaagagaaaguacggcaagucccuguacuauuauauccagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuuagaaacacguacuuuguggcccugcuuucaacugaauuguuugaaaauuaaacgugcuugggguucagcuggugaggcugucccuguaggaagaaagcucugggacugagcuguacaguaugguugccccuauccaagugucgcuauuuaaguuaaauuuaaaugaaauaaaauaaaauaaaaucaaaaaaaaaa

SEQ ID NO: 46 - RNA, 1926 nt, Homo sapiens
guggaugagcugugagugcgcgcgcgugcgcggggccgcgaccugugccggcucgagcccgcugggcacucggaggcgcgcacgucguuccccgcccucccgccgccgcccgcccucgcucucucgcgcuacccucccgccgcccgcgguccuccgucgguucucucguuaguccacggucuggucuucagcuacccgccuucgucuccgaguuugcgacucgcggaccggcguccccggcgcgaagaggcuggacucggauucguugccugagcaauggcugccauccggaagaaacuggugauuguuggugauggagccuguggaaagacaugcuugcucauagucuucagcaaggaccaguucccagagguguaugugcccacaguguuugagaacuauguggcagauaucgagguggauggaaagcagguagaguuggcuuugugggacacagcugggcaggaagauuaugaucgccugaggccccucuccuacccagauaccgauguuauacugauguguuuuuccaucgacagcccugauaguuuagaaaacaucccagaaaaguggaccccagaagucaagcauuucugucccaacgugcccaucauccugguugggaauaagaaggaucuucggaaugaugagcacacaaggcgggagcuagccaagaugaagcaggagccggugaaaccugaagaaggcagagauauggcaaacaggauuggcgcuuuuggguacauggaguguucagcaaagaccaaagauggagugagagagguuuuugaaauggcuacgagagcugcucugcaagcuagacgugggaagaaaaaaucugggugccuugucuugugaaaccuugcugcaagcacagcccuuaugcgguuaauuuugaagugcuguuuauuaaucuuaguguaugauuacuggccuuuuucauuuaucuauaauuuaccuaagauuacaaaucagaagucaucuugcuaccaguauuuagaagccaacuaugauuauuaacgauguccaacccgucuggcccaccaggguccuuuugacacugcucuaacagcccuccucugcacucccaccugacacaccaggcgcuaauucaaggaauuucuuaacuucuugcuucuuucuagaaagagaaacaguugguaacuuuugugaauuaggcuguaacuacuuuauaacuaacauguccugccuauuaucugucagcugcaagguacucuggugagucaccacuucagggcuuuacuccguaacagauuuuguuggcauagcucuggggugggcaguuuuuugaaaaugggcucaaccagaaaagcccaaguucaugcagcuguggcagaguuacaguucugugguuucauguuaguuaccuuauaguuacuguguaauuagugccacuuaauguauguuaccaaaaauaaauauaucuaccccagacuagauguaguauuuuuuguauaauuggauuuccuaauacugucauccucaaagaaaguguauugguuuuuuaaaaaagaaaguguauuuggaaauaaagucagauggaaaauucauuuuuuaaauucccguuuugucacuuuuucugauaaaagauggccauauuaccccuuuucggccccauguaucucaguaccccauggagcugggcuaaguaaauaggaauugguuucacgccugaggcaauuagacacuuuggaagauggcauaaccugucucaccuggacuuaagcaucuggcucuaauucacagugcucuuuucuccucacuguauccagguucccucccagaggagccaccaguucucauggguggcacucagucucucuucucuccagcugacuaaacuuuuuuucuguaccaguuaauuuuuccaacuacuaauagaauaaaggcaguuuucuaaaaaaa

SEQ ID NO: 47 - RNA, 5693 nt, Homo sapiens
gcagagcugcagaggcaccggacgagagagggcuccgcgggcccagcuggcagccaggccggagacaaguugcagucccgggcucuggugacgccguggccgcagcuggaagaggaaaacaaggaucagauuggagaagugauuuaucuaagaucccacaguggacuggcagcagcacugagaccucagccuagucuccugauccccaagcagggcccugccuaaggaacacacucugcagagugcugggccaaagcaggguuuuccaacuaaucuuagaagguaaaguccaugaagggucuccauuuugggacauucuaaucccugagccccuauuauuuucaucaugggcuucugccuggcucuagcauggacacuucugguuggggcauggaccccucugggagcucagaaccccauuucgugggaggugcagcgauuugaugggugguacaacaaccucauggagcacagauggggcagcaaaggcucccggcugcagcgccuggucccagccagcuaugcagauggcguguaccagcccuugggagaaccccaccugcccaacccccgagaccuuagcaacaccaucucaaggggcccugcagggcuggccucccugagaaaccgcacaguguugggggucuucuuuggcuaucacgugcuuucagaccuggugagcguggaaacucccggcugccccgccgaguuccucaacauucgcaucccgcccggagaccccauguucgaccccgaccagcgcggggacguggugcugcccuuccagagaagccgcugggaccccgagaccggacggagucccagcaauccccgggacccggccaaccaggugacgggcuggcuggacggcagcgccaucuaugguuccucgcauuccuggagcgacgcgcugcggagcuucuccaggggacagcuggcgucggggcccgaccccgcuuuuccccgagacucgcagaacccccugcucaugugggcggcgcccgaccccgccaccgggcagaacgggccccgggggcuguacgccuucggggcagagagagggaaccgggaacccuuccugcaggcgcugggccugcucugguuccgcuaccacaaccugugggcgcagaggcuggcccgccagcacccagacugggaggacgaggagcuguuccagcacgcacgcaagagggucaucgccaccuaccagaacaucgcuguguaugaguggcugcccagcuuccugcagaaaacacucccggaguauacaggauaccggccauuucuggaccccagcaucuccucagaguucguggcggccucugagcaguuccuguccaccauggugcccccuggcgucuacaugagaaaugccagcugccacuuccagggggucaucaaucggaacucaagugucuccagagcucuccgggucugcaacagcuacuggagccgugagcacccaagccuacaaagugcugaagauguggaugcacugcugcugggcauggccucccagaucgcagagcgagaggaccauguguugguugaagaugugcgggauuucuggccugggccacugaaguuuucccgcacagaccaccuggccagcugccugcagcggggccgggaucugggccugcccucuuacaccaaggccagggcagcacugggcuugucucccauuacccgcuggcaggacaucaacccugcacucucccggagcaaugacacuguacuggaggccacagcugcccuguacaaccaggacuuauccuggcuagagcugcucccugggggacuccuggagagccaccgggacccuggaccucuguucagcaccaucguccuugaacaauuugugcggcuacgggauggugaccgcuacugguuugagaacaccaggaaugggcuguucuccaagaaggagauugaagaaauccgaaauaccacccugcaggacgugcuggucgcuguuaucaacauugaccccagugcucugcagcccaaugucuuugucuggcauaaaggagaccccuguccgcagccgagacagcucagcacugaaggccugccagcgugugcucccucuguuguucgugacuauuuugagggcaguggauuuggcuucggggucaccaucgggacccucuguugcuucccuuuggugagccugcucagugccuggauuguugcccggcuccggaugagaaauuucaagaggcuccagggccaggaccgccagagcaucgugucugagaagcucgugggaggcauggaagcuuuggaauggcaaggccacaaggagcccugccggcccgugcuuguguaccugcagcccgggcagauccgugugguagauggcaggcucaccgugcuccgcaccauccagcugcagccuccacagaaggucaacuucguccuguccagcaaccguggacgccgcacucugcugcucaagauccccaaggaguaugaccuggugcugcuguuuaacuuggaggaagagcggcaggcgcugguggaaaaucuccggggagcucugaaggagagcggguugagcauccaggagugggagcugcgggagcaggagcugaugagagcagcugugacacgggagcagcggaggcaccuccuggagaccuuuuucaggcaccuuuucucccaggugcuggacaucaaccaggccgacgcagggacccugccccuggacuccucccagaaggugcgggaggcccugaccugugagcugagcagggccgaguuugccgagucccugggccucaagccccaggacauguuuguggaguccauguucucucuggcugacaaggauggcaauggcuaccuguccuuccgagaguuccuggacauccugguggucuucaugaaaggcucuccugaggaaaagucucgccuuauguuccgcauguacgacuuugaugggaauggccucauuuccaaggaugaguucaucaggaugcugagauccuucaucgagaucuccaacaacugccuguccaaggcccagcuggcugaggugguggaguccauguuccgggagucgggauuccaggacaaggaggaacugacaugggaagauuuucacuucaugcugcgggaccacaauagcgagcuccgcuucacgcagcucugugucaaagggguggaggugccugaagucaucaaggaccucugccggcgagccuccuacaucagccaggauaugaucugucccucucccagagugagugcccgcuguucccgcagcgacauugagacugaguugacaccucagagacugcagugccccauggacacagacccuccccaggagauucggcggagguuuggcaagaagguaacgucauuccagcccuugcuguucacugaggcgcaccgagagaaguuccaacgcagcugucuccaccagacggugcaacaguucaagcgcuucauugagaacuaccggcgccacaucggcugcguggccguguucuacgccaucgcuggggggcuuuuccuggagagggccuacuacuacgccuuugccgcacaucacacgggcaucacagacaccacccgcgugggaaucauccugucgcggggcacagcagccagcaucucuuucauguucuccuacaucuugcucaccaugugccgcaaccucaucaccuuccugcgagaaaccuuccucaaccgcuacgugcccuucgacgccgccguggacuuccaucgccucauugccuccaccgccaucguccucacagucuuacacagugugggccauguggugaauguguaccuguucuccaucagcccccucagcguccucucuugccucuuuccuggccucuuccaugaugaugggucugagcucccccagaaguauuacuggugguucuuccagaccguaccaggccucacggggguugugcugcuccugauccuggccaucauguaugucuuugccucccaccacuuccgccgccgcaguuuccggggcuucuggcugacccaccaccucuacauccugcucuauguccugcucaucauccaugguagcuuugcccugauccagcugccccguuuccacaucuucuuccuggucccagcaaucaucuaugggggcgacaagcuggugagccugagccggaagaagguggagaucagcguggugaaggcggagcugcugcccucaggagugacccaccugcgguuccagcggccccagggcuuugaguacaagucagggcagugggugcggaucgcuugccuggcucuggggaccaccgaguaccaccccuucacacugaccucugcgccccaugaggacacgcuuagccugcacauccgggcagcagggcccuggaccacucgccucagggagaucuacucagccccgacgggugacagaugugccagauacccaaagcuguaccuugauggaccauuuggagagggccaccaggaguggcauaaguuugaggugucaguguuagugggagggggcauuggggucaccccuuuugccuccauccucaaagaccuggucuucaagucauccgucagcugccaaguguucuguaagaagaucuacuucaucugggugacgcggacccagcgucaguuugaguggcuggcugacaucauccgagagguggaggagaaugaccaccaggaccuggugucugugcacaucuacaucacccagcuggcugagaaguucgaccucaggaccacuaugcuguacaucugugagcggcacuuccagaagguucugaaccggagucuauucacaggccugcgcuccaucacccacuuuggccguccccccuuugagcccuucuucaacucccugcaggagguccacccccagguccggaagaucgggguguuuagcuguggccccccuggcaugaccaagaauguggaaaaggccugucagcucaucaacaggcaggaccggacucacuucucccaccauuaugagaacuucuaggccccugcccggggguucugcccacugcccaguugagcagagguuugagcccacaccucaccucuguucuuccuauuucuggcugccucagccuucucugauuucccaccucccaaccuuguuccagguggccauagucagucaccaugugugggcucagggacccccaggaccaggaugugucucagccuggagaaauggugggggggcagugucuagggacuagagugagaaguaggggagcuacugauuuggggcaaagugaaaccucugcuuccagacuucagaaacaaaucucagaagacaagcugaccugacaaguacuaugugugugcaugucuguauguguguuggggcggugaguguaaggaugcagugggagcauggaugcuggcaucuuagaacccucccuacucccauaccuccuccucuucugggcuccccacugucagacgggcuggcaaaugccuugcaggagguagaggcuggacccauggcaagccauuuacagaaacccacucggcaccccagucuaacaccacaacuaauuucacccaagguuuuaagcacguucuuucaucagacccuggcccaauaccuauguaugcaaugcuccucagcccucuucucccugcuccaguagucucccuuccaaauaaaucacuuuucugccuuaaaaaaaaaaaaaaaa

SEQ ID NO: 48 - RNA, 5501 nt, Homo sapiens
gcagagcugcagaggcaccggacgagagagggcuccgcgggcccagcuggcagccaggccggagacaaguugcagucccgggcucuggugacgccguggccgcagggucuccauuuugggacauucuaaucccugagccccuauuauuuucaucaugggcuucugccuggcucuagcauggacacuucugguuggggcauggaccccucugggagcucagaaccccauuucgugggaggugcagcgauuugaugggugguacaacaaccucauggagcacagauggggcagcaaaggcucccggcugcagcgccuggucccagccagcuaugcagauggcguguaccagcccuugggagaaccccaccugcccaacccccgagaccuuagcaacaccaucucaaggggcccugcagggcuggccucccugagaaaccgcacaguguugggggucuucuuuggcuaucacgugcuuucagaccuggugagcguggaaacucccggcugccccgccgaguuccucaacauucgcaucccgcccggagaccccauguucgaccccgaccagcgcggggacguggugcugcccuuccagagaagccgcugggaccccgagaccggacggagucccagcaauccccgggacccggccaaccaggugacgggcuggcuggacggcagcgccaucuaugguuccucgcauuccuggagcgacgcgcugcggagcuucuccaggggacagcuggcgucggggcccgaccccgcuuuuccccgagacucgcagaacccccugcucaugugggcggcgcccgaccccgccaccgggcagaacgggccccgggggcuguacgccuucggggcagagagagggaaccgggaacccuuccugcaggcgcugggccugcucugguuccgcuaccacaaccugugggcgcagaggcuggcccgccagcacccagacugggaggacgaggagcuguuccagcacgcacgcaagagggucaucgccaccuaccagaacaucgcuguguaugaguggcugcccagcuuccugcagaaaacacucccggaguauacaggauaccggccauuucuggaccccagcaucuccucagaguucguggcggccucugagcaguuccuguccaccauggugcccccuggcgucuacaugagaaaugccagcugccacuuccagggggucaucaaucggaacucaagugucuccagagcucuccgggucugcaacagcuacuggagccgugagcacccaagccuacaaagugcugaagauguggaugcacugcugcugggcauggccucccagaucgcagagcgagaggaccauguguugguugaagaugugcgggauuucuggccugggccacugaaguuuucccgcacagaccaccuggccagcugccugcagcggggccgggaucugggccugcccucuuacaccaaggccagggcagcacugggcuugucucccauuacccgcuggcaggacaucaacccugcacucucccggagcaaugacacuguacuggaggccacagcugcccuguacaaccaggacuuauccuggcuagagcugcucccugggggacuccuggagagccaccgggacccuggaccucuguucagcaccaucguccuugaacaauuugugcggcuacgggauggugaccgcuacugguuugagaacaccaggaaugggcuguucuccaagaaggagauugaagaaauccgaaauaccacccugcaggacgugcuggucgcuguuaucaacauugaccccagugcucugcagcccaaugucuuugucuggcauaaaggagaccccuguccgcagccgagacagcucagcacugaaggccugccagcgugugcucccucuguuguucgugacuauuuugagggcaguggauuuggcuucggggucaccaucgggacccucuguugcuucccuuuggugagccugcucagugccuggauuguugcccggcuccggaugagaaauuucaagaggcuccagggccaggaccgccagagcaucgugucugagaagcucgugggaggcauggaagcuuuggaauggcaaggccacaaggagcccugccggcccgugcuuguguaccugcagcccgggcagauccgugugguagauggcaggcucaccgugcuccgcaccauccagcugcagccuccacagaaggucaacuucguccuguccagcaaccguggacgccgcacucugcugcucaagauccccaaggaguaugaccuggugcugcuguuuaacuuggaggaagagcggcaggcgcugguggaaaaucuccggggagcucugaaggagagcggguugagcauccaggagugggagcugcgggagcaggagcugaugagagcagcugugacacgggagcagcggaggcaccuccuggagaccuuuuucaggcaccuuuucucccaggugcuggacaucaaccaggccgacgcagggacccugccccuggacuccucccagaaggugcgggaggcccugaccugugagcugagcagggccgaguuugccgagucccugggccucaagccccaggacauguuuguggaguccauguucucucuggcugacaaggauggcaauggcuaccuguccuuccgagaguuccuggacauccugguggucuucaugaaaggcucuccugaggaaaagucucgccuuauguuccgcauguacgacuuugaugggaauggccucauuuccaaggaugaguucaucaggaugcugagauccuucaucgagaucuccaacaacugccuguccaaggcccagcuggcugaggugguggaguccauguuccgggagucgggauuccaggacaaggaggaacugacaugggaagauuuucacuucaugcugcgggaccacaauagcgagcuccgcuucacgcagcucugugucaaagggguggaggugccugaagucaucaaggaccucugccggcgagccuccuacaucagccaggauaugaucugucccucucccagagugagugcccgcuguucccgcagcgacauugagacugaguugacaccucagagacugcagugccccauggacacagacccuccccaggagauucggcggagguuuggcaagaagguaacgucauuccagcccuugcuguucacugaggcgcaccgagagaaguuccaacgcagcugucuccaccagacggugcaacaguucaagcgcuucauugagaacuaccggcgccacaucggcugcguggccguguucuacgccaucgcuggggggcuuuuccuggagagggccuacuacuacgccuuugccgcacaucacacgggcaucacagacaccacccgcgugggaaucauccugucgcggggcacagcagccagcaucucuuucauguucuccuacaucuugcucaccaugugccgcaaccucaucaccuuccugcgagaaaccuuccucaaccgcuacgugcccuucgacgccgccguggacuuccaucgccucauugccuccaccgccaucguccucacagucuuacacagugugggccauguggugaauguguaccuguucuccaucagcccccucagcguccucucuugccucuuuccuggccucuuccaugaugaugggucugagcucccccagaaguauuacuggugguucuuccagaccguaccaggccucacggggguugugcugcuccugauccuggccaucauguaugucuuugccucccaccacuuccgccgccgcaguuuccggggcuucuggcugacccaccaccucuacauccugcucuauguccugcucaucauccaugguagcuuugcccugauccagcugccccguuuccacaucuucuuccuggucccagcaaucaucuaugggggcgacaagcuggugagccugagccggaagaagguggagaucagcguggugaaggcggagcugcugcccucaggagugacccaccugcgguuccagcggccccagggcuuugaguacaagucagggcagugggugcggaucgcuugccuggcucuggggaccaccgaguaccaccccuucacacugaccucugcgccccaugaggacacgcuuagccugcacauccgggcagcagggcccuggaccacucgccucagggagaucuacucagccccgacgggugacagaugugccagauacccaaagcuguaccuugauggaccauuuggagagggccaccaggaguggcauaaguuugaggugucaguguuagugggagggggcauuggggucaccccuuuugccuccauccucaaagaccuggucuucaagucauccgucagcugccaaguguucuguaagaagaucuacuucaucugggugacgcggacccagcgucaguuugaguggcuggcugacaucauccgagagguggaggagaaugaccaccaggaccuggugucugugcacaucuacaucacccagcuggcugagaaguucgaccucaggaccacuaugcuguacaucugugagcggcacuuccagaagguucugaaccggagucuauucacaggccugcgcuccaucacccacuuuggccguccccccuuugagcccuucuucaacucccugcaggagguccacccccagguccggaagaucgggguguuuagcuguggccccccuggcaugaccaagaauguggaaaaggccugucagcucaucaacaggcaggaccggacucacuucucccaccauuaugagaacuucuaggccccugcccggggguucugcccacugcccaguugagcagagguuugagcccacaccucaccucuguucuuccuauuucuggcugccucagccuucucugauuucccaccucccaaccuuguuccagguggccauagucagucaccaugugugggcucagggacccccaggaccaggaugugucucagccuggagaaauggugggggggcagugucuagggacuagagugagaaguaggggagcuacugauuuggggcaaagugaaaccucugcuuccagacuucagaaacaaaucucagaagacaagcugaccugacaaguacuaugugugugcaugucuguauguguguuggggcggugaguguaaggaugcagugggagcauggaugcuggcaucuuagaacccucccuacucccauaccuccuccucuucugggcuccccacugucagacgggcuggcaaaugccuugcaggagguagaggcuggacccauggcaagccauuuacagaaacccacucggcaccccagucuaacaccacaacuaauuucacccaagguuuuaagcacguucuuucaucagacccuggcccaauaccuauguaugcaaugcuccucagcccucuucucccugcuccaguagucucccuuccaaauaaaucacuuuucugccuuaaaaaaaaaaaaaaaa

SEQ ID NO: 49 - protein, 1134 aa, Homo sapiens
MRFGSKMMPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 50 - protein, 1005 aa, Homo sapiens
MDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 51 - protein, 753 aa, Homo sapiens
MRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 52 - protein, 910 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 53 - protein, 893 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 54 - protein, 195 aa, Homo sapiens
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 55 - protein, 181 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 56 - protein, 181 aa, Homo sapiens; identical to SEQ ID NO: 55

SEQ ID NO: 57 - protein, 135 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 58 - protein, 452 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 59 - protein, 108 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 60 - protein, 568 aa, Homo sapiens
MMGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 61 - protein, 91 aa, Homo sapiens
MCPCPLHRGRGPPAVCACSAGRLGLRSSAAQLTAARLKALGDELHQRTMWRRRARSRRAPAPGALPTYWPWLCAAAQVAALAAWLLGRRNL

SEQ ID NO: 62 - protein, 282 aa, Homo sapiens
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 63 - protein, 124 aa, Homo sapiens
QTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 64 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 65 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 66 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 67 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 68 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 69 - protein, 307 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESLSTCWRRCLYWTQIRELQRPKPLHMPTLLSTTILMMNQWPILMISPLKAGTSL

SEQ ID NO: 70 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 71 - protein, 297 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLGKLTIYPHLMDIELVMI

SEQ ID NO: 72 - protein, 148 aa, Homo sapiens
MVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 73 - protein, 211 aa, Homo sapiens
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 74 - protein, 192 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 75 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 76 - protein, 595 aa, Homo sapiens
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFANLPSCCRWRIRKEFPKSEGQYSGFKSPY

SEQ ID NO: 77 - protein, 1503 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 78 - protein, 1503 aa, Homo sapiens; identical to SEQ ID NO: 77

SEQ ID NO: 79 - protein, 976 aa, Homo sapiens
MNAGPGCEPCTKRPRWGAATTSPAASDARSFPSRQRRVLDPKDAHVQFRVPPSSPACVPGRAGQHRGSATSLVFKQKTITSWMDTKGIKTAESESLDSKENNNTRIESMMSSVQKDNFYQHNVEKLENVSQLSLDKSPTEKSTQYLNQHQTAAMCKWQNEGKHTEQLLESEPQTVTLVPEQFSNANIDRSPQNDDHSDTDSEENRDNQQFLTTVKLANAKQTTEDEQAREAKSHQKCSKSCDPGEDCASCQQDEIDVVPESPLSDVGSEDVGTGPKNDNKLTRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPRCGIRLPLLRPSANHTVTIRVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 80 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 81 - protein, 459 aa, Homo sapiens
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITALTLLALVYLPGVIAAILQLYRGTKYRRFPDWLDHWMLCRKQLGLVALGFAFLHVLYTLVIPIRYYVRWRLGNLTVTQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 82 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 83 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 84 - protein, 113 aa, Homo sapiens
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 85 - protein, 112 aa, Homo sapiens
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 86 - protein, 349 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 87 - protein, 314 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 88 - protein, 300 aa, Homo sapiens
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 89 - protein, 287 aa, Homo sapiens
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 90 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 91 - protein, 357 aa, Homo sapiens
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 92 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 93 - protein, 339 aa, Homo sapiens; identical to SEQ ID NO: 92

SEQ ID NO: 94 - protein, 193 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 95 - protein, 1551 aa, Homo sapiens
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 96 - protein, 1551 aa, Homo sapiens; identical to SEQ ID NO: 95

SEQ ID NO: 97 - RNA, 19 nt, Artificial Sequence
  Chemically synthesized
gagggugaaauucaacccc

SEQ ID NO: 98 - RNA, 19 nt, Artificial Sequence
  Chemically synthesized
gggguugaauuucacccuc

SEQ ID NO: 99 - RNA, 19 nt, Artificial Sequence
  RNA Oligomer
cacccagagaacauuuauu

SEQ ID NO: 100 - RNA, 19 nt, Artificial Sequence
  RNA Oligomer
aauaaauguucucugggug

SEQ ID NO: 101 - RNA, 19 nt, Artificial Sequence
  RNA Oligomer
gggugaaauucaacccccu

SEQ ID NO: 102 - RNA, 19 nt, Artificial Sequence
  RNA Oligomer
aggggguugaauuucaccc

SEQ ID NO: 103 - RNA, 19 nt, Artificial Sequence
  RNA Oligomer
agggugaaauucaaccccc

SEQ ID NO: 104 - RNA, 19 nt, Artificial Sequence
  RNA Oligomer
ggggguugaauuucacccu

SEQ ID NO: 105 - RNA, 19 nt, Artificial Sequence
  RNA Oligomer
agggaguguuugaauaagc

SEQ ID NO: 106 - RNA, 19 nt, Artificial Sequence
  RNA Oligomer
gcuuauucaaacacucccu

SEQ ID NO: 107 - RNA, 19 nt, Artificial Sequence
  RNA Oligomer
acccagagaacauuuauuc

SEQ ID NO: 108 - RNA, 19 nt, Artificial Sequence
  RNA Oligomer
gaauaaauguucucugggu

SEQ ID NO: 109 - RNA, 19 nt, Artificial Sequence
  RNA Oligomer
cgcugagggagaaagagaa

SEQ ID NO: 110 - RNA, 19 nt, Artificial Sequence
  RNA Oligomer
uucucuuucucccucagcg

SEQ ID NO: 111 - RNA, 19 nt, Artificial Sequence
  RNA Oligomer
cgcaccugaagaaugugaa

SEQ ID NO: 112 - RNA, 19 nt, Artificial Sequence
  RNA Oligomer
uucacauucuucaggugcg

SEQ ID NO: 113 - RNA, 19 nt, Artificial Sequence
  RNA Oligomer
gucuucuacucgcaccuga

SEQ ID NO: 114 - RNA, 19 nt, Artificial Sequence
  RNA Oligomer
ucaggugcgaguagaagac

SEQ ID NO: 115 - RNA, 19 nt, Artificial Sequence
  RNA Oligomer
gacuguuccugaccucaga

SEQ ID NO: 116 - RNA, 19 nt, Artificial Sequence
  RNA Oligomer
ucugaggucaggaacaguc

SEQ ID NO: 117 - RNA, 19 nt, Artificial Sequence
  RNA Oligomer
accucagauuuggacagcu

SEQ ID NO: 118 - RNA, 19 nt, Artificial Sequence
  RNA Oligomer
agcuguccaaaucugaggu

SEQ ID NO: 119 - RNA, 19 nt, Artificial Sequence
  RNA Oligomer
uggggacagaaguacauga

SEQ ID NO: 120 - RNA, 19 nt, Artificial Sequence
  RNA Oligomer
ucauguacuucugucccca

SEQ ID NO: 121 - RNA, 19 nt, Artificial Sequence
  RNA Oligomer
gggcccuuuaccaggaauu

SEQ ID NO: 122 - RNA, 19 nt, Artificial Sequence
  RNA Oligomer
aauuccugguaaagggccc

SEQ ID NO: 123 - RNA, 19 nt, Artificial Sequence
  RNA Oligomer
cccuuuaccaggaauuacu

SEQ ID NO: 124 - RNA, 19 nt, Artificial Sequence
  RNA Oligomer
aguaauuccugguaaaggg

SEQ ID NO: 125 - RNA, 19 nt, Artificial Sequence
  RNA Oligomer
gaaggaacauugcagagcu

SEQ ID NO: 126 - RNA, 19 nt, Artificial Sequence
  RNA Oligomer
agcucugcaauguuccuuc

SEQ ID NO: 127 - RNA, 19 nt, Artificial Sequence
  RNA Oligomer
acagauaaaagaaggaaca

SEQ ID NO: 128 - RNA, 19 nt, Artificial Sequence
  RNA Oligomer
uguuccuucuuuuaucugu

SEQ ID NO: 129 - RNA, 19 nt, Artificial Sequence
  RNA Oligomer
auccuaguauuccuaaccu

SEQ ID NO: 130 - RNA, 19 nt, Artificial Sequence
  RNA Oligomer
agguuaggaauacuaggau

SEQ ID NO: 131 - RNA, 19 nt, Artificial Sequence
  RNA Oligomer
aucccaguauuccuagccu

SEQ ID NO: 132 - RNA, 19 nt, Artificial Sequence
  RNA Oligomer
aggcuaggaauacugggau

SEQ ID NO: 133 - RNA, 19 nt, Artificial Sequence
  RNA Oligomer
gcacuccugaauuuuauca

SEQ ID NO: 134 - RNA, 19 nt, Artificial Sequence
  RNA Oligomer
ugauaaaauucaggagugc

SEQ ID NO: 135 - RNA, 19 nt, Artificial Sequence
  RNA Oligomer
gcacaggaaaugcaagaga

SEQ ID NO: 136 - RNA, 19 nt, Artificial Sequence
  RNA Oligomer
ucucuugcauuuccugugc

SEQ ID NO: 137 - RNA, 19 nt, Artificial Sequence
  RNA Oligomer
gggcuugugauaugcacgu

SEQ ID NO: 138 - RNA, 19 nt, Artificial Sequence
  RNA Oligomer
acgugcauaucacaagccc

SEQ ID NO: 139 - RNA, 19 nt, Artificial Sequence
  RNA Oligomer
gccagaauguggaacuccu

SEQ ID NO: 140 - RNA, 19 nt, Artificial Sequence
  RNA Oligomer
aggaguuccacauucuggc

SEQ ID NO: 141 - RNA, 19 nt, Artificial Sequence
  RNA Oligomer
uccuggaacuucacaugaa

SEQ ID NO: 142 - RNA, 19 nt, Artificial Sequence
  RNA Oligomer
uucaugugaaguuccagga

SEQ ID NO: 143 - RNA, 19 nt, Artificial Sequence
  RNA Oligomer
gguguucauuucuauuaca

SEQ ID NO: 144 - RNA, 19 nt, Artificial Sequence
  RNA Oligomer
uguaauagaaaugaacacc

SEQ ID NO: 145 - RNA, 19 nt, Artificial Sequence
  RNA Oligomer
acacacaccauguuuucau

SEQ ID NO: 146 - RNA, 19 nt, Artificial Sequence
  RNA Oligomer
augaaaacauggugugugu

SEQ ID NO: 147 - RNA, 19 nt, Artificial Sequence
  RNA Oligomer
gguacacacaccauguuuu

SEQ ID NO: 148 - RNA, 19 nt, Artificial Sequence
  RNA Oligomer
aaaacaugguguguguacc

SEQ ID NO: 149 - RNA, 19 nt, Artificial Sequence
  RNA Oligomer
cacuuucugaguuaucaua

SEQ ID NO: 150 - RNA, 19 nt, Artificial Sequence
  RNA Oligomer
uaugauaacucagaaagug

SEQ ID NO: 151 - RNA, 19 nt, Artificial Sequence
  RNA Oligomer
cugaaaucuauaugguaca

SEQ ID NO: 152 - RNA, 19 nt, Artificial Sequence
  RNA Oligomer
uguaccauauagauuucag

SEQ ID NO: 153 - RNA, 19 nt, Artificial Sequence
  RNA Oligomer
cuggcgauuucaacaagaa

SEQ ID NO: 154 - RNA, 19 nt, Artificial Sequence
  RNA Oligomer
uucuuguugaaaucgccag

SEQ ID NO: 155 - RNA, 19 nt, Artificial Sequence
  RNA Oligomer
ucuggcgauuucaacaaga

SEQ ID NO: 156 - RNA, 19 nt, Artificial Sequence
  RNA Oligomer
ucuuguugaaaucgccaga

SEQ ID NO: 157 - RNA, 19 nt, Artificial Sequence
  RNA Oligomer
ccccaaugcuauuuacaua

SEQ ID NO: 158 - RNA, 19 nt, Artificial Sequence
  RNA Oligomer
uauguaaauagcauugggg

SEQ ID NO: 159 - RNA, 19 nt, Artificial Sequence
  RNA Oligomer
augcuauuuacauacagcu

SEQ ID NO: 160 - RNA, 19 nt, Artificial Sequence
  RNA Oligomer
agcuguauguaaauagcau

SEQ ID NO: 161 - RNA, 19 nt, Artificial Sequence
  RNA Oligomer
ccccaaugcuauuuacaua

SEQ ID NO: 162 - RNA, 19 nt, Artificial Sequence
  RNA Oligomer
uauguaaauagcauugggg

SEQ ID NO: 163 - RNA, 19 nt, Artificial Sequence
  RNA Oligomer
augcuauuuacauacagcu

SEQ ID NO: 164 - RNA, 19 nt, Artificial Sequence
  RNA Oligomer
agcuguauguaaauagcau

SEQ ID NO: 165 - RNA, 19 nt, Artificial Sequence
  RNA Oligomer
gagccugaacugacaucaa

SEQ ID NO: 166 - RNA, 19 nt, Artificial Sequence
  RNA Oligomer
uugaugucaguucaggcuc

SEQ ID NO: 167 - RNA, 19 nt, Artificial Sequence
  RNA Oligomer
gagacauggaaaaaauacu

SEQ ID NO: 168 - RNA, 19 nt, Artificial Sequence
  RNA Oligomer
aguauuuuuuccaugucuc

SEQ ID NO: 169 - RNA, 19 nt, Artificial Sequence
  RNA Oligomer
gacauggaaaaaauacugc

SEQ ID NO: 170 - RNA, 19 nt, Artificial Sequence
  RNA Oligomer
gcaguauuuuuuccauguc

SEQ ID NO: 171 - RNA, 19 nt, Artificial Sequence
  RNA Oligomer
acccucagcaugaggaaca

SEQ ID NO: 172 - RNA, 19 nt, Artificial Sequence
  RNA Oligomer
uguuccucaugcugagggu

SEQ ID NO: 173 - RNA, 19 nt, Artificial Sequence
  RNA Oligomer
gaaaaacucagauuggaua

SEQ ID NO: 174 - RNA, 19 nt, Artificial Sequence
  RNA Oligomer
uauccaaucugaguuuuuc

SEQ ID NO: 175 - RNA, 19 nt, Artificial Sequence
  RNA Oligomer
cugcauuggugaauuuaau

SEQ ID NO: 176 - RNA, 19 nt, Artificial Sequence
  RNA Oligomer
auuaaauucaccaaugcag

SEQ ID NO: 177 - RNA, 19 nt, Artificial Sequence
  RNA Oligomer
cagguugucuacuaaagaa

SEQ ID NO: 178 - RNA, 19 nt, Artificial Sequence
  RNA Oligomer
uucuuuaguagacaaccug

SEQ ID NO: 179 - RNA, 19 nt, Artificial Sequence
  RNA Oligomer
gccuuauauaucacacuau

SEQ ID NO: 180 - RNA, 19 nt, Artificial Sequence
  RNA Oligomer
auagugugauauauaaggc

SEQ ID NO: 181 - RNA, 19 nt, Artificial Sequence
  RNA Oligomer
ggaauuaagucuccgauua

SEQ ID NO: 182 - RNA, 19 nt, Artificial Sequence
  RNA Oligomer
uaaucggagacuuaauucc

SEQ ID NO: 183 - RNA, 19 nt, Artificial Sequence
  RNA Oligomer
agguugucuacuaaagaaa

SEQ ID NO: 184 - RNA, 19 nt, Artificial Sequence
  RNA Oligomer
uuucuuuaguagacaaccu

SEQ ID NO: 185 - RNA, 19 nt, Artificial Sequence
  RNA Oligomer
gagaaaaacagcucacagu

SEQ ID NO: 186 - RNA, 19 nt, Artificial Sequence
  RNA Oligomer
acugugagcuguuuuucuc

SEQ ID NO: 187 - RNA, 19 nt, Artificial Sequence
  RNA Oligomer
ccaagauagagcuacaaac

SEQ ID NO: 188 - RNA, 19 nt, Artificial Sequence
  RNA Oligomer
guuuguagcucuaucuugg

SEQ ID NO: 189 - RNA, 19 nt, Artificial Sequence
  RNA Oligomer
cacucugcauuggugaauu

SEQ ID NO: 190 - RNA, 19 nt, Artificial Sequence
  RNA Oligomer
aauucaccaaugcagagug

SEQ ID NO: 191 - RNA, 19 nt, Artificial Sequence
  RNA Oligomer
ccuuaauucagcugaagua

SEQ ID NO: 192 - RNA, 19 nt, Artificial Sequence
  RNA Oligomer
uacuucagcugaauuaagg

SEQ ID NO: 193 - RNA, 19 nt, Artificial Sequence
  RNA Oligomer
guucaacuuuugugugcuu

SEQ ID NO: 194 - RNA, 19 nt, Artificial Sequence
  RNA Oligomer
aagcacacaaaaguugaac

SEQ ID NO: 195 - RNA, 19 nt, Artificial Sequence
  RNA Oligomer
uccuuuguguucaacuuuu

SEQ ID NO: 196 - RNA, 19 nt, Artificial Sequence
  RNA Oligomer
aaaaguugaacacaaagga

SEQ ID NO: 197 - RNA, 19 nt, Artificial Sequence
  RNA Oligomer
accacagaaaucccuagaa

SEQ ID NO: 198 - RNA, 19 nt, Artificial Sequence
  RNA Oligomer
uucuagggauuucuguggu

SEQ ID NO: 199 - RNA, 19 nt, Artificial Sequence
  RNA Oligomer
gccgaccauuucagaauca

SEQ ID NO: 200 - RNA, 19 nt, Artificial Sequence
  RNA Oligomer
ugauucugaaauggucggc

SEQ ID NO: 201 - RNA, 19 nt, Artificial Sequence
  RNA Oligomer
ggacuuacguugaaaacag

SEQ ID NO: 202 - RNA, 19 nt, Artificial Sequence
  RNA Oligomer
cuguuuucaacguaagucc

SEQ ID NO: 203 - RNA, 19 nt, Artificial Sequence
  RNA Oligomer
uggaugcaaaucuuugcca

SEQ ID NO: 204 - RNA, 19 nt, Artificial Sequence
  RNA Oligomer
uggcaaagauuugcaucca

SEQ ID NO: 205 - RNA, 19 nt, Artificial Sequence
  RNA Oligomer
gaccauuucaguccaucau

SEQ ID NO: 206 - RNA, 19 nt, Artificial Sequence
  RNA Oligomer
augauggacugaaaugguc

SEQ ID NO: 207 - RNA, 19 nt, Artificial Sequence
  RNA Oligomer
gaggucuaaaguauauaca

SEQ ID NO: 208 - RNA, 19 nt, Artificial Sequence
  RNA Oligomer
uguauauacuuuagaccuc

SEQ ID NO: 209 - RNA, 19 nt, Artificial Sequence
  RNA Oligomer
gugcugcuuuugacacaaa

SEQ ID NO: 210 - RNA, 19 nt, Artificial Sequence
  RNA Oligomer
uuugugucaaaagcagcac

SEQ ID NO: 211 - RNA, 19 nt, Artificial Sequence
  RNA Oligomer
uuggugcuguaaaauaccu

SEQ ID NO: 212 - RNA, 19 nt, Artificial Sequence
  RNA Oligomer
agguauuuuacagcaccaa

SEQ ID NO: 213 - RNA, 19 nt, Artificial Sequence
  RNA Oligomer
gaguccugcaucauuugaa

SEQ ID NO: 214 - RNA, 19 nt, Artificial Sequence
  RNA Oligomer
uucaaaugaugcaggacuc

SEQ ID NO: 215 - RNA, 19 nt, Artificial Sequence
  RNA Oligomer
gauguguucuuaauuugcu

SEQ ID NO: 216 - RNA, 19 nt, Artificial Sequence
  RNA Oligomer
agcaaauuaagaacacauc

SEQ ID NO: 217 - RNA, 19 nt, Artificial Sequence
  RNA Oligomer
gucaagccaaacacaaaca

SEQ ID NO: 218 - RNA, 19 nt, Artificial Sequence
  RNA Oligomer
uguuuguguuuggcuugac

SEQ ID NO: 219 - RNA, 19 nt, Artificial Sequence
  RNA Oligomer
guccagcaauuaauaaaac

SEQ ID NO: 220 - RNA, 19 nt, Artificial Sequence
  RNA Oligomer
guuuuauuaauugcuggac

SEQ ID NO: 221 - RNA, 19 nt, Artificial Sequence
  RNA Oligomer
gugccauaccaguuaaaca

SEQ ID NO: 222 - RNA, 19 nt, Artificial Sequence
  RNA Oligomer
uguuuaacugguauggcac

SEQ ID NO: 223 - RNA, 19 nt, Artificial Sequence
  RNA Oligomer
gcaaaaugaaagagaacau

SEQ ID NO: 224 - RNA, 19 nt, Artificial Sequence
  RNA Oligomer
auguucucuuucauuuugc

SEQ ID NO: 225 - RNA, 19 nt, Artificial Sequence
  RNA Oligomer
gcauuucucaugaauuaga

SEQ ID NO: 226 - RNA, 19 nt, Artificial Sequence
  RNA Oligomer
ucuaauucaugagaaaugc

SEQ ID NO: 227 - RNA, 19 nt, Artificial Sequence
  RNA Oligomer
ccgcauuucucaugaauua

SEQ ID NO: 228 - RNA, 19 nt, Artificial Sequence
  RNA Oligomer
uaauucaugagaaaugcgg

SEQ ID NO: 229 - RNA, 19 nt, Artificial Sequence
  RNA Oligomer
guaccaguuaauuuuucca

SEQ ID NO: 230 - RNA, 19 nt, Artificial Sequence
  RNA Oligomer
uggaaaaauuaacugguac

SEQ ID NO: 231 - RNA, 19 nt, Artificial Sequence
  RNA Oligomer
uagaaaacaucccagaaaa

SEQ ID NO: 232 - RNA, 19 nt, Artificial Sequence
  RNA Oligomer
uuuucugggauguuuucua

SEQ ID NO: 233 - RNA, 19 nt, Artificial Sequence
  RNA Oligomer
accaguuaauuuuuccaac

SEQ ID NO: 234 - RNA, 19 nt, Artificial Sequence
  RNA Oligomer
guuggaaaaauuaacuggu

SEQ ID NO: 235 - RNA, 19 nt, Artificial Sequence
  RNA Oligomer
gccacuuaauguauguuac

SEQ ID NO: 236 - RNA, 19 nt, Artificial Sequence
  RNA Oligomer
guaacauacauuaaguggc

SEQ ID NO: 237 - RNA, 19 nt, Artificial Sequence
  RNA Oligomer
gggcaguuuuuugaaaaug

SEQ ID NO: 238 - RNA, 19 nt, Artificial Sequence
  RNA Oligomer
cauuuucaaaaaacugccc

SEQ ID NO: 239 - RNA, 19 nt, Artificial Sequence
  RNA Oligomer
ggcuaaguaaauaggaauu

SEQ ID NO: 240 - RNA, 19 nt, Artificial Sequence
  RNA Oligomer
aauuccuauuuacuuagcc

SEQ ID NO: 241 - RNA, 19 nt, Artificial Sequence
  RNA Oligomer
ccuguggaaagacaugcuu

SEQ ID NO: 242 - RNA, 19 nt, Artificial Sequence
  RNA Oligomer
aagcaugucuuuccacagg

SEQ ID NO: 243 - RNA, 19 nt, Artificial Sequence
  RNA Oligomer
gugcucuuuucuccucacu

SEQ ID NO: 244 - RNA, 19 nt, Artificial Sequence
  RNA Oligomer
agugaggagaaaagagcac

SEQ ID NO: 245 - RNA, 19 nt, Artificial Sequence
  RNA Oligomer
gggcuaaguaaauaggaau

SEQ ID NO: 246 - RNA, 19 nt, Artificial Sequence
  RNA Oligomer
auuccuauuuacuuagccc

SEQ ID NO: 247 - RNA, 19 nt, Artificial Sequence
  RNA Oligomer
gugggcaguuuuuugaaaa

SEQ ID NO: 248 - RNA, 19 nt, Artificial Sequence
  RNA Oligomer
uuuucaaaaaacugcccac

SEQ ID NO: 249 - RNA, 19 nt, Artificial Sequence
  RNA Oligomer
ggugccuugucuugugaaa

SEQ ID NO: 250 - RNA, 19 nt, Artificial Sequence
  RNA Oligomer
uuucacaagacaaggcacc

SEQ ID NO: 251 - RNA, 19 nt, Artificial Sequence
  RNA Oligomer
cccaaguucaugcagcugu

SEQ ID NO: 252 - RNA, 19 nt, Artificial Sequence
  RNA Oligomer
acagcugcaugaacuuggg

SEQ ID NO: 253 - RNA, 19 nt, Artificial Sequence
  RNA Oligomer
ggcacucagucucucuucu

SEQ ID NO: 254 - RNA, 19 nt, Artificial Sequence
  RNA Oligomer
agaagagagacugagugcc

SEQ ID NO: 255 - RNA, 19 nt, Artificial Sequence
  RNA Oligomer
cacuuuggaagauggcaua

SEQ ID NO: 256 - RNA, 19 nt, Artificial Sequence
  RNA Oligomer
uaugccaucuuccaaagug

SEQ ID NO: 257 - RNA, 19 nt, Artificial Sequence
  RNA Oligomer
gagagaaguuccaacgcag

SEQ ID NO: 258 - RNA, 19 nt, Artificial Sequence
  RNA Oligomer
cugcguuggaacuucucuc

SEQ ID NO: 259 - RNA, 19 nt, Artificial Sequence
  RNA Oligomer
cgagagaaguuccaacgca

SEQ ID NO: 260 - RNA, 38 nt, Artificial Sequence
  RNA Oligomer
ugcguuggaacuucucucgcugcguuggaacuucucuc

SEQ ID NO: 261 - RNA, 19 nt, Artificial Sequence
  RNA Oligomer
accgagagaaguuccaacg

SEQ ID NO: 262 - RNA, 19 nt, Artificial Sequence
  RNA Oligomer
cguuggaacuucucucggu

SEQ ID NO: 263 - RNA, 19 nt, Artificial Sequence
  RNA Oligomer
agauccccaaggaguauga

SEQ ID NO: 264 - RNA, 19 nt, Artificial Sequence
  RNA Oligomer
ucauacuccuuggggaucu

SEQ ID NO: 265 - RNA, 19 nt, Artificial Sequence
  RNA Oligomer
uugccuccauccucaaaga

SEQ ID NO: 266 - RNA, 19 nt, Artificial Sequence
  RNA Oligomer
ucuuugaggauggaggcaa

SEQ ID NO: 267 - RNA, 23 nt, Artificial Sequence
  RNA Oligomer
ccuugcacuccugaauuuuauca

SEQ ID NO: 268 - RNA, 23 nt, Artificial Sequence
  RNA Oligomer
ugauaaaauucaggagugcaagg

SEQ ID NO: 269 - RNA, 23 nt, Artificial Sequence
  RNA Oligomer
cuugcacuccugaauuuuaucaa

SEQ ID NO: 270 - RNA, 23 nt, Artificial Sequence
  RNA Oligomer
uugauaaaauucaggagugcaag

SEQ ID NO: 271 - RNA, 23 nt, Artificial Sequence
  RNA Oligomer
uugcacuccugaauuuuaucaaa

SEQ ID NO: 272 - RNA, 23 nt, Artificial Sequence
  RNA Oligomer
uuugauaaaauucaggagugcaa

SEQ ID NO: 273 - RNA, 23 nt, Artificial Sequence
  RNA Oligomer
ugcacuccugaauuuuaucaaac

SEQ ID NO: 274 - RNA, 23 nt, Artificial Sequence
  RNA Oligomer
guuugauaaaauucaggagugca

SEQ ID NO: 275 - RNA, 23 nt, Artificial Sequence
  RNA Oligomer
gcacuccugaauuuuaucaaaca

SEQ ID NO: 276 - RNA, 23 nt, Artificial Sequence
  RNA Oligomer
uguuugauaaaauucaggagugc

SEQ ID NO: 277 - RNA, 19 nt, Artificial Sequence
  RNA Oligomer
ccaguaauuagauguagaa

SEQ ID NO: 278 - RNA, 19 nt, Artificial Sequence
  RNA Oligomer
ccaagaauuaaaccaagac

SEQ ID NO: 279 - RNA, 19 nt, Artificial Sequence
  RNA Oligomer
cccaagaauuaaaccaaga

SEQ ID NO: 280 - RNA, 19 nt, Artificial Sequence
  RNA Oligomer
caagaauuaaaccaagaca

SEQ ID NO: 281 - RNA, 19 nt, Artificial Sequence
  RNA Oligomer
ccaacuaaauuacugccuu

SEQ ID NO: 282 - RNA, 19 nt, Artificial Sequence
  RNA Oligomer
ggauugaagaauucaccau

SEQ ID NO: 283 - RNA, 19 nt, Artificial Sequence
  RNA Oligomer
ccacagggaagacgaagau

SEQ ID NO: 284 - RNA, 19 nt, Artificial Sequence
  RNA Oligomer
ucccaucauacccauccaa

SEQ ID NO: 285 - RNA, 19 nt, Artificial Sequence
  RNA Oligomer
gcguugaccaagacucaua

SEQ ID NO: 286 - RNA, 19 nt, Artificial Sequence
  RNA Oligomer
acaccuuacuuccacccuu

SEQ ID NO: 287 - RNA, 19 nt, Artificial Sequence
  RNA Oligomer
guaccaguaauuagaugua

SEQ ID NO: 288 - RNA, 19 nt, Artificial Sequence
  RNA Oligomer
cgcugagggagaaagagaa

SEQ ID NO: 289 - RNA, 19 nt, Artificial Sequence
  RNA Oligomer
ggaucugacucuugcugaa

SEQ ID NO: 290 - RNA, 19 nt, Artificial Sequence
  RNA Oligomer
uacccaagaauuaaaccaa

SEQ ID NO: 291 - RNA, 19 nt, Artificial Sequence
  RNA Oligomer
guacccaagaauuaaacca

SEQ ID NO: 292 - RNA, 19 nt, Artificial Sequence
  RNA Oligomer
ggagucauuuaugcgcuuu

SEQ ID NO: 293 - RNA, 19 nt, Artificial Sequence
  RNA Oligomer
guccaaguguguaaguuuu

SEQ ID NO: 294 - RNA, 19 nt, Artificial Sequence
  RNA Oligomer
ggacaaacuugcguaaaac

SEQ ID NO: 295 - RNA, 19 nt, Artificial Sequence
  RNA Oligomer
ccauccaagucagcuucug

SEQ ID NO: 296 - RNA, 19 nt, Artificial Sequence
  RNA Oligomer
gaauaagcguaauucagaa

SEQ ID NO: 297 - RNA, 19 nt, Artificial Sequence
  RNA Oligomer
ggaaauugaacagaugaau

SEQ ID NO: 298 - RNA, 19 nt, Artificial Sequence
  RNA Oligomer
gucuuuuguaucucagaaa

SEQ ID NO: 299 - RNA, 19 nt, Artificial Sequence
  RNA Oligomer
cuguacccaagaauuaaac

SEQ ID NO: 300 - RNA, 19 nt, Artificial Sequence
  RNA Oligomer
acuguacccaagaauuaaa

SEQ ID NO: 301 - RNA, 19 nt, Artificial Sequence
  RNA Oligomer
ccaaguguguaaguuuuug

SEQ ID NO: 302 - RNA, 19 nt, Artificial Sequence
  RNA Oligomer
gccacacagaaaucguuaa

SEQ ID NO: 303 - RNA, 19 nt, Artificial Sequence
  RNA Oligomer
ggcuccacaugugcuugau

SEQ ID NO: 304 - RNA, 19 nt, Artificial Sequence
  RNA Oligomer
cccaucauacccauccaag

SEQ ID NO: 305 - RNA, 19 nt, Artificial Sequence
  RNA Oligomer
gucccaucauacccaucca

SEQ ID NO: 306 - RNA, 19 nt, Artificial Sequence
  RNA Oligomer
ccaucucugucccaucaua

SEQ ID NO: 307 - RNA, 19 nt, Artificial Sequence
  RNA Oligomer
ccaugaaaacgaaagaauu

SEQ ID NO: 308 - RNA, 19 nt, Artificial Sequence
  RNA Oligomer
ggcugcuucacaaacuaaa

SEQ ID NO: 309 - RNA, 19 nt, Artificial Sequence
  RNA Oligomer
cucuacagcaaaaagaaaa

SEQ ID NO: 310 - RNA, 19 nt, Artificial Sequence
  RNA Oligomer
agaaaggagaacgguguua

SEQ ID NO: 311 - RNA, 19 nt, Artificial Sequence
  RNA Oligomer
ggcugaauuuuaaucugua

SEQ ID NO: 312 - RNA, 19 nt, Artificial Sequence
  RNA Oligomer
accaguaauuagauguaga

SEQ ID NO: 313 - RNA, 19 nt, Artificial Sequence
  RNA Oligomer
gaaugaaggauugaagaau

SEQ ID NO: 314 - RNA, 19 nt, Artificial Sequence
  RNA Oligomer
ggauuaugaaccucagaau

SEQ ID NO: 315 - RNA, 19 nt, Artificial Sequence
  RNA Oligomer
gcauaaugaauaaaggagu

SEQ ID NO: 316 - RNA, 19 nt, Artificial Sequence
  RNA Oligomer
ggagggagaauuugaccuu

SEQ ID NO: 317 - RNA, 19 nt, Artificial Sequence
  RNA Oligomer
cccauccaagucagcuucu

SEQ ID NO: 318 - RNA, 19 nt, Artificial Sequence
  RNA Oligomer
cccaacuaaauuacugccu

SEQ ID NO: 319 - RNA, 19 nt, Artificial Sequence
  RNA Oligomer
ggagaaccaugaaaacgaa

SEQ ID NO: 320 - RNA, 19 nt, Artificial Sequence
  RNA Oligomer
gcacccagagaacauuuau

SEQ ID NO: 321 - RNA, 19 nt, Artificial Sequence
  RNA Oligomer
caccuuacuuccacccuuc

SEQ ID NO: 322 - RNA, 19 nt, Artificial Sequence
  RNA Oligomer
gccuuauuuuggacaaacu

SEQ ID NO: 323 - RNA, 19 nt, Artificial Sequence
  RNA Oligomer
ccagagcagugaagauauc

SEQ ID NO: 324 - RNA, 19 nt, Artificial Sequence
  RNA Oligomer
uccuucaaaugcagaucuu

SEQ ID NO: 325 - RNA, 19 nt, Artificial Sequence
  RNA Oligomer
ccaguuacuccagaaacaa

SEQ ID NO: 326 - RNA, 19 nt, Artificial Sequence
  RNA Oligomer
caaauugaaucaagagcag

SEQ ID NO: 327 - RNA, 19 nt, Artificial Sequence
  RNA Oligomer
acaaauugaaucaagagca

SEQ ID NO: 328 - RNA, 19 nt, Artificial Sequence
  RNA Oligomer
ggcugugucaaaaguagaa

SEQ ID NO: 329 - RNA, 19 nt, Artificial Sequence
  RNA Oligomer
ccagcaaaaacagagggag

SEQ ID NO: 330 - RNA, 19 nt, Artificial Sequence
  RNA Oligomer
ggaagcuaagcuaaaaaaa

SEQ ID NO: 331 - RNA, 19 nt, Artificial Sequence
  RNA Oligomer
ccguguaucucaguaacaa

SEQ ID NO: 332 - RNA, 19 nt, Artificial Sequence
  RNA Oligomer
cgguaccaguaauuagaug

SEQ ID NO: 333 - RNA, 19 nt, Artificial Sequence
  RNA Oligomer
gcgugaugaaauaaagcau

SEQ ID NO: 334 - RNA, 19 nt, Artificial Sequence
  RNA Oligomer
agagaaugaaggauugaag

SEQ ID NO: 335 - RNA, 19 nt, Artificial Sequence
  RNA Oligomer
uccaaguguguaaguuuuu

SEQ ID NO: 336 - RNA, 19 nt, Artificial Sequence
  RNA Oligomer
ccacacagaaaucguuaag

SEQ ID NO: 337 - RNA, 19 nt, Artificial Sequence
  RNA Oligomer
ugaccuuguacagagaauu

SEQ ID NO: 338 - RNA, 19 nt, Artificial Sequence
  RNA Oligomer
cugguaaaaggacaaacuu

SEQ ID NO: 339 - RNA, 19 nt, Artificial Sequence
  RNA Oligomer
acccauccaagucagcuuc

SEQ ID NO: 340 - RNA, 19 nt, Artificial Sequence
  RNA Oligomer
accaugaaaacgaaagaau

SEQ ID NO: 341 - RNA, 19 nt, Artificial Sequence
  RNA Oligomer
cacccagagaacauuuauu

SEQ ID NO: 342 - RNA, 19 nt, Artificial Sequence
  RNA Oligomer
cuacagcaaaaagaaaauc

SEQ ID NO: 343 - RNA, 19 nt, Artificial Sequence
  RNA Oligomer
cugcagcuaagaaacaaau

SEQ ID NO: 344 - RNA, 19 nt, Artificial Sequence
  RNA Oligomer
gcugcagcuaagaaacaaa

SEQ ID NO: 345 - RNA, 19 nt, Artificial Sequence
  RNA Oligomer
aggaagcuaagcuaaaaaa

SEQ ID NO: 346 - RNA, 19 nt, Artificial Sequence
  RNA Oligomer
caggaagcuaagcuaaaaa

SEQ ID NO: 347 - RNA, 19 nt, Artificial Sequence
  RNA Oligomer
gcgacaacagcaacaaguu

SEQ ID NO: 348 - RNA, 19 nt, Artificial Sequence
  RNA Oligomer
cccguaauauuugucaaga

SEQ ID NO: 349 - RNA, 19 nt, Artificial Sequence
  RNA Oligomer
agaaugaaggauugaagaa

SEQ ID NO: 350 - RNA, 19 nt, Artificial Sequence
  RNA Oligomer
cacacagaauuuuagucaa

SEQ ID NO: 351 - RNA, 19 nt, Artificial Sequence
  RNA Oligomer
ccacacagaauuuuaguca

SEQ ID NO: 352 - RNA, 19 nt, Artificial Sequence
  RNA Oligomer
gacuguacccaagaauuaa

SEQ ID NO: 353 - RNA, 19 nt, Artificial Sequence
  RNA Oligomer
aggagucauuuaugcgcuu

SEQ ID NO: 354 - RNA, 19 nt, Artificial Sequence
  RNA Oligomer
ggcauaaugaauaaaggag

SEQ ID NO: 355 - RNA, 19 nt, Artificial Sequence
  RNA Oligomer
cguccaaguguguaaguuu

SEQ ID NO: 356 - RNA, 19 nt, Artificial Sequence
  RNA Oligomer
acguccaaguguguaaguu

SEQ ID NO: 357 - RNA, 19 nt, Artificial Sequence
  RNA Oligomer
accuuguacagagaauuau

SEQ ID NO: 358 - RNA, 19 nt, Artificial Sequence
  RNA Oligomer
gaaugagggugaaauucaa

SEQ ID NO: 359 - RNA, 19 nt, Artificial Sequence
  RNA Oligomer
gcguaaaacuggcucagag

SEQ ID NO: 360 - RNA, 19 nt, Artificial Sequence
  RNA Oligomer
ccagaauccauauuuacau

SEQ ID NO: 361 - RNA, 19 nt, Artificial Sequence
  RNA Oligomer
gccaaauauucagaagcuu

SEQ ID NO: 362 - RNA, 19 nt, Artificial Sequence
  RNA Oligomer
gaacauuuauuccaauagc

SEQ ID NO: 363 - RNA, 19 nt, Artificial Sequence
  RNA Oligomer
agcacccagagaacauuua

SEQ ID NO: 364 - RNA, 19 nt, Artificial Sequence
  RNA Oligomer
ccagaaucaacagcagcac

SEQ ID NO: 365 - RNA, 19 nt, Artificial Sequence
  RNA Oligomer
cgcguugaccaagacucau

SEQ ID NO: 366 - RNA, 19 nt, Artificial Sequence
  RNA Oligomer
agaagaaagugcguccguu

SEQ ID NO: 367 - RNA, 19 nt, Artificial Sequence
  RNA Oligomer
ugauuggaguccuucaaau

SEQ ID NO: 368 - RNA, 19 nt, Artificial Sequence
  RNA Oligomer
gggcugcuucacaaacuaa

SEQ ID NO: 369 - RNA, 19 nt, Artificial Sequence
  RNA Oligomer
ggaagaagaaggcagcucu

SEQ ID NO: 370 - RNA, 19 nt, Artificial Sequence
  RNA Oligomer
ggauaagcguguuaaugag

SEQ ID NO: 371 - RNA, 19 nt, Artificial Sequence
  RNA Oligomer
caacaacagagggaguguu

SEQ ID NO: 372 - RNA, 19 nt, Artificial Sequence
  RNA Oligomer
ucaggaagcuaagcuaaaa

SEQ ID NO: 373 - RNA, 19 nt, Artificial Sequence
  RNA Oligomer
acaacaagaucagcgacaa

SEQ ID NO: 374 - RNA, 19 nt, Artificial Sequence
  RNA Oligomer
cgcuuaaaguuuuugaaac

SEQ ID NO: 375 - RNA, 19 nt, Artificial Sequence
  RNA Oligomer
cuaaggaacagcgcuuaaa

SEQ ID NO: 376 - RNA, 19 nt, Artificial Sequence
  RNA Oligomer
gcaacagauugaagcccag

SEQ ID NO: 377 - RNA, 19 nt, Artificial Sequence
  RNA Oligomer
gccagcagcaacagauuga

SEQ ID NO: 378 - RNA, 19 nt, Artificial Sequence
  RNA Oligomer
ugucuuuuguaucucagaa

SEQ ID NO: 379 - RNA, 19 nt, Artificial Sequence
  RNA Oligomer
gcacugcacacuuguauau

SEQ ID NO: 380 - RNA, 19 nt, Artificial Sequence
  RNA Oligomer
gaagaugaaaucgaauggu

SEQ ID NO: 381 - RNA, 19 nt, Artificial Sequence
  RNA Oligomer
agaugggcauaaugaauaa

SEQ ID NO: 382 - RNA, 19 nt, Artificial Sequence
  RNA Oligomer
guaaguuuuugguggaguc

SEQ ID NO: 383 - RNA, 19 nt, Artificial Sequence
  RNA Oligomer
guguaaguuuuugguggag

SEQ ID NO: 384 - RNA, 19 nt, Artificial Sequence
  RNA Oligomer
ggccacacagaaaucguua

SEQ ID NO: 385 - RNA, 19 nt, Artificial Sequence
  RNA Oligomer
cggcucuucacaaugcugu

SEQ ID NO: 386 - RNA, 19 nt, Artificial Sequence
  RNA Oligomer
ccuuguacagagaauuauu

SEQ ID NO: 387 - RNA, 19 nt, Artificial Sequence
  RNA Oligomer
ccaguagaaauccagaauc

SEQ ID NO: 388 - RNA, 19 nt, Artificial Sequence
  RNA Oligomer
uacgaaagaaacugucuaa

SEQ ID NO: 389 - RNA, 19 nt, Artificial Sequence
  RNA Oligomer
cggauaaugagcgaauguu

SEQ ID NO: 390 - RNA, 19 nt, Artificial Sequence
  RNA Oligomer
cccagaaucaacagcagca

SEQ ID NO: 391 - RNA, 19 nt, Artificial Sequence
  RNA Oligomer
gaccaagacucauaccaga

SEQ ID NO: 392 - RNA, 19 nt, Artificial Sequence
  RNA Oligomer
cguugaccaagacucauac

SEQ ID NO: 393 - RNA, 19 nt, Artificial Sequence
  RNA Oligomer
gggaacuaaaccaaaacca

SEQ ID NO: 394 - RNA, 19 nt, Artificial Sequence
  RNA Oligomer
cuacaaaaccaaaacagau

SEQ ID NO: 395 - RNA, 19 nt, Artificial Sequence
  RNA Oligomer
uccuacaaaaccaaaacag

SEQ ID NO: 396 - RNA, 19 nt, Artificial Sequence
  RNA Oligomer
gguugcaaauaaaaaugug

SEQ ID NO: 397 - RNA, 19 nt, Artificial Sequence
  RNA Oligomer
agagcagugaagauaucuu

SEQ ID NO: 398 - RNA, 19 nt, Artificial Sequence
  RNA Oligomer
guccuucaaaugcagaucu

SEQ ID NO: 399 - RNA, 19 nt, Artificial Sequence
  RNA Oligomer
ccagaaacaauaugcagag

SEQ ID NO: 400 - RNA, 19 nt, Artificial Sequence
  RNA Oligomer
ggccugaauugcuggugaa

SEQ ID NO: 401 - RNA, 19 nt, Artificial Sequence
  RNA Oligomer
gaaaaucuaccaguuucau

SEQ ID NO: 402 - RNA, 19 nt, Artificial Sequence
  RNA Oligomer
gcguaauucagaaguggca

SEQ ID NO: 403 - RNA, 19 nt, Artificial Sequence
  RNA Oligomer
guguuugaauaagcguaau

SEQ ID NO: 404 - RNA, 19 nt, Artificial Sequence
  RNA Oligomer
agagggaguguuugaauaa

SEQ ID NO: 405 - RNA, 19 nt, Artificial Sequence
  RNA Oligomer
ccaagcuacaacaacagag

SEQ ID NO: 406 - RNA, 19 nt, Artificial Sequence
  RNA Oligomer
ugcagcuaagaaacaaauu

SEQ ID NO: 407 - RNA, 19 nt, Artificial Sequence
  RNA Oligomer
caaaaguagaagaacugac

SEQ ID NO: 408 - RNA, 19 nt, Artificial Sequence
  RNA Oligomer
gucaaaaguagaagaacug

SEQ ID NO: 409 - RNA, 19 nt, Artificial Sequence
  RNA Oligomer
ugugucaaaaguagaagaa

SEQ ID NO: 410 - RNA, 19 nt, Artificial Sequence
  RNA Oligomer
aggaaauugaacagaugaa

SEQ ID NO: 411 - RNA, 19 nt, Artificial Sequence
  RNA Oligomer
ggagaaacuuaaaaggcua

SEQ ID NO: 412 - RNA, 19 nt, Artificial Sequence
  RNA Oligomer
gcgcuuaaaguuuuugaaa

SEQ ID NO: 413 - RNA, 19 nt, Artificial Sequence
  RNA Oligomer
ucugacucuugcugaacuu

SEQ ID NO: 414 - RNA, 19 nt, Artificial Sequence
  RNA Oligomer
gguaccaguaauuagaugu

SEQ ID NO: 415 - RNA, 19 nt, Artificial Sequence
  RNA Oligomer
cuaagcuacgguaccagua

SEQ ID NO: 416 - RNA, 19 nt, Artificial Sequence
  RNA Oligomer
cuggugaauaucgaagaaa

SEQ ID NO: 417 - RNA, 19 nt, Artificial Sequence
  RNA Oligomer
gauugaagaauucaccauu

SEQ ID NO: 418 - RNA, 19 nt, Artificial Sequence
  RNA Oligomer
aagagaaugaaggauugaa

SEQ ID NO: 419 - RNA, 19 nt, Artificial Sequence
  RNA Oligomer
cuagaagagaaugaaggau

SEQ ID NO: 420 - RNA, 19 nt, Artificial Sequence
  RNA Oligomer
ccaugaccuacagugacau

SEQ ID NO: 421 - RNA, 19 nt, Artificial Sequence
  RNA Oligomer
cucauguaacaacguccaa

SEQ ID NO: 422 - RNA, 19 nt, Artificial Sequence
  RNA Oligomer
ccucauguaacaacgucca

SEQ ID NO: 423 - RNA, 19 nt, Artificial Sequence
  RNA Oligomer
aggccacacagaaaucguu

SEQ ID NO: 424 - RNA, 19 nt, Artificial Sequence
  RNA Oligomer
ggagaauuugaccuuguac

SEQ ID NO: 425 - RNA, 19 nt, Artificial Sequence
  RNA Oligomer
agggagaauuugaccuugu

SEQ ID NO: 426 - RNA, 19 nt, Artificial Sequence
  RNA Oligomer
agaggcuccacaugugcuu

SEQ ID NO: 427 - RNA, 19 nt, Artificial Sequence
  RNA Oligomer
ucugucccaucauacccau

SEQ ID NO: 428 - RNA, 19 nt, Artificial Sequence
  RNA Oligomer
ccgaaaccagagugaugcu

SEQ ID NO: 429 - RNA, 19 nt, Artificial Sequence
  RNA Oligomer
gcaaguucaauauauucca

SEQ ID NO: 430 - RNA, 19 nt, Artificial Sequence
  RNA Oligomer
gcgagagugauugccauuu

SEQ ID NO: 431 - RNA, 19 nt, Artificial Sequence
  RNA Oligomer
ugcaaauaaaaauguggcu

SEQ ID NO: 432 - RNA, 19 nt, Artificial Sequence
  RNA Oligomer
cagguugcaaauaaaaaug

SEQ ID NO: 433 - RNA, 19 nt, Artificial Sequence
  RNA Oligomer
gcucagguugcaaauaaaa

SEQ ID NO: 434 - RNA, 19 nt, Artificial Sequence
  RNA Oligomer
cgugguggaucugugcaaa

SEQ ID NO: 435 - RNA, 19 nt, Artificial Sequence
  RNA Oligomer
acgugguggaucugugcaa

SEQ ID NO: 436 - RNA, 19 nt, Artificial Sequence
  RNA Oligomer
cgaugaaaauacagacacu

SEQ ID NO: 437 - RNA, 19 nt, Artificial Sequence
  RNA Oligomer
cgucuacuaugccucggau

SEQ ID NO: 438 - RNA, 19 nt, Artificial Sequence
  RNA Oligomer
caaaaagaaaaucuaccag

SEQ ID NO: 439 - RNA, 19 nt, Artificial Sequence
  RNA Oligomer
acagagggaguguuugaau

SEQ ID NO: 440 - RNA, 19 nt, Artificial Sequence
  RNA Oligomer
gaauaauuuguuccagcaa

SEQ ID NO: 441 - RNA, 19 nt, Artificial Sequence
  RNA Oligomer
cuaaaagaaauagcugaga

SEQ ID NO: 442 - RNA, 19 nt, Artificial Sequence
  RNA Oligomer
acagauugaagcccagcaa

SEQ ID NO: 443 - RNA, 19 nt, Artificial Sequence
  RNA Oligomer
gaagaaaggagaacggugu

SEQ ID NO: 444 - RNA, 19 nt, Artificial Sequence
  RNA Oligomer
acgguaccaguaauuagau

SEQ ID NO: 445 - RNA, 19 nt, Artificial Sequence
  RNA Oligomer
gaauaucgaagaaaggaga

SEQ ID NO: 446 - RNA, 19 nt, Artificial Sequence
  RNA Oligomer
ugaauaucgaagaaaggag

SEQ ID NO: 447 - RNA, 19 nt, Artificial Sequence
  RNA Oligomer
cgacaauccuguuuucuac

SEQ ID NO: 448 - RNA, 19 nt, Artificial Sequence
  RNA Oligomer
agauaaguauacagcgaca

SEQ ID NO: 449 - RNA, 19 nt, Artificial Sequence
  RNA Oligomer
ucagauaaguauacagcga

SEQ ID NO: 450 - RNA, 19 nt, Artificial Sequence
  RNA Oligomer
cacagaauuuuagucaaug

SEQ ID NO: 451 - RNA, 19 nt, Artificial Sequence
  RNA Oligomer
acagggaagacgaagauga

SEQ ID NO: 452 - RNA, 19 nt, Artificial Sequence
  RNA Oligomer
gggcauaaugaauaaagga

SEQ ID NO: 453 - RNA, 19 nt, Artificial Sequence
  RNA Oligomer
acaacguccaaguguguaa

SEQ ID NO: 454 - RNA, 19 nt, Artificial Sequence
  RNA Oligomer
ucauguaacaacguccaag

SEQ ID NO: 455 - RNA, 19 nt, Artificial Sequence
  RNA Oligomer
ugccucauguaacaacguc

SEQ ID NO: 456 - RNA, 19 nt, Artificial Sequence
  RNA Oligomer
ggacuccauuacauugugc

SEQ ID NO: 457 - RNA, 19 nt, Artificial Sequence
  RNA Oligomer
uggacuccauuacauugug

SEQ ID NO: 458 - RNA, 19 nt, Artificial Sequence
  RNA Oligomer
aaauguaaaugcugcugau

SEQ ID NO: 459 - RNA, 19 nt, Artificial Sequence
  RNA Oligomer
ggaaugagggugaaauuca

SEQ ID NO: 460 - RNA, 19 nt, Artificial Sequence
  RNA Oligomer
aggcuccacaugugcuuga

SEQ ID NO: 461 - RNA, 19 nt, Artificial Sequence
  RNA Oligomer
uuacgaaagaaacugucua

SEQ ID NO: 462 - RNA, 19 nt, Artificial Sequence
  RNA Oligomer
cuaauccuuaccgaaacca

SEQ ID NO: 463 - RNA, 19 nt, Artificial Sequence
  RNA Oligomer
gcccaacuaaauuacugcc

SEQ ID NO: 464 - RNA, 19 nt, Artificial Sequence
  RNA Oligomer
gaaccaugaaaacgaaaga

SEQ ID NO: 465 - RNA, 19 nt, Artificial Sequence
  RNA Oligomer
ggcgccaggaaaaaacuuc

SEQ ID NO: 466 - RNA, 19 nt, Artificial Sequence
  RNA Oligomer
ccuuauuuuggacaaacua

SEQ ID NO: 467 - RNA, 19 nt, Artificial Sequence
  RNA Oligomer
cucagguugcaaauaaaaa

SEQ ID NO: 468 - RNA, 19 nt, Artificial Sequence
  RNA Oligomer
gguggaucugugcaaagaa

SEQ ID NO: 469 - RNA, 19 nt, Artificial Sequence
  RNA Oligomer
gaguccuucaaaugcagau

SEQ ID NO: 470 - RNA, 19 nt, Artificial Sequence
  RNA Oligomer
gccgaugaaaauacagaca

SEQ ID NO: 471 - RNA, 19 nt, Artificial Sequence
  RNA Oligomer
aguuucaucugauggaaau

SEQ ID NO: 472 - RNA, 19 nt, Artificial Sequence
  RNA Oligomer
gcguguuaaugagcugagg

SEQ ID NO: 473 - RNA, 19 nt, Artificial Sequence
  RNA Oligomer
ucauggauaagcguguuaa

SEQ ID NO: 474 - RNA, 19 nt, Artificial Sequence
  RNA Oligomer
uaagcguaauucagaagug

SEQ ID NO: 475 - RNA, 19 nt, Artificial Sequence
  RNA Oligomer
gagggaguguuugaauaag

SEQ ID NO: 476 - RNA, 19 nt, Artificial Sequence
  RNA Oligomer
agcuacaacaacagaggga

SEQ ID NO: 477 - RNA, 19 nt, Artificial Sequence
  RNA Oligomer
cacagaaguuccaguuacu

SEQ ID NO: 478 - RNA, 19 nt, Artificial Sequence
  RNA Oligomer
cugugucaaaaguagaaga

SEQ ID NO: 479 - RNA, 19 nt, Artificial Sequence
  RNA Oligomer
ugaauaauuuguuccagca

SEQ ID NO: 480 - RNA, 19 nt, Artificial Sequence
  RNA Oligomer
acagaagagacuaagcaau

SEQ ID NO: 481 - RNA, 19 nt, Artificial Sequence
  RNA Oligomer
guggaacagaagagacuaa

SEQ ID NO: 482 - RNA, 19 nt, Artificial Sequence
  RNA Oligomer
guaacaaugagcagcacuu

SEQ ID NO: 483 - RNA, 19 nt, Artificial Sequence
  RNA Oligomer
gcuaaaaaaagugagagca

SEQ ID NO: 484 - RNA, 19 nt, Artificial Sequence
  RNA Oligomer
cuaagcuaaaaaaagugag

SEQ ID NO: 485 - RNA, 19 nt, Artificial Sequence
  RNA Oligomer
gcuaagcuaaaaaaaguga

SEQ ID NO: 486 - RNA, 19 nt, Artificial Sequence
  RNA Oligomer
gaaacaacaagaucagcga

SEQ ID NO: 487 - RNA, 19 nt, Artificial Sequence
  RNA Oligomer
cugacuuuaaaaacaguug

SEQ ID NO: 488 - RNA, 19 nt, Artificial Sequence
  RNA Oligomer
uuaguugguugucagugaa

SEQ ID NO: 489 - RNA, 19 nt, Artificial Sequence
  RNA Oligomer
gaagaacuguuaguugguu

SEQ ID NO: 490 - RNA, 19 nt, Artificial Sequence
  RNA Oligomer
gcacacuuguauauuguca

SEQ ID NO: 491 - RNA, 19 nt, Artificial Sequence
  RNA Oligomer
uggugaauaucgaagaaag

SEQ ID NO: 492 - RNA, 19 nt, Artificial Sequence
  RNA Oligomer
gucuaguaaauaggaucau

SEQ ID NO: 493 - RNA, 19 nt, Artificial Sequence
  RNA Oligomer
agaauccugucuaguaaau

SEQ ID NO: 494 - RNA, 19 nt, Artificial Sequence
  RNA Oligomer
gcgacaauccuguuuucua

SEQ ID NO: 495 - RNA, 19 nt, Artificial Sequence
  RNA Oligomer
gauaaguauacagcgacaa

SEQ ID NO: 496 - RNA, 19 nt, Artificial Sequence
  RNA Oligomer
uagaagagaaugaaggauu

SEQ ID NO: 497 - RNA, 19 nt, Artificial Sequence
  RNA Oligomer
ugacaauguagcuugaaag

SEQ ID NO: 498 - RNA, 19 nt, Artificial Sequence
  RNA Oligomer
gagucauuuaugcgcuuug

SEQ ID NO: 499 - RNA, 19 nt, Artificial Sequence
  RNA Oligomer
aggagaagaugggcauaau

SEQ ID NO: 500 - RNA, 19 nt, Artificial Sequence
  RNA Oligomer
uguguaaguuuuuggugga

SEQ ID NO: 501 - RNA, 19 nt, Artificial Sequence
  RNA Oligomer
gccucauguaacaacgucc

SEQ ID NO: 502 - RNA, 19 nt, Artificial Sequence
  RNA Oligomer
ugguguaaauguaaaugcu

SEQ ID NO: 503 - RNA, 19 nt, Artificial Sequence
  RNA Oligomer
caguuugguguaaauguaa

SEQ ID NO: 504 - RNA, 19 nt, Artificial Sequence
  RNA Oligomer
ucguuaaguuccugguaca

SEQ ID NO: 505 - RNA, 19 nt, Artificial Sequence
  RNA Oligomer
cacacagaaaucguuaagu

SEQ ID NO: 506 - RNA, 19 nt, Artificial Sequence
  RNA Oligomer
uugaccuuguacagagaau

SEQ ID NO: 507 - RNA, 19 nt, Artificial Sequence
  RNA Oligomer
gagaauuugaccuuguaca

SEQ ID NO: 508 - RNA, 19 nt, Artificial Sequence
  RNA Oligomer
cgucuuuggagggagaauu

SEQ ID NO: 509 - RNA, 19 nt, Artificial Sequence
  RNA Oligomer
cuccacaugugcuugaugu

SEQ ID NO: 510 - RNA, 19 nt, Artificial Sequence
  RNA Oligomer
cgauuuggaagucagagga

SEQ ID NO: 511 - RNA, 19 nt, Artificial Sequence
  RNA Oligomer
gaaacugucuaacgcacca

SEQ ID NO: 512 - RNA, 19 nt, Artificial Sequence
  RNA Oligomer
aaccaugaaaacgaaagaa

SEQ ID NO: 513 - RNA, 19 nt, Artificial Sequence
  RNA Oligomer
cuaucucccagcauaccuu

SEQ ID NO: 514 - RNA, 19 nt, Artificial Sequence
  RNA Oligomer
gcaguugucaacaguuguu

SEQ ID NO: 515 - RNA, 19 nt, Artificial Sequence
  RNA Oligomer
gaagauaucuugcgggaug

SEQ ID NO: 516 - RNA, 19 nt, Artificial Sequence
  RNA Oligomer
ccuuugguacucugaggaa

SEQ ID NO: 517 - RNA, 19 nt, Artificial Sequence
  RNA Oligomer
ugcguccguucucaauguu

SEQ ID NO: 518 - RNA, 19 nt, Artificial Sequence
  RNA Oligomer
ccuucaaaugcagaucuuu

SEQ ID NO: 519 - RNA, 19 nt, Artificial Sequence
  RNA Oligomer
cugauuggaguccuucaaa

SEQ ID NO: 520 - RNA, 19 nt, Artificial Sequence
  RNA Oligomer
ccgaugaaaauacagacac

SEQ ID NO: 521 - RNA, 19 nt, Artificial Sequence
  RNA Oligomer
caguuucaucugauggaaa

SEQ ID NO: 522 - RNA, 19 nt, Artificial Sequence
  RNA Oligomer
caguuacuccagaaacaau

SEQ ID NO: 523 - RNA, 19 nt, Artificial Sequence
  RNA Oligomer
gucauggauaagcguguua

SEQ ID NO: 524 - RNA, 19 nt, Artificial Sequence
  RNA Oligomer
aguguuugaauaagcguaa

SEQ ID NO: 525 - RNA, 19 nt, Artificial Sequence
  RNA Oligomer
gaguguuugaauaagcgua

SEQ ID NO: 526 - RNA, 19 nt, Artificial Sequence
  RNA Oligomer
ugucaaaaguagaagaacu

SEQ ID NO: 527 - RNA, 19 nt, Artificial Sequence
  RNA Oligomer
gcugugucaaaaguagaag

SEQ ID NO: 528 - RNA, 19 nt, Artificial Sequence
  RNA Oligomer
uggaggaaauugaacagau

SEQ ID NO: 529 - RNA, 19 nt, Artificial Sequence
  RNA Oligomer
agcuaagcuaaaaaaagug

SEQ ID NO: 530 - RNA, 19 nt, Artificial Sequence
  RNA Oligomer
ucaguaacaaugagcagca

SEQ ID NO: 531 - RNA, 19 nt, Artificial Sequence
  RNA Oligomer
gagcaggagaaacuuaaaa

SEQ ID NO: 532 - RNA, 19 nt, Artificial Sequence
  RNA Oligomer
agcgcuuaaaguuuuugaa

SEQ ID NO: 533 - RNA, 19 nt, Artificial Sequence
  RNA Oligomer
cguguaucucaguaacaau

SEQ ID NO: 534 - RNA, 19 nt, Artificial Sequence
  RNA Oligomer
ggauggaucugacucuugc

SEQ ID NO: 535 - RNA, 19 nt, Artificial Sequence
  RNA Oligomer
cuaggauggaucugacucu

SEQ ID NO: 536 - RNA, 19 nt, Artificial Sequence
  RNA Oligomer
ccguaauauuugucaagau

SEQ ID NO: 537 - RNA, 19 nt, Artificial Sequence
  RNA Oligomer
acccguaauauuugucaag

SEQ ID NO: 538 - RNA, 19 nt, Artificial Sequence
  RNA Oligomer
cucagaaauuagaaacuug

SEQ ID NO: 539 - RNA, 19 nt, Artificial Sequence
  RNA Oligomer
uugaaacuaagcuacggua

SEQ ID NO: 540 - RNA, 19 nt, Artificial Sequence
  RNA Oligomer
ggaucauuuauugggcagu

SEQ ID NO: 541 - RNA, 19 nt, Artificial Sequence
  RNA Oligomer
cagauaaguauacagcgac

SEQ ID NO: 542 - RNA, 19 nt, Artificial Sequence
  RNA Oligomer
ugaaauaaagcaucuacgu

SEQ ID NO: 543 - RNA, 19 nt, Artificial Sequence
  RNA Oligomer
agcgugaugaaauaaagca

SEQ ID NO: 544 - RNA, 19 nt, Artificial Sequence
  RNA Oligomer
augacaauguagcuugaaa

SEQ ID NO: 545 - RNA, 19 nt, Artificial Sequence
  RNA Oligomer
cucuguuaagaagaaguaa

SEQ ID NO: 546 - RNA, 19 nt, Artificial Sequence
  RNA Oligomer
ucaggauccaaguuuaaaa

SEQ ID NO: 547 - RNA, 19 nt, Artificial Sequence
  RNA Oligomer
caggagaagaugggcauaa

SEQ ID NO: 548 - RNA, 19 nt, Artificial Sequence
  RNA Oligomer
gugcucccaauuucuuuau

SEQ ID NO: 549 - RNA, 19 nt, Artificial Sequence
  RNA Oligomer
aggaaauggaggaaggcua

SEQ ID NO: 550 - RNA, 19 nt, Artificial Sequence
  RNA Oligomer
cagauaagugcgaggaaau

SEQ ID NO: 551 - RNA, 19 nt, Artificial Sequence
  RNA Oligomer
guaacaacguccaagugug

SEQ ID NO: 552 - RNA, 19 nt, Artificial Sequence
  RNA Oligomer
gagggagaauuugaccuug

SEQ ID NO: 553 - RNA, 19 nt, Artificial Sequence
  RNA Oligomer
acaugugcuugauguguac

SEQ ID NO: 554 - RNA, 19 nt, Artificial Sequence
  RNA Oligomer
cccagaagaaccaaaucca

SEQ ID NO: 555 - RNA, 19 nt, Artificial Sequence
  RNA Oligomer
cagcccaaaucuccagaau

SEQ ID NO: 556 - RNA, 19 nt, Artificial Sequence
  RNA Oligomer
acagcccaaaucuccagaa

SEQ ID NO: 557 - RNA, 19 nt, Artificial Sequence
  RNA Oligomer
gccuugauuaugagccuga

SEQ ID NO: 558 - RNA, 19 nt, Artificial Sequence
  RNA Oligomer
ggaaugccaguacagagaa

SEQ ID NO: 559 - RNA, 19 nt, Artificial Sequence
  RNA Oligomer
gaaauccagaauccauauu

SEQ ID NO: 560 - RNA, 19 nt, Artificial Sequence
  RNA Oligomer
agaaagcccaguagaaauc

SEQ ID NO: 561 - RNA, 19 nt, Artificial Sequence
  RNA Oligomer
cagaaagcccaguagaaau

SEQ ID NO: 562 - RNA, 19 nt, Artificial Sequence
  RNA Oligomer
cucagaaagcccaguagaa

SEQ ID NO: 563 - RNA, 19 nt, Artificial Sequence
  RNA Oligomer
aaacugucuaacgcaccaa

SEQ ID NO: 564 - RNA, 19 nt, Artificial Sequence
  RNA Oligomer
ccuuacgaaagaaacuguc

SEQ ID NO: 565 - RNA, 19 nt, Artificial Sequence
  RNA Oligomer
ccuuaccgaaaccagagug

SEQ ID NO: 566 - RNA, 19 nt, Artificial Sequence
  RNA Oligomer
uccuuaccgaaaccagagu

SEQ ID NO: 567 - RNA, 19 nt, Artificial Sequence
  RNA Oligomer
ccuuucuuaucuaauccuu

SEQ ID NO: 568 - RNA, 19 nt, Artificial Sequence
  RNA Oligomer
gccuuucuuaucuaauccu

SEQ ID NO: 569 - RNA, 19 nt, Artificial Sequence
  RNA Oligomer
cagcacccagagaacauuu

SEQ ID NO: 570 - RNA, 19 nt, Artificial Sequence
  RNA Oligomer
guauaugguaagccuguaa

SEQ ID NO: 571 - RNA, 19 nt, Artificial Sequence
  RNA Oligomer
ccaagaccagacccuuucu

SEQ ID NO: 572 - RNA, 19 nt, Artificial Sequence
  RNA Oligomer
ggaacuaaaccaaaaccag

SEQ ID NO: 573 - RNA, 19 nt, Artificial Sequence
  RNA Oligomer
gcaaauaaaaauguggcua

SEQ ID NO: 574 - RNA, 19 nt, Artificial Sequence
  RNA Oligomer
gagcagugaagauaucuug

SEQ ID NO: 575 - RNA, 19 nt, Artificial Sequence
  RNA Oligomer
accagagcagugaagauau

SEQ ID NO: 576 - RNA, 19 nt, Artificial Sequence
  RNA Oligomer
guggaucugugcaaagaac

SEQ ID NO: 577 - RNA, 19 nt, Artificial Sequence
  RNA Oligomer
cucaauguuugaugcagua

SEQ ID NO: 578 - RNA, 19 nt, Artificial Sequence
  RNA Oligomer
gggagaaagagaagaaagu

SEQ ID NO: 579 - RNA, 19 nt, Artificial Sequence
  RNA Oligomer
ugggaaugcucuggaucaa

SEQ ID NO: 580 - RNA, 19 nt, Artificial Sequence
  RNA Oligomer
cacugggaaugcucuggau

SEQ ID NO: 581 - RNA, 19 nt, Artificial Sequence
  RNA Oligomer
aggcucuaaaauccaucca

SEQ ID NO: 582 - RNA, 19 nt, Artificial Sequence
  RNA Oligomer
uaaaggcucuaaaauccau

SEQ ID NO: 583 - RNA, 19 nt, Artificial Sequence
  RNA Oligomer
agaaacaauaugcagagac

SEQ ID NO: 584 - RNA, 19 nt, Artificial Sequence
  RNA Oligomer
ggccgaugaaaauacagac

SEQ ID NO: 585 - RNA, 19 nt, Artificial Sequence
  RNA Oligomer
gggccgaugaaaauacaga

SEQ ID NO: 586 - RNA, 19 nt, Artificial Sequence
  RNA Oligomer
aguuacuccagaaacaaua

SEQ ID NO: 587 - RNA, 19 nt, Artificial Sequence
  RNA Oligomer
uucaucugauggaaaucuu

SEQ ID NO: 588 - RNA, 19 nt, Artificial Sequence
  RNA Oligomer
guguuaaugagcugaggga

SEQ ID NO: 589 - RNA, 19 nt, Artificial Sequence
  RNA Oligomer
guaauucagaaguggcagu

SEQ ID NO: 590 - RNA, 19 nt, Artificial Sequence
  RNA Oligomer
gggaguguuugaauaagcg

SEQ ID NO: 591 - RNA, 19 nt, Artificial Sequence
  RNA Oligomer
gccaagcuacaacaacaga

SEQ ID NO: 592 - RNA, 19 nt, Artificial Sequence
  RNA Oligomer
gcagcuaagaaacaaauug

SEQ ID NO: 593 - RNA, 19 nt, Artificial Sequence
  RNA Oligomer
ccacguggaacagaagaga

SEQ ID NO: 594 - RNA, 19 nt, Artificial Sequence
  RNA Oligomer
gaagcuaagcuaaaaaaag

SEQ ID NO: 595 - RNA, 19 nt, Artificial Sequence
  RNA Oligomer
gaaucaggaagcuaagcua

SEQ ID NO: 596 - RNA, 19 nt, Artificial Sequence
  RNA Oligomer
gcuggcaacuaaggaacag

SEQ ID NO: 597 - RNA, 19 nt, Artificial Sequence
  RNA Oligomer
agacuuacccguaauauuu

SEQ ID NO: 598 - RNA, 19 nt, Artificial Sequence
  RNA Oligomer
agaacuguuaguugguugu

SEQ ID NO: 599 - RNA, 19 nt, Artificial Sequence
  RNA Oligomer
cauuuagcgugaugaaaua

SEQ ID NO: 600 - RNA, 19 nt, Artificial Sequence
  RNA Oligomer
uuaaugauaaggagggaua

SEQ ID NO: 601 - RNA, 19 nt, Artificial Sequence
  RNA Oligomer
gggaagacgaagaugaaau

SEQ ID NO: 602 - RNA, 19 nt, Artificial Sequence
  RNA Oligomer
uuaugcgcuuugggauuau

SEQ ID NO: 603 - RNA, 19 nt, Artificial Sequence
  RNA Oligomer
gaugggcauaaugaauaaa

SEQ ID NO: 604 - RNA, 19 nt, Artificial Sequence
  RNA Oligomer
caacguccaaguguguaag

SEQ ID NO: 605 - RNA, 19 nt, Artificial Sequence
  RNA Oligomer
gacuccauuacauugugcu

SEQ ID NO: 606 - RNA, 19 nt, Artificial Sequence
  RNA Oligomer
gucuuuggagggagaauuu

SEQ ID NO: 607 - RNA, 19 nt, Artificial Sequence
  RNA Oligomer
aggacaaacuugcguaaaa

SEQ ID NO: 608 - RNA, 19 nt, Artificial Sequence
  RNA Oligomer
uacauguggagcccgaaaa

SEQ ID NO: 609 - RNA, 19 nt, Artificial Sequence
  RNA Oligomer
accaucucugucccaucau

SEQ ID NO: 610 - RNA, 19 nt, Artificial Sequence
  RNA Oligomer
ugggccaaauauucagaag

SEQ ID NO: 611 - RNA, 19 nt, Artificial Sequence
  RNA Oligomer
acguaguucuauuacagag

SEQ ID NO: 612 - RNA, 19 nt, Artificial Sequence
  RNA Oligomer
ccucuaaagaaacguaguu

SEQ ID NO: 613 - RNA, 19 nt, Artificial Sequence
  RNA Oligomer
agcgaauguuugauguucu

SEQ ID NO: 614 - RNA, 19 nt, Artificial Sequence
  RNA Oligomer
agaagccuuacgaaagaaa

SEQ ID NO: 615 - RNA, 19 nt, Artificial Sequence
  RNA Oligomer
agaaccaugaaaacgaaag

SEQ ID NO: 616 - RNA, 19 nt, Artificial Sequence
  RNA Oligomer
gcggauaaugagcgaaugu

SEQ ID NO: 617 - RNA, 19 nt, Artificial Sequence
  RNA Oligomer
guggcagcaaguucaauau

SEQ ID NO: 618 - RNA, 19 nt, Artificial Sequence
  RNA Oligomer
cguggcagcaaguucaaua

SEQ ID NO: 619 - RNA, 19 nt, Artificial Sequence
  RNA Oligomer
ugguggaucugugcaaaga

SEQ ID NO: 620 - RNA, 19 nt, Artificial Sequence
  RNA Oligomer
ccguucucaauguuugaug

SEQ ID NO: 621 - RNA, 19 nt, Artificial Sequence
  RNA Oligomer
gcguccguucucaauguuu

SEQ ID NO: 622 - RNA, 19 nt, Artificial Sequence
  RNA Oligomer
gugcguccguucucaaugu

SEQ ID NO: 623 - RNA, 19 nt, Artificial Sequence
  RNA Oligomer
ugagggagaaagagaagaa

SEQ ID NO: 624 - RNA, 19 nt, Artificial Sequence
  RNA Oligomer
ugcucuggaucaaguugau

SEQ ID NO: 625 - RNA, 19 nt, Artificial Sequence
  RNA Oligomer
cucugcuucuguaccucaa

SEQ ID NO: 626 - RNA, 19 nt, Artificial Sequence
  RNA Oligomer
ggaguccuucaaaugcaga

SEQ ID NO: 627 - RNA, 19 nt, Artificial Sequence
  RNA Oligomer
cagaaacaauaugcagaga

SEQ ID NO: 628 - RNA, 19 nt, Artificial Sequence
  RNA Oligomer
gguccaagaugaugccgau

SEQ ID NO: 629 - RNA, 19 nt, Artificial Sequence
  RNA Oligomer
agaaguggcagucauggau

SEQ ID NO: 630 - RNA, 19 nt, Artificial Sequence
  RNA Oligomer
ggaguguuugaauaagcgu

SEQ ID NO: 631 - RNA, 19 nt, Artificial Sequence
  RNA Oligomer
agggaguguuugaauaagc

SEQ ID NO: 632 - RNA, 19 nt, Artificial Sequence
  RNA Oligomer
ugccaagcuacaacaacag

SEQ ID NO: 633 - RNA, 19 nt, Artificial Sequence
  RNA Oligomer
caguaacaaugagcagcac

SEQ ID NO: 634 - RNA, 19 nt, Artificial Sequence
  RNA Oligomer
gagaaacuuaaaaggcuaa

SEQ ID NO: 635 - RNA, 19 nt, Artificial Sequence
  RNA Oligomer
gcaggagaaacuuaaaagg

SEQ ID NO: 636 - RNA, 19 nt, Artificial Sequence
  RNA Oligomer
cugagcaggagaaacuuaa

SEQ ID NO: 637 - RNA, 19 nt, Artificial Sequence
  RNA Oligomer
guguaucucaguaacaaug

SEQ ID NO: 638 - RNA, 19 nt, Artificial Sequence
  RNA Oligomer
ccagcagcaacagauugaa

SEQ ID NO: 639 - RNA, 19 nt, Artificial Sequence
  RNA Oligomer
uaggauggaucugacucuu

SEQ ID NO: 640 - RNA, 19 nt, Artificial Sequence
  RNA Oligomer
gguguuaauaguccuagga

SEQ ID NO: 641 - RNA, 19 nt, Artificial Sequence
  RNA Oligomer
cgguguuaauaguccuagg

SEQ ID NO: 642 - RNA, 19 nt, Artificial Sequence
  RNA Oligomer
uacccguaauauuugucaa

SEQ ID NO: 643 - RNA, 19 nt, Artificial Sequence
  RNA Oligomer
cuuguuuguaggcugaauu

SEQ ID NO: 644 - RNA, 19 nt, Artificial Sequence
  RNA Oligomer
agauguagaaucuuguuug

SEQ ID NO: 645 - RNA, 19 nt, Artificial Sequence
  RNA Oligomer
gucagugaacaauaacuuu

SEQ ID NO: 646 - RNA, 19 nt, Artificial Sequence
  RNA Oligomer
ggcacugcacacuuguaua

SEQ ID NO: 647 - RNA, 19 nt, Artificial Sequence
  RNA Oligomer
aggcacugcacacuuguau

SEQ ID NO: 648 - RNA, 19 nt, Artificial Sequence
  RNA Oligomer
acauuuagcgugaugaaau

SEQ ID NO: 649 - RNA, 19 nt, Artificial Sequence
  RNA Oligomer
agaggacauuuagcgugau

SEQ ID NO: 650 - RNA, 19 nt, Artificial Sequence
  RNA Oligomer
cacguaacuugcugggacu

SEQ ID NO: 651 - RNA, 19 nt, Artificial Sequence
  RNA Oligomer
ugauaaggagggauauguu

SEQ ID NO: 652 - RNA, 19 nt, Artificial Sequence
  RNA Oligomer
uuaugaaccucagaaugau

SEQ ID NO: 653 - RNA, 19 nt, Artificial Sequence
  RNA Oligomer
ugggcauaaugaauaaagg

SEQ ID NO: 654 - RNA, 19 nt, Artificial Sequence
  RNA Oligomer
ggagaagaugggcauaaug

SEQ ID NO: 655 - RNA, 19 nt, Artificial Sequence
  RNA Oligomer
caauuucuuuauggaguuc

SEQ ID NO: 656 - RNA, 19 nt, Artificial Sequence
  RNA Oligomer
ggaaauggaggaaggcuac

SEQ ID NO: 657 - RNA, 19 nt, Artificial Sequence
  RNA Oligomer
guaaauguaaaugcugcug

SEQ ID NO: 658 - RNA, 19 nt, Artificial Sequence
  RNA Oligomer
cauggaaugagggugaaau

SEQ ID NO: 659 - RNA, 19 nt, Artificial Sequence
  RNA Oligomer
ugcuugauguguaccugga

SEQ ID NO: 660 - RNA, 19 nt, Artificial Sequence
  RNA Oligomer
ucaacgauuuggaagucag

SEQ ID NO: 661 - RNA, 19 nt, Artificial Sequence
  RNA Oligomer
ccaguacagagaacaguga

SEQ ID NO: 662 - RNA, 19 nt, Artificial Sequence
  RNA Oligomer
gggaaugccaguacagaga

SEQ ID NO: 663 - RNA, 19 nt, Artificial Sequence
  RNA Oligomer
augggccaaauauucagaa

SEQ ID NO: 664 - RNA, 19 nt, Artificial Sequence
  RNA Oligomer
agaaacguaguucuauuac

SEQ ID NO: 665 - RNA, 19 nt, Artificial Sequence
  RNA Oligomer
cgaauguuugauguucuuc

SEQ ID NO: 666 - RNA, 19 nt, Artificial Sequence
  RNA Oligomer
uuacugccuuucuuaucua

SEQ ID NO: 667 - RNA, 19 nt, Artificial Sequence
  RNA Oligomer
gagaaccaugaaaacgaaa

SEQ ID NO: 668 - RNA, 19 nt, Artificial Sequence
  RNA Oligomer
uucuccagguucuaagcaa

SEQ ID NO: 669 - RNA, 19 nt, Artificial Sequence
  RNA Oligomer
cggaaguucucagcaguug

SEQ ID NO: 670 - RNA, 19 nt, Artificial Sequence
  RNA Oligomer
agacggaaguucucagcag

SEQ ID NO: 671 - RNA, 19 nt, Artificial Sequence
  RNA Oligomer
gaaccagagcagugaagau

SEQ ID NO: 672 - RNA, 19 nt, Artificial Sequence
  RNA Oligomer
gagggagaaagagaagaaa

SEQ ID NO: 673 - RNA, 19 nt, Artificial Sequence
  RNA Oligomer
cugcuucuguaccucaaag

SEQ ID NO: 674 - RNA, 19 nt, Artificial Sequence
  RNA Oligomer
cauggauaagcguguuaau

SEQ ID NO: 675 - RNA, 19 nt, Artificial Sequence
  RNA Oligomer
cuggcugugucaaaaguag

SEQ ID NO: 676 - RNA, 19 nt, Artificial Sequence
  RNA Oligomer
ccuggcugugucaaaagua

SEQ ID NO: 677 - RNA, 19 nt, Artificial Sequence
  RNA Oligomer
ugagcaggagaaacuuaaa

SEQ ID NO: 678 - RNA, 19 nt, Artificial Sequence
  RNA Oligomer
aggaacagcgcuuaaaguu

SEQ ID NO: 679 - RNA, 19 nt, Artificial Sequence
  RNA Oligomer
gaacuucaggaaauggcau

SEQ ID NO: 680 - RNA, 19 nt, Artificial Sequence
  RNA Oligomer
guguuaauaguccuaggau

SEQ ID NO: 681 - RNA, 19 nt, Artificial Sequence
  RNA Oligomer
acgguguuaauaguccuag

SEQ ID NO: 682 - RNA, 19 nt, Artificial Sequence
  RNA Oligomer
aacgguguuaauaguccua

SEQ ID NO: 683 - RNA, 19 nt, Artificial Sequence
  RNA Oligomer
agaaacuugcuacagacuu

SEQ ID NO: 684 - RNA, 19 nt, Artificial Sequence
  RNA Oligomer
gaaauuagaaacuugcuac

SEQ ID NO: 685 - RNA, 19 nt, Artificial Sequence
  RNA Oligomer
ucuuguuuguaggcugaau

SEQ ID NO: 686 - RNA, 19 nt, Artificial Sequence
  RNA Oligomer
acacuuguauauugucagu

SEQ ID NO: 687 - RNA, 19 nt, Artificial Sequence
  RNA Oligomer
ugcuccuaaaccaguccuc

SEQ ID NO: 688 - RNA, 19 nt, Artificial Sequence
  RNA Oligomer
ugaguguuuucagcagcug

SEQ ID NO: 689 - RNA, 19 nt, Artificial Sequence
  RNA Oligomer
gcaguugggaaaucagcuc

SEQ ID NO: 690 - RNA, 19 nt, Artificial Sequence
  RNA Oligomer
gaauccugucuaguaaaua

SEQ ID NO: 691 - RNA, 19 nt, Artificial Sequence
  RNA Oligomer
guaaaaguuccuggugaau

SEQ ID NO: 692 - RNA, 19 nt, Artificial Sequence
  RNA Oligomer
uguaaaaguuccuggugaa

SEQ ID NO: 693 - RNA, 19 nt, Artificial Sequence
  RNA Oligomer
gauguuucuuaccguguau

SEQ ID NO: 694 - RNA, 19 nt, Artificial Sequence
  RNA Oligomer
uccacacagaauuuuaguc

SEQ ID NO: 695 - RNA, 19 nt, Artificial Sequence
  RNA Oligomer
aaaggagcuuggccugaaa

SEQ ID NO: 696 - RNA, 19 nt, Artificial Sequence
  RNA Oligomer
ugaaccucagaaugaugau

SEQ ID NO: 697 - RNA, 19 nt, Artificial Sequence
  RNA Oligomer
ugcucccaauuucuuuaug

SEQ ID NO: 698 - RNA, 19 nt, Artificial Sequence
  RNA Oligomer
gacauugugaguggaccaa

SEQ ID NO: 699 - RNA, 19 nt, Artificial Sequence
  RNA Oligomer
gugcgaggaaauggaggaa

SEQ ID NO: 700 - RNA, 19 nt, Artificial Sequence
  RNA Oligomer
uguaaaugcugcugauagu

SEQ ID NO: 701 - RNA, 19 nt, Artificial Sequence
  RNA Oligomer
gguguaaauguaaaugcug

SEQ ID NO: 702 - RNA, 19 nt, Artificial Sequence
  RNA Oligomer
ucauggaaugagggugaaa

SEQ ID NO: 703 - RNA, 19 nt, Artificial Sequence
  RNA Oligomer
cccaaaucuccagaauaac

SEQ ID NO: 704 - RNA, 19 nt, Artificial Sequence
  RNA Oligomer
agcccaaaucuccagaaua

SEQ ID NO: 705 - RNA, 19 nt, Artificial Sequence
  RNA Oligomer
cuaaagaaacguaguucua

SEQ ID NO: 706 - RNA, 19 nt, Artificial Sequence
  RNA Oligomer
ugagcgaauguuugauguu

SEQ ID NO: 707 - RNA, 19 nt, Artificial Sequence
  RNA Oligomer
cugccuuucuuaucuaauc

SEQ ID NO: 708 - RNA, 19 nt, Artificial Sequence
  RNA Oligomer
uggcagcaaguucaauaua

SEQ ID NO: 709 - RNA, 19 nt, Artificial Sequence
  RNA Oligomer
ccguggcagcaaguucaau

SEQ ID NO: 710 - RNA, 19 nt, Artificial Sequence
  RNA Oligomer
agaaaguccaccugcugcu

SEQ ID NO: 711 - RNA, 19 nt, Artificial Sequence
  RNA Oligomer
caaaacagauuaauuugcc

SEQ ID NO: 712 - RNA, 19 nt, Artificial Sequence
  RNA Oligomer
uugguacucugaggaagaa

SEQ ID NO: 713 - RNA, 19 nt, Artificial Sequence
  RNA Oligomer
caauguuugaugcaguaga

SEQ ID NO: 714 - RNA, 19 nt, Artificial Sequence
  RNA Oligomer
ggagaaagagaagaaagug

SEQ ID NO: 715 - RNA, 19 nt, Artificial Sequence
  RNA Oligomer
aguugaugauggagagguu

SEQ ID NO: 716 - RNA, 19 nt, Artificial Sequence
  RNA Oligomer
uggaguccuucaaaugcag

SEQ ID NO: 717 - RNA, 19 nt, Artificial Sequence
  RNA Oligomer
ucgucuacuaugccucgga

SEQ ID NO: 718 - RNA, 19 nt, Artificial Sequence
  RNA Oligomer
ggcagcucuacagcaaaaa

SEQ ID NO: 719 - RNA, 19 nt, Artificial Sequence
  RNA Oligomer
cagcuaagaaacaaauuga

SEQ ID NO: 720 - RNA, 19 nt, Artificial Sequence
  RNA Oligomer
ucguccuggcugugucaaa

SEQ ID NO: 721 - RNA, 19 nt, Artificial Sequence
  RNA Oligomer
gaugaauaauuuguuccag

SEQ ID NO: 722 - RNA, 19 nt, Artificial Sequence
  RNA Oligomer
ugggaaacuuguggaggaa

SEQ ID NO: 723 - RNA, 19 nt, Artificial Sequence
  RNA Oligomer
gacuaagcaaugggaaacu

SEQ ID NO: 724 - RNA, 19 nt, Artificial Sequence
  RNA Oligomer
agagacuaagcaaugggaa

SEQ ID NO: 725 - RNA, 19 nt, Artificial Sequence
  RNA Oligomer
uggaacagaagagacuaag

SEQ ID NO: 726 - RNA, 19 nt, Artificial Sequence
  RNA Oligomer
cguggaacagaagagacua

SEQ ID NO: 727 - RNA, 19 nt, Artificial Sequence
  RNA Oligomer
acguggaacagaagagacu

SEQ ID NO: 728 - RNA, 19 nt, Artificial Sequence
  RNA Oligomer
agcaggagaaacuuaaaag

SEQ ID NO: 729 - RNA, 19 nt, Artificial Sequence
  RNA Oligomer
cagcgcuuaaaguuuuuga

SEQ ID NO: 730 - RNA, 19 nt, Artificial Sequence
  RNA Oligomer
ucagaaauuagaaacuugc

SEQ ID NO: 731 - RNA, 19 nt, Artificial Sequence
  RNA Oligomer
gauguagaaucuuguuugu

SEQ ID NO: 732 - RNA, 19 nt, Artificial Sequence
  RNA Oligomer
cuuguauauugucagugaa

SEQ ID NO: 733 - RNA, 19 nt, Artificial Sequence
  RNA Oligomer
aggaucauuuauugggcag

SEQ ID NO: 734 - RNA, 19 nt, Artificial Sequence
  RNA Oligomer
guguaaaaguuccugguga

SEQ ID NO: 735 - RNA, 19 nt, Artificial Sequence
  RNA Oligomer
gagcugcccaugaaagaag

SEQ ID NO: 736 - RNA, 19 nt, Artificial Sequence
  RNA Oligomer
gaaccucagaaugaugaug

SEQ ID NO: 737 - RNA, 19 nt, Artificial Sequence
  RNA Oligomer
agaagaugggcauaaugaa

SEQ ID NO: 738 - RNA, 19 nt, Artificial Sequence
  RNA Oligomer
ucgucuuuggagggagaau

SEQ ID NO: 739 - RNA, 19 nt, Artificial Sequence
  RNA Oligomer
agauucgucuuuggaggga

SEQ ID NO: 740 - RNA, 19 nt, Artificial Sequence
  RNA Oligomer
ccuugauuaugagccugag

SEQ ID NO: 741 - RNA, 19 nt, Artificial Sequence
  RNA Oligomer
gaaugccaguacagagaac

SEQ ID NO: 742 - RNA, 19 nt, Artificial Sequence
  RNA Oligomer
cucucugguuccugaauca

SEQ ID NO: 743 - RNA, 19 nt, Artificial Sequence
  RNA Oligomer
accaaggccucuaaagaaa

SEQ ID NO: 744 - RNA, 19 nt, Artificial Sequence
  RNA Oligomer
gcagcacccagagaacauu

SEQ ID NO: 745 - RNA, 19 nt, Artificial Sequence
  RNA Oligomer
agagggccacacuuuucaa

SEQ ID NO: 746 - RNA, 19 nt, Artificial Sequence
  RNA Oligomer
acggaaguucucagcaguu

SEQ ID NO: 747 - RNA, 19 nt, Artificial Sequence
  RNA Oligomer
gacggaaguucucagcagu

SEQ ID NO: 748 - RNA, 19 nt, Artificial Sequence
  RNA Oligomer
gaagaaccagagcagugaa

SEQ ID NO: 749 - RNA, 19 nt, Artificial Sequence
  RNA Oligomer
uccguucucaauguuugau

SEQ ID NO: 750 - RNA, 19 nt, Artificial Sequence
  RNA Oligomer
ucaaguugaugauggagag

SEQ ID NO: 751 - RNA, 19 nt, Artificial Sequence
  RNA Oligomer
gaaugcucuggaucaaguu

SEQ ID NO: 752 - RNA, 19 nt, Artificial Sequence
  RNA Oligomer
gggaaugcucuggaucaag

SEQ ID NO: 753 - RNA, 19 nt, Artificial Sequence
  RNA Oligomer
gaaacaauaugcagagacg

SEQ ID NO: 754 - RNA, 19 nt, Artificial Sequence
  RNA Oligomer
uccagaaacaauaugcaga

SEQ ID NO: 755 - RNA, 19 nt, Artificial Sequence
  RNA Oligomer
uggucauucaggcuucaga

SEQ ID NO: 756 - RNA, 19 nt, Artificial Sequence
  RNA Oligomer
gccugaauugcuggugaag

SEQ ID NO: 757 - RNA, 19 nt, Artificial Sequence
  RNA Oligomer
aggccugaauugcugguga

SEQ ID NO: 758 - RNA, 19 nt, Artificial Sequence
  RNA Oligomer
agaaaaucuaccaguuuca

SEQ ID NO: 759 - RNA, 19 nt, Artificial Sequence
  RNA Oligomer
agucauggauaagcguguu

SEQ ID NO: 760 - RNA, 19 nt, Artificial Sequence
  RNA Oligomer
aaguggcagucauggauaa

SEQ ID NO: 761 - RNA, 19 nt, Artificial Sequence
  RNA Oligomer
uccuggcugugucaaaagu

SEQ ID NO: 762 - RNA, 19 nt, Artificial Sequence
  RNA Oligomer
ugagcagcacuucacagaa

SEQ ID NO: 763 - RNA, 19 nt, Artificial Sequence
  RNA Oligomer
guggaggaaauugaacaga

SEQ ID NO: 764 - RNA, 19 nt, Artificial Sequence
  RNA Oligomer
agacuaagcaaugggaaac

SEQ ID NO: 765 - RNA, 19 nt, Artificial Sequence
  RNA Oligomer
agaaucaggaagcuaagcu

SEQ ID NO: 766 - RNA, 19 nt, Artificial Sequence
  RNA Oligomer
aggagaaacuuaaaaggcu

SEQ ID NO: 767 - RNA, 19 nt, Artificial Sequence
  RNA Oligomer
gcugagcaggagaaacuua

SEQ ID NO: 768 - RNA, 19 nt, Artificial Sequence
  RNA Oligomer
acagcgcuuaaaguuuuug

SEQ ID NO: 769 - RNA, 19 nt, Artificial Sequence
  RNA Oligomer
aacagcgcuuaaaguuuuu

SEQ ID NO: 770 - RNA, 19 nt, Artificial Sequence
  RNA Oligomer
cacugcacacuuguauauu

SEQ ID NO: 771 - RNA, 19 nt, Artificial Sequence
  RNA Oligomer
ucgaaggcacugcacacuu

SEQ ID NO: 772 - RNA, 19 nt, Artificial Sequence
  RNA Oligomer
cugucuaguaaauaggauc

SEQ ID NO: 773 - RNA, 19 nt, Artificial Sequence
  RNA Oligomer
gacauuuagcgugaugaaa

SEQ ID NO: 774 - RNA, 19 nt, Artificial Sequence
  RNA Oligomer
gaggacauuuagcgugaug

SEQ ID NO: 775 - RNA, 19 nt, Artificial Sequence
  RNA Oligomer
ucaggagaagaugggcaua

SEQ ID NO: 776 - RNA, 19 nt, Artificial Sequence
  RNA Oligomer
agugcucccaauuucuuua

SEQ ID NO: 777 - RNA, 19 nt, Artificial Sequence
  RNA Oligomer
gggugaaauucaacccccu

SEQ ID NO: 778 - RNA, 19 nt, Artificial Sequence
  RNA Oligomer
acccagagaacauuuauuc

SEQ ID NO: 779 - RNA, 19 nt, Artificial Sequence
  RNA Oligomer
agggugaaauucaaccccc

SEQ ID NO: 780 - RNA, 19 nt, Artificial Sequence
  RNA Oligomer
gagggugaaauucaacccc

SEQ ID NO: 781 - RNA, 19 nt, Artificial Sequence
  RNA Oligomer
uucuacaucuaauuacugg

SEQ ID NO: 782 - RNA, 19 nt, Artificial Sequence
  RNA Oligomer
gucuugguuuaauucuugg

SEQ ID NO: 783 - RNA, 19 nt, Artificial Sequence
  RNA Oligomer
ucuugguuuaauucuuggg

SEQ ID NO: 784 - RNA, 19 nt, Artificial Sequence
  RNA Oligomer
ugucuugguuuaauucuug

SEQ ID NO: 785 - RNA, 19 nt, Artificial Sequence
  RNA Oligomer
aaggcaguaauuuaguugg

SEQ ID NO: 786 - RNA, 19 nt, Artificial Sequence
  RNA Oligomer
auggugaauucuucaaucc

SEQ ID NO: 787 - RNA, 19 nt, Artificial Sequence
  RNA Oligomer
aucuucgucuucccugugg

SEQ ID NO: 788 - RNA, 19 nt, Artificial Sequence
  RNA Oligomer
uuggauggguaugauggga

SEQ ID NO: 789 - RNA, 19 nt, Artificial Sequence
  RNA Oligomer
uaugagucuuggucaacgc

SEQ ID NO: 790 - RNA, 19 nt, Artificial Sequence
  RNA Oligomer
aaggguggaaguaaggugu

SEQ ID NO: 791 - RNA, 19 nt, Artificial Sequence
  RNA Oligomer
uacaucuaauuacugguac

SEQ ID NO: 792 - RNA, 19 nt, Artificial Sequence
  RNA Oligomer
uucucuuucucccucagcg

SEQ ID NO: 793 - RNA, 19 nt, Artificial Sequence
  RNA Oligomer
uucagcaagagucagaucc

SEQ ID NO: 794 - RNA, 19 nt, Artificial Sequence
  RNA Oligomer
uugguuuaauucuugggua

SEQ ID NO: 795 - RNA, 19 nt, Artificial Sequence
  RNA Oligomer
ugguuuaauucuuggguac

SEQ ID NO: 796 - RNA, 19 nt, Artificial Sequence
  RNA Oligomer
aaagcgcauaaaugacucc

SEQ ID NO: 797 - RNA, 19 nt, Artificial Sequence
  RNA Oligomer
aaaacuuacacacuuggac

SEQ ID NO: 798 - RNA, 19 nt, Artificial Sequence
  RNA Oligomer
guuuuacgcaaguuugucc

SEQ ID NO: 799 - RNA, 19 nt, Artificial Sequence
  RNA Oligomer
cagaagcugacuuggaugg

SEQ ID NO: 800 - RNA, 19 nt, Artificial Sequence
  RNA Oligomer
uucugaauuacgcuuauuc

SEQ ID NO: 801 - RNA, 19 nt, Artificial Sequence
  RNA Oligomer
auucaucuguucaauuucc

SEQ ID NO: 802 - RNA, 19 nt, Artificial Sequence
  RNA Oligomer
uuucugagauacaaaagac

SEQ ID NO: 803 - RNA, 19 nt, Artificial Sequence
  RNA Oligomer
guuuaauucuuggguacag

SEQ ID NO: 804 - RNA, 19 nt, Artificial Sequence
  RNA Oligomer
uuuaauucuuggguacagu

SEQ ID NO: 805 - RNA, 19 nt, Artificial Sequence
  RNA Oligomer
caaaaacuuacacacuugg

SEQ ID NO: 806 - RNA, 19 nt, Artificial Sequence
  RNA Oligomer
uuaacgauuucuguguggc

SEQ ID NO: 807 - RNA, 19 nt, Artificial Sequence
  RNA Oligomer
aucaagcacauguggagcc

SEQ ID NO: 808 - RNA, 19 nt, Artificial Sequence
  RNA Oligomer
cuuggauggguaugauggg

SEQ ID NO: 809 - RNA, 19 nt, Artificial Sequence
  RNA Oligomer
uggauggguaugaugggac

SEQ ID NO: 810 - RNA, 19 nt, Artificial Sequence
  RNA Oligomer
uaugaugggacagagaugg

SEQ ID NO: 811 - RNA, 19 nt, Artificial Sequence
  RNA Oligomer
aauucuuucguuuucaugg

SEQ ID NO: 812 - RNA, 19 nt, Artificial Sequence
  RNA Oligomer
uuuaguuugugaagcagcc

SEQ ID NO: 813 - RNA, 19 nt, Artificial Sequence
  RNA Oligomer
uuuucuuuuugcuguagag

SEQ ID NO: 814 - RNA, 19 nt, Artificial Sequence
  RNA Oligomer
uaacaccguucuccuuucu

SEQ ID NO: 815 - RNA, 19 nt, Artificial Sequence
  RNA Oligomer
uacagauuaaaauucagcc

SEQ ID NO: 816 - RNA, 19 nt, Artificial Sequence
  RNA Oligomer
ucuacaucuaauuacuggu

SEQ ID NO: 817 - RNA, 19 nt, Artificial Sequence
  RNA Oligomer
auucuucaauccuucauuc

SEQ ID NO: 818 - RNA, 19 nt, Artificial Sequence
  RNA Oligomer
auucugagguucauaaucc

SEQ ID NO: 819 - RNA, 19 nt, Artificial Sequence
  RNA Oligomer
acuccuuuauucauuaugc

SEQ ID NO: 820 - RNA, 19 nt, Artificial Sequence
  RNA Oligomer
aaggucaaauucucccucc

SEQ ID NO: 821 - RNA, 19 nt, Artificial Sequence
  RNA Oligomer
agaagcugacuuggauggg

SEQ ID NO: 822 - RNA, 19 nt, Artificial Sequence
  RNA Oligomer
aggcaguaauuuaguuggg

SEQ ID NO: 823 - RNA, 19 nt, Artificial Sequence
  RNA Oligomer
uucguuuucaugguucucc

SEQ ID NO: 824 - RNA, 19 nt, Artificial Sequence
  RNA Oligomer
auaaauguucucugggugc

SEQ ID NO: 825 - RNA, 19 nt, Artificial Sequence
  RNA Oligomer
gaaggguggaaguaaggug

SEQ ID NO: 826 - RNA, 19 nt, Artificial Sequence
  RNA Oligomer
aguuuguccaaaauaaggc

SEQ ID NO: 827 - RNA, 19 nt, Artificial Sequence
  RNA Oligomer
gauaucuucacugcucugg

SEQ ID NO: 828 - RNA, 19 nt, Artificial Sequence
  RNA Oligomer
aagaucugcauuugaagga

SEQ ID NO: 829 - RNA, 19 nt, Artificial Sequence
  RNA Oligomer
uuguuucuggaguaacugg

SEQ ID NO: 830 - RNA, 19 nt, Artificial Sequence
  RNA Oligomer
cugcucuugauucaauuug

SEQ ID NO: 831 - RNA, 19 nt, Artificial Sequence
  RNA Oligomer
ugcucuugauucaauuugu

SEQ ID NO: 832 - RNA, 19 nt, Artificial Sequence
  RNA Oligomer
uucuacuuuugacacagcc

SEQ ID NO: 833 - RNA, 19 nt, Artificial Sequence
  RNA Oligomer
cucccucuguuuuugcugg

SEQ ID NO: 834 - RNA, 19 nt, Artificial Sequence
  RNA Oligomer
uuuuuuuagcuuagcuucc

SEQ ID NO: 835 - RNA, 19 nt, Artificial Sequence
  RNA Oligomer
uuguuacugagauacacgg

SEQ ID NO: 836 - RNA, 19 nt, Artificial Sequence
  RNA Oligomer
caucuaauuacugguaccg

SEQ ID NO: 837 - RNA, 19 nt, Artificial Sequence
  RNA Oligomer
augcuuuauuucaucacgc

SEQ ID NO: 838 - RNA, 19 nt, Artificial Sequence
  RNA Oligomer
cuucaauccuucauucucu

SEQ ID NO: 839 - RNA, 19 nt, Artificial Sequence
  RNA Oligomer
aaaaacuuacacacuugga

SEQ ID NO: 840 - RNA, 19 nt, Artificial Sequence
  RNA Oligomer
cuuaacgauuucugugugg

SEQ ID NO: 841 - RNA, 19 nt, Artificial Sequence
  RNA Oligomer
aauucucuguacaagguca

SEQ ID NO: 842 - RNA, 19 nt, Artificial Sequence
  RNA Oligomer
aaguuuguccuuuuaccag

SEQ ID NO: 843 - RNA, 19 nt, Artificial Sequence
  RNA Oligomer
gaagcugacuuggaugggu

SEQ ID NO: 844 - RNA, 19 nt, Artificial Sequence
  RNA Oligomer
auucuuucguuuucauggu

SEQ ID NO: 845 - RNA, 19 nt, Artificial Sequence
  RNA Oligomer
aauaaauguucucugggug

SEQ ID NO: 846 - RNA, 19 nt, Artificial Sequence
  RNA Oligomer
gauuuucuuuuugcuguag

SEQ ID NO: 847 - RNA, 19 nt, Artificial Sequence
  RNA Oligomer
auuuguuucuuagcugcag

SEQ ID NO: 848 - RNA, 19 nt, Artificial Sequence
  RNA Oligomer
uuuguuucuuagcugcagc

SEQ ID NO: 849 - RNA, 19 nt, Artificial Sequence
  RNA Oligomer
uuuuuuagcuuagcuuccu

SEQ ID NO: 850 - RNA, 19 nt, Artificial Sequence
  RNA Oligomer
uuuuuagcuuagcuuccug

SEQ ID NO: 851 - RNA, 19 nt, Artificial Sequence
  RNA Oligomer
aacuuguugcuguugucgc

SEQ ID NO: 852 - RNA, 19 nt, Artificial Sequence
  RNA Oligomer
ucuugacaaauauuacggg

SEQ ID NO: 853 - RNA, 19 nt, Artificial Sequence
  RNA Oligomer
uucuucaauccuucauucu

SEQ ID NO: 854 - RNA, 19 nt, Artificial Sequence
  RNA Oligomer
uugacuaaaauucugugug

SEQ ID NO: 855 - RNA, 19 nt, Artificial Sequence
  RNA Oligomer
ugacuaaaauucugugugg

SEQ ID NO: 856 - RNA, 19 nt, Artificial Sequence
  RNA Oligomer
uuaauucuuggguacaguc

SEQ ID NO: 857 - RNA, 19 nt, Artificial Sequence
  RNA Oligomer
aagcgcauaaaugacuccu

SEQ ID NO: 858 - RNA, 19 nt, Artificial Sequence
  RNA Oligomer
cuccuuuauucauuaugcc

SEQ ID NO: 859 - RNA, 19 nt, Artificial Sequence
  RNA Oligomer
aaacuuacacacuuggacg

SEQ ID NO: 860 - RNA, 19 nt, Artificial Sequence
  RNA Oligomer
aacuuacacacuuggacgu

SEQ ID NO: 861 - RNA, 19 nt, Artificial Sequence
  RNA Oligomer
auaauucucuguacaaggu

SEQ ID NO: 862 - RNA, 19 nt, Artificial Sequence
  RNA Oligomer
uugaauuucacccucauuc

SEQ ID NO: 863 - RNA, 19 nt, Artificial Sequence
  RNA Oligomer
cucugagccaguuuuacgc

SEQ ID NO: 864 - RNA, 19 nt, Artificial Sequence
  RNA Oligomer
auguaaauauggauucugg

SEQ ID NO: 865 - RNA, 19 nt, Artificial Sequence
  RNA Oligomer
aagcuucugaauauuuggc

SEQ ID NO: 866 - RNA, 19 nt, Artificial Sequence
  RNA Oligomer
gcuauuggaauaaauguuc

SEQ ID NO: 867 - RNA, 19 nt, Artificial Sequence
  RNA Oligomer
uaaauguucucugggugcu

SEQ ID NO: 868 - RNA, 19 nt, Artificial Sequence
  RNA Oligomer
gugcugcuguugauucugg

SEQ ID NO: 869 - RNA, 19 nt, Artificial Sequence
  RNA Oligomer
augagucuuggucaacgcg

SEQ ID NO: 870 - RNA, 19 nt, Artificial Sequence
  RNA Oligomer
aacggacgcacuuucuucu

SEQ ID NO: 871 - RNA, 19 nt, Artificial Sequence
  RNA Oligomer
auuugaaggacuccaauca

SEQ ID NO: 872 - RNA, 19 nt, Artificial Sequence
  RNA Oligomer
uuaguuugugaagcagccc

SEQ ID NO: 873 - RNA, 19 nt, Artificial Sequence
  RNA Oligomer
agagcugccuucuucuucc

SEQ ID NO: 874 - RNA, 19 nt, Artificial Sequence
  RNA Oligomer
cucauuaacacgcuuaucc

SEQ ID NO: 875 - RNA, 19 nt, Artificial Sequence
  RNA Oligomer
aacacucccucuguuguug

SEQ ID NO: 876 - RNA, 19 nt, Artificial Sequence
  RNA Oligomer
uuuuagcuuagcuuccuga

SEQ ID NO: 877 - RNA, 19 nt, Artificial Sequence
  RNA Oligomer
uugucgcugaucuuguugu

SEQ ID NO: 878 - RNA, 19 nt, Artificial Sequence
  RNA Oligomer
guuucaaaaacuuuaagcg

SEQ ID NO: 879 - RNA, 19 nt, Artificial Sequence
  RNA Oligomer
uuuaagcgcuguuccuuag

SEQ ID NO: 880 - RNA, 19 nt, Artificial Sequence
  RNA Oligomer
cugggcuucaaucuguugc

SEQ ID NO: 881 - RNA, 19 nt, Artificial Sequence
  RNA Oligomer
ucaaucuguugcugcuggc

SEQ ID NO: 882 - RNA, 19 nt, Artificial Sequence
  RNA Oligomer
uucugagauacaaaagaca

SEQ ID NO: 883 - RNA, 19 nt, Artificial Sequence
  RNA Oligomer
auauacaagugugcagugc

SEQ ID NO: 884 - RNA, 19 nt, Artificial Sequence
  RNA Oligomer
accauucgauuucaucuuc

SEQ ID NO: 885 - RNA, 19 nt, Artificial Sequence
  RNA Oligomer
uuauucauuaugcccaucu

SEQ ID NO: 886 - RNA, 19 nt, Artificial Sequence
  RNA Oligomer
gacuccaccaaaaacuuac

SEQ ID NO: 887 - RNA, 19 nt, Artificial Sequence
  RNA Oligomer
cuccaccaaaaacuuacac

SEQ ID NO: 888 - RNA, 19 nt, Artificial Sequence
  RNA Oligomer
uaacgauuucuguguggcc

SEQ ID NO: 889 - RNA, 19 nt, Artificial Sequence
  RNA Oligomer
acagcauugugaagagccg

SEQ ID NO: 890 - RNA, 19 nt, Artificial Sequence
  RNA Oligomer
aauaauucucuguacaagg

SEQ ID NO: 891 - RNA, 19 nt, Artificial Sequence
  RNA Oligomer
gauucuggauuucuacugg

SEQ ID NO: 892 - RNA, 19 nt, Artificial Sequence
  RNA Oligomer
uuagacaguuucuuucgua

SEQ ID NO: 893 - RNA, 19 nt, Artificial Sequence
  RNA Oligomer
aacauucgcucauuauccg

SEQ ID NO: 894 - RNA, 19 nt, Artificial Sequence
  RNA Oligomer
ugcugcuguugauucuggg

SEQ ID NO: 895 - RNA, 19 nt, Artificial Sequence
  RNA Oligomer
ucugguaugagucuugguc

SEQ ID NO: 896 - RNA, 19 nt, Artificial Sequence
  RNA Oligomer
guaugagucuuggucaacg

SEQ ID NO: 897 - RNA, 19 nt, Artificial Sequence
  RNA Oligomer
ugguuuugguuuaguuccc

SEQ ID NO: 898 - RNA, 19 nt, Artificial Sequence
  RNA Oligomer
aucuguuuugguuuuguag

SEQ ID NO: 899 - RNA, 19 nt, Artificial Sequence
  RNA Oligomer
cuguuuugguuuuguagga

SEQ ID NO: 900 - RNA, 19 nt, Artificial Sequence
  RNA Oligomer
cacauuuuuauuugcaacc

SEQ ID NO: 901 - RNA, 19 nt, Artificial Sequence
  RNA Oligomer
aagauaucuucacugcucu

SEQ ID NO: 902 - RNA, 19 nt, Artificial Sequence
  RNA Oligomer
agaucugcauuugaaggac

SEQ ID NO: 903 - RNA, 19 nt, Artificial Sequence
  RNA Oligomer
cucugcauauuguuucugg

SEQ ID NO: 904 - RNA, 19 nt, Artificial Sequence
  RNA Oligomer
uucaccagcaauucaggcc

SEQ ID NO: 905 - RNA, 19 nt, Artificial Sequence
  RNA Oligomer
augaaacugguagauuuuc

SEQ ID NO: 906 - RNA, 19 nt, Artificial Sequence
  RNA Oligomer
ugccacuucugaauuacgc

SEQ ID NO: 907 - RNA, 19 nt, Artificial Sequence
  RNA Oligomer
auuacgcuuauucaaacac

SEQ ID NO: 908 - RNA, 19 nt, Artificial Sequence
  RNA Oligomer
uuauucaaacacucccucu

SEQ ID NO: 909 - RNA, 19 nt, Artificial Sequence
  RNA Oligomer
cucuguuguuguagcuugg

SEQ ID NO: 910 - RNA, 19 nt, Artificial Sequence
  RNA Oligomer
aauuuguuucuuagcugca

SEQ ID NO: 911 - RNA, 19 nt, Artificial Sequence
  RNA Oligomer
gucaguucuucuacuuuug

SEQ ID NO: 912 - RNA, 19 nt, Artificial Sequence
  RNA Oligomer
caguucuucuacuuuugac

SEQ ID NO: 913 - RNA, 19 nt, Artificial Sequence
  RNA Oligomer
uucuucuacuuuugacaca

SEQ ID NO: 914 - RNA, 19 nt, Artificial Sequence
  RNA Oligomer
uucaucuguucaauuuccu

SEQ ID NO: 915 - RNA, 19 nt, Artificial Sequence
  RNA Oligomer
uagccuuuuaaguuucucc

SEQ ID NO: 916 - RNA, 19 nt, Artificial Sequence
  RNA Oligomer
uuucaaaaacuuuaagcgc

SEQ ID NO: 917 - RNA, 19 nt, Artificial Sequence
  RNA Oligomer
aaguucagcaagagucaga

SEQ ID NO: 918 - RNA, 19 nt, Artificial Sequence
  RNA Oligomer
acaucuaauuacugguacc

SEQ ID NO: 919 - RNA, 19 nt, Artificial Sequence
  RNA Oligomer
uacugguaccguagcuuag

SEQ ID NO: 920 - RNA, 19 nt, Artificial Sequence
  RNA Oligomer
uuucuucgauauucaccag

SEQ ID NO: 921 - RNA, 19 nt, Artificial Sequence
  RNA Oligomer
aauggugaauucuucaauc

SEQ ID NO: 922 - RNA, 19 nt, Artificial Sequence
  RNA Oligomer
uucaauccuucauucucuu

SEQ ID NO: 923 - RNA, 19 nt, Artificial Sequence
  RNA Oligomer
auccuucauucucuucuag

SEQ ID NO: 924 - RNA, 19 nt, Artificial Sequence
  RNA Oligomer
augucacuguaggucaugg

SEQ ID NO: 925 - RNA, 19 nt, Artificial Sequence
  RNA Oligomer
uuggacguuguuacaugag

SEQ ID NO: 926 - RNA, 19 nt, Artificial Sequence
  RNA Oligomer
uggacguuguuacaugagg

SEQ ID NO: 927 - RNA, 19 nt, Artificial Sequence
  RNA Oligomer
aacgauuucuguguggccu

SEQ ID NO: 928 - RNA, 19 nt, Artificial Sequence
  RNA Oligomer
guacaaggucaaauucucc

SEQ ID NO: 929 - RNA, 19 nt, Artificial Sequence
  RNA Oligomer
acaaggucaaauucucccu

SEQ ID NO: 930 - RNA, 19 nt, Artificial Sequence
  RNA Oligomer
aagcacauguggagccucu

SEQ ID NO: 931 - RNA, 19 nt, Artificial Sequence
  RNA Oligomer
auggguaugaugggacaga

SEQ ID NO: 932 - RNA, 19 nt, Artificial Sequence
  RNA Oligomer
agcaucacucugguuucgg

SEQ ID NO: 933 - RNA, 19 nt, Artificial Sequence
  RNA Oligomer
uggaauauauugaacuugc

SEQ ID NO: 934 - RNA, 19 nt, Artificial Sequence
  RNA Oligomer
aaauggcaaucacucucgc

SEQ ID NO: 935 - RNA, 19 nt, Artificial Sequence
  RNA Oligomer
agccacauuuuuauuugca

SEQ ID NO: 936 - RNA, 19 nt, Artificial Sequence
  RNA Oligomer
cauuuuuauuugcaaccug

SEQ ID NO: 937 - RNA, 19 nt, Artificial Sequence
  RNA Oligomer
uuuuauuugcaaccugagc

SEQ ID NO: 938 - RNA, 19 nt, Artificial Sequence
  RNA Oligomer
uuugcacagauccaccacg

SEQ ID NO: 939 - RNA, 19 nt, Artificial Sequence
  RNA Oligomer
uugcacagauccaccacgu

SEQ ID NO: 940 - RNA, 19 nt, Artificial Sequence
  RNA Oligomer
agugucuguauuuucaucg

SEQ ID NO: 941 - RNA, 19 nt, Artificial Sequence
  RNA Oligomer
auccgaggcauaguagacg

SEQ ID NO: 942 - RNA, 19 nt, Artificial Sequence
  RNA Oligomer
cugguagauuuucuuuuug

SEQ ID NO: 943 - RNA, 19 nt, Artificial Sequence
  RNA Oligomer
auucaaacacucccucugu

SEQ ID NO: 944 - RNA, 19 nt, Artificial Sequence
  RNA Oligomer
uugcuggaacaaauuauuc

SEQ ID NO: 945 - RNA, 19 nt, Artificial Sequence
  RNA Oligomer
ucucagcuauuucuuuuag

SEQ ID NO: 946 - RNA, 19 nt, Artificial Sequence
  RNA Oligomer
uugcugggcuucaaucugu

SEQ ID NO: 947 - RNA, 19 nt, Artificial Sequence
  RNA Oligomer
acaccguucuccuuucuuc

SEQ ID NO: 948 - RNA, 19 nt, Artificial Sequence
  RNA Oligomer
aucuaauuacugguaccgu

SEQ ID NO: 949 - RNA, 19 nt, Artificial Sequence
  RNA Oligomer
ucuccuuucuucgauauuc

SEQ ID NO: 950 - RNA, 19 nt, Artificial Sequence
  RNA Oligomer
cuccuuucuucgauauuca

SEQ ID NO: 951 - RNA, 19 nt, Artificial Sequence
  RNA Oligomer
guagaaaacaggauugucg

SEQ ID NO: 952 - RNA, 19 nt, Artificial Sequence
  RNA Oligomer
ugucgcuguauacuuaucu

SEQ ID NO: 953 - RNA, 19 nt, Artificial Sequence
  RNA Oligomer
ucgcuguauacuuaucuga

SEQ ID NO: 954 - RNA, 19 nt, Artificial Sequence
  RNA Oligomer
cauugacuaaaauucugug

SEQ ID NO: 955 - RNA, 19 nt, Artificial Sequence
  RNA Oligomer
ucaucuucgucuucccugu

SEQ ID NO: 956 - RNA, 19 nt, Artificial Sequence
  RNA Oligomer
uccuuuauucauuaugccc

SEQ ID NO: 957 - RNA, 19 nt, Artificial Sequence
  RNA Oligomer
uuacacacuuggacguugu

SEQ ID NO: 958 - RNA, 19 nt, Artificial Sequence
  RNA Oligomer
cuuggacguuguuacauga

SEQ ID NO: 959 - RNA, 19 nt, Artificial Sequence
  RNA Oligomer
gacguuguuacaugaggca

SEQ ID NO: 960 - RNA, 19 nt, Artificial Sequence
  RNA Oligomer
gcacaauguaauggagucc

SEQ ID NO: 961 - RNA, 19 nt, Artificial Sequence
  RNA Oligomer
cacaauguaauggagucca

SEQ ID NO: 962 - RNA, 19 nt, Artificial Sequence
  RNA Oligomer
aucagcagcauuuacauuu

SEQ ID NO: 963 - RNA, 19 nt, Artificial Sequence
  RNA Oligomer
ugaauuucacccucauucc

SEQ ID NO: 964 - RNA, 19 nt, Artificial Sequence
  RNA Oligomer
ucaagcacauguggagccu

SEQ ID NO: 965 - RNA, 19 nt, Artificial Sequence
  RNA Oligomer
uagacaguuucuuucguaa

SEQ ID NO: 966 - RNA, 19 nt, Artificial Sequence
  RNA Oligomer
ugguuucgguaaggauuag

SEQ ID NO: 967 - RNA, 19 nt, Artificial Sequence
  RNA Oligomer
ggcaguaauuuaguugggc

SEQ ID NO: 968 - RNA, 19 nt, Artificial Sequence
  RNA Oligomer
ucuuucguuuucaugguuc

SEQ ID NO: 969 - RNA, 19 nt, Artificial Sequence
  RNA Oligomer
gaaguuuuuuccuggcgcc

SEQ ID NO: 970 - RNA, 19 nt, Artificial Sequence
  RNA Oligomer
uaguuuguccaaaauaagg

SEQ ID NO: 971 - RNA, 19 nt, Artificial Sequence
  RNA Oligomer
uuuuuauuugcaaccugag

SEQ ID NO: 972 - RNA, 19 nt, Artificial Sequence
  RNA Oligomer
uucuuugcacagauccacc

SEQ ID NO: 973 - RNA, 19 nt, Artificial Sequence
  RNA Oligomer
aucugcauuugaaggacuc

SEQ ID NO: 974 - RNA, 19 nt, Artificial Sequence
  RNA Oligomer
ugucuguauuuucaucggc

SEQ ID NO: 975 - RNA, 19 nt, Artificial Sequence
  RNA Oligomer
auuuccaucagaugaaacu

SEQ ID NO: 976 - RNA, 19 nt, Artificial Sequence
  RNA Oligomer
ccucagcucauuaacacgc

SEQ ID NO: 977 - RNA, 19 nt, Artificial Sequence
  RNA Oligomer
uuaacacgcuuauccauga

SEQ ID NO: 978 - RNA, 19 nt, Artificial Sequence
  RNA Oligomer
cacuucugaauuacgcuua

SEQ ID NO: 979 - RNA, 19 nt, Artificial Sequence
  RNA Oligomer
cuuauucaaacacucccuc

SEQ ID NO: 980 - RNA, 19 nt, Artificial Sequence
  RNA Oligomer
ucccucuguuguuguagcu

SEQ ID NO: 981 - RNA, 19 nt, Artificial Sequence
  RNA Oligomer
aguaacuggaacuucugug

SEQ ID NO: 982 - RNA, 19 nt, Artificial Sequence
  RNA Oligomer
ucuucuacuuuugacacag

SEQ ID NO: 983 - RNA, 19 nt, Artificial Sequence
  RNA Oligomer
ugcuggaacaaauuauuca

SEQ ID NO: 984 - RNA, 19 nt, Artificial Sequence
  RNA Oligomer
auugcuuagucucuucugu

SEQ ID NO: 985 - RNA, 19 nt, Artificial Sequence
  RNA Oligomer
uuagucucuucuguuccac

SEQ ID NO: 986 - RNA, 19 nt, Artificial Sequence
  RNA Oligomer
aagugcugcucauuguuac

SEQ ID NO: 987 - RNA, 19 nt, Artificial Sequence
  RNA Oligomer
ugcucucacuuuuuuuagc

SEQ ID NO: 988 - RNA, 19 nt, Artificial Sequence
  RNA Oligomer
cucacuuuuuuuagcuuag

SEQ ID NO: 989 - RNA, 19 nt, Artificial Sequence
  RNA Oligomer
ucacuuuuuuuagcuuagc

SEQ ID NO: 990 - RNA, 19 nt, Artificial Sequence
  RNA Oligomer
ucgcugaucuuguuguuuc

SEQ ID NO: 991 - RNA, 19 nt, Artificial Sequence
  RNA Oligomer
caacuguuuuuaaagucag

SEQ ID NO: 992 - RNA, 19 nt, Artificial Sequence
  RNA Oligomer
uucacugacaaccaacuaa

SEQ ID NO: 993 - RNA, 19 nt, Artificial Sequence
  RNA Oligomer
aaccaacuaacaguucuuc

SEQ ID NO: 994 - RNA, 19 nt, Artificial Sequence
  RNA Oligomer
ugacaauauacaagugugc

SEQ ID NO: 995 - RNA, 19 nt, Artificial Sequence
  RNA Oligomer
cuuucuucgauauucacca

SEQ ID NO: 996 - RNA, 19 nt, Artificial Sequence
  RNA Oligomer
augauccuauuuacuagac

SEQ ID NO: 997 - RNA, 19 nt, Artificial Sequence
  RNA Oligomer
auuuacuagacaggauucu

SEQ ID NO: 998 - RNA, 19 nt, Artificial Sequence
  RNA Oligomer
uagaaaacaggauugucgc

SEQ ID NO: 999 - RNA, 19 nt, Artificial Sequence
  RNA Oligomer
uugucgcuguauacuuauc

SEQ ID NO: 1000 - RNA, 19 nt, Artificial Sequence
  RNA Oligomer
aauccuucauucucuucua

SEQ ID NO: 1001 - RNA, 19 nt, Artificial Sequence
  RNA Oligomer
cuuucaagcuacauuguca

SEQ ID NO: 1002 - RNA, 19 nt, Artificial Sequence
  RNA Oligomer
caaagcgcauaaaugacuc

SEQ ID NO: 1003 - RNA, 19 nt, Artificial Sequence
  RNA Oligomer
auuaugcccaucuucuccu

SEQ ID NO: 1004 - RNA, 19 nt, Artificial Sequence
  RNA Oligomer
uccaccaaaaacuuacaca

SEQ ID NO: 1005 - RNA, 19 nt, Artificial Sequence
  RNA Oligomer
ggacguuguuacaugaggc

SEQ ID NO: 1006 - RNA, 19 nt, Artificial Sequence
  RNA Oligomer
agcauuuacauuuacacca

SEQ ID NO: 1007 - RNA, 19 nt, Artificial Sequence
  RNA Oligomer
uuacauuuacaccaaacug

SEQ ID NO: 1008 - RNA, 19 nt, Artificial Sequence
  RNA Oligomer
uguaccaggaacuuaacga

SEQ ID NO: 1009 - RNA, 19 nt, Artificial Sequence
  RNA Oligomer
acuuaacgauuucugugug

SEQ ID NO: 1010 - RNA, 19 nt, Artificial Sequence
  RNA Oligomer
auucucuguacaaggucaa

SEQ ID NO: 1011 - RNA, 19 nt, Artificial Sequence
  RNA Oligomer
uguacaaggucaaauucuc

SEQ ID NO: 1012 - RNA, 19 nt, Artificial Sequence
  RNA Oligomer
aauucucccuccaaagacg

SEQ ID NO: 1013 - RNA, 19 nt, Artificial Sequence
  RNA Oligomer
acaucaagcacauguggag

SEQ ID NO: 1014 - RNA, 19 nt, Artificial Sequence
  RNA Oligomer
uccucugacuuccaaaucg

SEQ ID NO: 1015 - RNA, 19 nt, Artificial Sequence
  RNA Oligomer
uggugcguuagacaguuuc

SEQ ID NO: 1016 - RNA, 19 nt, Artificial Sequence
  RNA Oligomer
uucuuucguuuucaugguu

SEQ ID NO: 1017 - RNA, 19 nt, Artificial Sequence
  RNA Oligomer
aagguaugcugggagauag

SEQ ID NO: 1018 - RNA, 19 nt, Artificial Sequence
  RNA Oligomer
aacaacuguugacaacugc

SEQ ID NO: 1019 - RNA, 19 nt, Artificial Sequence
  RNA Oligomer
caucccgcaagauaucuuc

SEQ ID NO: 1020 - RNA, 19 nt, Artificial Sequence
  RNA Oligomer
uuccucagaguaccaaagg

SEQ ID NO: 1021 - RNA, 19 nt, Artificial Sequence
  RNA Oligomer
aacauugagaacggacgca

SEQ ID NO: 1022 - RNA, 19 nt, Artificial Sequence
  RNA Oligomer
aaagaucugcauuugaagg

SEQ ID NO: 1023 - RNA, 19 nt, Artificial Sequence
  RNA Oligomer
uuugaaggacuccaaucag

SEQ ID NO: 1024 - RNA, 19 nt, Artificial Sequence
  RNA Oligomer
gugucuguauuuucaucgg

SEQ ID NO: 1025 - RNA, 19 nt, Artificial Sequence
  RNA Oligomer
uuuccaucagaugaaacug

SEQ ID NO: 1026 - RNA, 19 nt, Artificial Sequence
  RNA Oligomer
auuguuucuggaguaacug

SEQ ID NO: 1027 - RNA, 19 nt, Artificial Sequence
  RNA Oligomer
uaacacgcuuauccaugac

SEQ ID NO: 1028 - RNA, 19 nt, Artificial Sequence
  RNA Oligomer
uuacgcuuauucaaacacu

SEQ ID NO: 1029 - RNA, 19 nt, Artificial Sequence
  RNA Oligomer
uacgcuuauucaaacacuc

SEQ ID NO: 1030 - RNA, 19 nt, Artificial Sequence
  RNA Oligomer
aguucuucuacuuuugaca

SEQ ID NO: 1031 - RNA, 19 nt, Artificial Sequence
  RNA Oligomer
cuucuacuuuugacacagc

SEQ ID NO: 1032 - RNA, 19 nt, Artificial Sequence
  RNA Oligomer
aucuguucaauuuccucca

SEQ ID NO: 1033 - RNA, 19 nt, Artificial Sequence
  RNA Oligomer
cacuuuuuuuagcuuagcu

SEQ ID NO: 1034 - RNA, 19 nt, Artificial Sequence
  RNA Oligomer
ugcugcucauuguuacuga

SEQ ID NO: 1035 - RNA, 19 nt, Artificial Sequence
  RNA Oligomer
uuuuaaguuucuccugcuc

SEQ ID NO: 1036 - RNA, 19 nt, Artificial Sequence
  RNA Oligomer
uucaaaaacuuuaagcgcu

SEQ ID NO: 1037 - RNA, 19 nt, Artificial Sequence
  RNA Oligomer
auuguuacugagauacacg

SEQ ID NO: 1038 - RNA, 19 nt, Artificial Sequence
  RNA Oligomer
gcaagagucagauccaucc

SEQ ID NO: 1039 - RNA, 19 nt, Artificial Sequence
  RNA Oligomer
agagucagauccauccuag

SEQ ID NO: 1040 - RNA, 19 nt, Artificial Sequence
  RNA Oligomer
aucuugacaaauauuacgg

SEQ ID NO: 1041 - RNA, 19 nt, Artificial Sequence
  RNA Oligomer
cuugacaaauauuacgggu

SEQ ID NO: 1042 - RNA, 19 nt, Artificial Sequence
  RNA Oligomer
caaguuucuaauuucugag

SEQ ID NO: 1043 - RNA, 19 nt, Artificial Sequence
  RNA Oligomer
uaccguagcuuaguuucaa

SEQ ID NO: 1044 - RNA, 19 nt, Artificial Sequence
  RNA Oligomer
acugcccaauaaaugaucc

SEQ ID NO: 1045 - RNA, 19 nt, Artificial Sequence
  RNA Oligomer
gucgcuguauacuuaucug

SEQ ID NO: 1046 - RNA, 19 nt, Artificial Sequence
  RNA Oligomer
acguagaugcuuuauuuca

SEQ ID NO: 1047 - RNA, 19 nt, Artificial Sequence
  RNA Oligomer
ugcuuuauuucaucacgcu

SEQ ID NO: 1048 - RNA, 19 nt, Artificial Sequence
  RNA Oligomer
uuucaagcuacauugucau

SEQ ID NO: 1049 - RNA, 19 nt, Artificial Sequence
  RNA Oligomer
uuacuucuucuuaacagag

SEQ ID NO: 1050 - RNA, 19 nt, Artificial Sequence
  RNA Oligomer
uuuuaaacuuggauccuga

SEQ ID NO: 1051 - RNA, 19 nt, Artificial Sequence
  RNA Oligomer
uuaugcccaucuucuccug

SEQ ID NO: 1052 - RNA, 19 nt, Artificial Sequence
  RNA Oligomer
auaaagaaauugggagcac

SEQ ID NO: 1053 - RNA, 19 nt, Artificial Sequence
  RNA Oligomer
uagccuuccuccauuuccu

SEQ ID NO: 1054 - RNA, 19 nt, Artificial Sequence
  RNA Oligomer
auuuccucgcacuuaucug

SEQ ID NO: 1055 - RNA, 19 nt, Artificial Sequence
  RNA Oligomer
cacacuuggacguuguuac

SEQ ID NO: 1056 - RNA, 19 nt, Artificial Sequence
  RNA Oligomer
caaggucaaauucucccuc

SEQ ID NO: 1057 - RNA, 19 nt, Artificial Sequence
  RNA Oligomer
guacacaucaagcacaugu

SEQ ID NO: 1058 - RNA, 19 nt, Artificial Sequence
  RNA Oligomer
uggauuugguucuucuggg

SEQ ID NO: 1059 - RNA, 19 nt, Artificial Sequence
  RNA Oligomer
auucuggagauuugggcug

SEQ ID NO: 1060 - RNA, 19 nt, Artificial Sequence
  RNA Oligomer
uucuggagauuugggcugu

SEQ ID NO: 1061 - RNA, 19 nt, Artificial Sequence
  RNA Oligomer
ucaggcucauaaucaaggc

SEQ ID NO: 1062 - RNA, 19 nt, Artificial Sequence
  RNA Oligomer
uucucuguacuggcauucc

SEQ ID NO: 1063 - RNA, 19 nt, Artificial Sequence
  RNA Oligomer
aauauggauucuggauuuc

SEQ ID NO: 1064 - RNA, 19 nt, Artificial Sequence
  RNA Oligomer
gauuucuacugggcuuucu

SEQ ID NO: 1065 - RNA, 19 nt, Artificial Sequence
  RNA Oligomer
auuucuacugggcuuucug

SEQ ID NO: 1066 - RNA, 19 nt, Artificial Sequence
  RNA Oligomer
uucuacugggcuuucugag

SEQ ID NO: 1067 - RNA, 19 nt, Artificial Sequence
  RNA Oligomer
uuggugcguuagacaguuu

SEQ ID NO: 1068 - RNA, 19 nt, Artificial Sequence
  RNA Oligomer
gacaguuucuuucguaagg

SEQ ID NO: 1069 - RNA, 19 nt, Artificial Sequence
  RNA Oligomer
cacucugguuucgguaagg

SEQ ID NO: 1070 - RNA, 19 nt, Artificial Sequence
  RNA Oligomer
acucugguuucgguaagga

SEQ ID NO: 1071 - RNA, 19 nt, Artificial Sequence
  RNA Oligomer
aaggauuagauaagaaagg

SEQ ID NO: 1072 - RNA, 19 nt, Artificial Sequence
  RNA Oligomer
aggauuagauaagaaaggc

SEQ ID NO: 1073 - RNA, 19 nt, Artificial Sequence
  RNA Oligomer
aaauguucucugggugcug

SEQ ID NO: 1074 - RNA, 19 nt, Artificial Sequence
  RNA Oligomer
uuacaggcuuaccauauac

SEQ ID NO: 1075 - RNA, 19 nt, Artificial Sequence
  RNA Oligomer
agaaagggucuggucuugg

SEQ ID NO: 1076 - RNA, 19 nt, Artificial Sequence
  RNA Oligomer
cugguuuugguuuaguucc

SEQ ID NO: 1077 - RNA, 19 nt, Artificial Sequence
  RNA Oligomer
uagccacauuuuuauuugc

SEQ ID NO: 1078 - RNA, 19 nt, Artificial Sequence
  RNA Oligomer
caagauaucuucacugcuc

SEQ ID NO: 1079 - RNA, 19 nt, Artificial Sequence
  RNA Oligomer
auaucuucacugcucuggu

SEQ ID NO: 1080 - RNA, 19 nt, Artificial Sequence
  RNA Oligomer
guucuuugcacagauccac

SEQ ID NO: 1081 - RNA, 19 nt, Artificial Sequence
  RNA Oligomer
uacugcaucaaacauugag

SEQ ID NO: 1082 - RNA, 19 nt, Artificial Sequence
  RNA Oligomer
acuuucuucucuuucuccc

SEQ ID NO: 1083 - RNA, 19 nt, Artificial Sequence
  RNA Oligomer
uugauccagagcauuccca

SEQ ID NO: 1084 - RNA, 19 nt, Artificial Sequence
  RNA Oligomer
auccagagcauucccagug

SEQ ID NO: 1085 - RNA, 19 nt, Artificial Sequence
  RNA Oligomer
uggauggauuuuagagccu

SEQ ID NO: 1086 - RNA, 19 nt, Artificial Sequence
  RNA Oligomer
auggauuuuagagccuuua

SEQ ID NO: 1087 - RNA, 19 nt, Artificial Sequence
  RNA Oligomer
gucucugcauauuguuucu

SEQ ID NO: 1088 - RNA, 19 nt, Artificial Sequence
  RNA Oligomer
gucuguauuuucaucggcc

SEQ ID NO: 1089 - RNA, 19 nt, Artificial Sequence
  RNA Oligomer
ucuguauuuucaucggccc

SEQ ID NO: 1090 - RNA, 19 nt, Artificial Sequence
  RNA Oligomer
uauuguuucuggaguaacu

SEQ ID NO: 1091 - RNA, 19 nt, Artificial Sequence
  RNA Oligomer
aagauuuccaucagaugaa

SEQ ID NO: 1092 - RNA, 19 nt, Artificial Sequence
  RNA Oligomer
ucccucagcucauuaacac

SEQ ID NO: 1093 - RNA, 19 nt, Artificial Sequence
  RNA Oligomer
acugccacuucugaauuac

SEQ ID NO: 1094 - RNA, 19 nt, Artificial Sequence
  RNA Oligomer
cgcuuauucaaacacuccc

SEQ ID NO: 1095 - RNA, 19 nt, Artificial Sequence
  RNA Oligomer
ucuguuguuguagcuuggc

SEQ ID NO: 1096 - RNA, 19 nt, Artificial Sequence
  RNA Oligomer
caauuuguuucuuagcugc

SEQ ID NO: 1097 - RNA, 19 nt, Artificial Sequence
  RNA Oligomer
ucucuucuguuccacgugg

SEQ ID NO: 1098 - RNA, 19 nt, Artificial Sequence
  RNA Oligomer
cuuuuuuuagcuuagcuuc

SEQ ID NO: 1099 - RNA, 19 nt, Artificial Sequence
  RNA Oligomer
uagcuuagcuuccugauuc

SEQ ID NO: 1100 - RNA, 19 nt, Artificial Sequence
  RNA Oligomer
cuguuccuuaguugccagc

SEQ ID NO: 1101 - RNA, 19 nt, Artificial Sequence
  RNA Oligomer
aaauauuacggguaagucu

SEQ ID NO: 1102 - RNA, 19 nt, Artificial Sequence
  RNA Oligomer
acaaccaacuaacaguucu

SEQ ID NO: 1103 - RNA, 19 nt, Artificial Sequence
  RNA Oligomer
uauuucaucacgcuaaaug

SEQ ID NO: 1104 - RNA, 19 nt, Artificial Sequence
  RNA Oligomer
uaucccuccuuaucauuaa

SEQ ID NO: 1105 - RNA, 19 nt, Artificial Sequence
  RNA Oligomer
auuucaucuucgucuuccc

SEQ ID NO: 1106 - RNA, 19 nt, Artificial Sequence
  RNA Oligomer
auaaucccaaagcgcauaa

SEQ ID NO: 1107 - RNA, 19 nt, Artificial Sequence
  RNA Oligomer
uuuauucauuaugcccauc

SEQ ID NO: 1108 - RNA, 19 nt, Artificial Sequence
  RNA Oligomer
cuuacacacuuggacguug

SEQ ID NO: 1109 - RNA, 19 nt, Artificial Sequence
  RNA Oligomer
agcacaauguaauggaguc

SEQ ID NO: 1110 - RNA, 19 nt, Artificial Sequence
  RNA Oligomer
aaauucucccuccaaagac

SEQ ID NO: 1111 - RNA, 19 nt, Artificial Sequence
  RNA Oligomer
uuuuacgcaaguuuguccu

SEQ ID NO: 1112 - RNA, 19 nt, Artificial Sequence
  RNA Oligomer
uuuucgggcuccacaugua

SEQ ID NO: 1113 - RNA, 19 nt, Artificial Sequence
  RNA Oligomer
augaugggacagagauggu

SEQ ID NO: 1114 - RNA, 19 nt, Artificial Sequence
  RNA Oligomer
cuucugaauauuuggccca

SEQ ID NO: 1115 - RNA, 19 nt, Artificial Sequence
  RNA Oligomer
cucuguaauagaacuacgu

SEQ ID NO: 1116 - RNA, 19 nt, Artificial Sequence
  RNA Oligomer
aacuacguuucuuuagagg

SEQ ID NO: 1117 - RNA, 19 nt, Artificial Sequence
  RNA Oligomer
agaacaucaaacauucgcu

SEQ ID NO: 1118 - RNA, 19 nt, Artificial Sequence
  RNA Oligomer
uuucuuucguaaggcuucu

SEQ ID NO: 1119 - RNA, 19 nt, Artificial Sequence
  RNA Oligomer
cuuucguuuucaugguucu

SEQ ID NO: 1120 - RNA, 19 nt, Artificial Sequence
  RNA Oligomer
acauucgcucauuauccgc

SEQ ID NO: 1121 - RNA, 19 nt, Artificial Sequence
  RNA Oligomer
auauugaacuugcugccac

SEQ ID NO: 1122 - RNA, 19 nt, Artificial Sequence
  RNA Oligomer
uauugaacuugcugccacg

SEQ ID NO: 1123 - RNA, 19 nt, Artificial Sequence
  RNA Oligomer
ucuuugcacagauccacca

SEQ ID NO: 1124 - RNA, 19 nt, Artificial Sequence
  RNA Oligomer
caucaaacauugagaacgg

SEQ ID NO: 1125 - RNA, 19 nt, Artificial Sequence
  RNA Oligomer
aaacauugagaacggacgc

SEQ ID NO: 1126 - RNA, 19 nt, Artificial Sequence
  RNA Oligomer
acauugagaacggacgcac

SEQ ID NO: 1127 - RNA, 19 nt, Artificial Sequence
  RNA Oligomer
uucuucucuuucucccuca

SEQ ID NO: 1128 - RNA, 19 nt, Artificial Sequence
  RNA Oligomer
aucaacuugauccagagca

SEQ ID NO: 1129 - RNA, 19 nt, Artificial Sequence
  RNA Oligomer
uugagguacagaagcagag

SEQ ID NO: 1130 - RNA, 19 nt, Artificial Sequence
  RNA Oligomer
ucugcauuugaaggacucc

SEQ ID NO: 1131 - RNA, 19 nt, Artificial Sequence
  RNA Oligomer
ucucugcauauuguuucug

SEQ ID NO: 1132 - RNA, 19 nt, Artificial Sequence
  RNA Oligomer
aucggcaucaucuuggacc

SEQ ID NO: 1133 - RNA, 19 nt, Artificial Sequence
  RNA Oligomer
auccaugacugccacuucu

SEQ ID NO: 1134 - RNA, 19 nt, Artificial Sequence
  RNA Oligomer
acgcuuauucaaacacucc

SEQ ID NO: 1135 - RNA, 19 nt, Artificial Sequence
  RNA Oligomer
gcuuauucaaacacucccu

SEQ ID NO: 1136 - RNA, 19 nt, Artificial Sequence
  RNA Oligomer
cuguuguuguagcuuggca

SEQ ID NO: 1137 - RNA, 19 nt, Artificial Sequence
  RNA Oligomer
gugcugcucauuguuacug

SEQ ID NO: 1138 - RNA, 19 nt, Artificial Sequence
  RNA Oligomer
uuagccuuuuaaguuucuc

SEQ ID NO: 1139 - RNA, 19 nt, Artificial Sequence
  RNA Oligomer
ccuuuuaaguuucuccugc

SEQ ID NO: 1140 - RNA, 19 nt, Artificial Sequence
  RNA Oligomer
uuaaguuucuccugcucag

SEQ ID NO: 1141 - RNA, 19 nt, Artificial Sequence
  RNA Oligomer
cauuguuacugagauacac

SEQ ID NO: 1142 - RNA, 19 nt, Artificial Sequence
  RNA Oligomer
uucaaucuguugcugcugg

SEQ ID NO: 1143 - RNA, 19 nt, Artificial Sequence
  RNA Oligomer
aagagucagauccauccua

SEQ ID NO: 1144 - RNA, 19 nt, Artificial Sequence
  RNA Oligomer
uccuaggacuauuaacacc

SEQ ID NO: 1145 - RNA, 19 nt, Artificial Sequence
  RNA Oligomer
ccuaggacuauuaacaccg

SEQ ID NO: 1146 - RNA, 19 nt, Artificial Sequence
  RNA Oligomer
uugacaaauauuacgggua

SEQ ID NO: 1147 - RNA, 19 nt, Artificial Sequence
  RNA Oligomer
aauucagccuacaaacaag

SEQ ID NO: 1148 - RNA, 19 nt, Artificial Sequence
  RNA Oligomer
caaacaagauucuacaucu

SEQ ID NO: 1149 - RNA, 19 nt, Artificial Sequence
  RNA Oligomer
aaaguuauuguucacugac

SEQ ID NO: 1150 - RNA, 19 nt, Artificial Sequence
  RNA Oligomer
uauacaagugugcagugcc

SEQ ID NO: 1151 - RNA, 19 nt, Artificial Sequence
  RNA Oligomer
auacaagugugcagugccu

SEQ ID NO: 1152 - RNA, 19 nt, Artificial Sequence
  RNA Oligomer
auuucaucacgcuaaaugu

SEQ ID NO: 1153 - RNA, 19 nt, Artificial Sequence
  RNA Oligomer
aucacgcuaaauguccucu

SEQ ID NO: 1154 - RNA, 19 nt, Artificial Sequence
  RNA Oligomer
agucccagcaaguuacgug

SEQ ID NO: 1155 - RNA, 19 nt, Artificial Sequence
  RNA Oligomer
aacauaucccuccuuauca

SEQ ID NO: 1156 - RNA, 19 nt, Artificial Sequence
  RNA Oligomer
aucauucugagguucauaa

SEQ ID NO: 1157 - RNA, 19 nt, Artificial Sequence
  RNA Oligomer
ccuuuauucauuaugccca

SEQ ID NO: 1158 - RNA, 19 nt, Artificial Sequence
  RNA Oligomer
cauuaugcccaucuucucc

SEQ ID NO: 1159 - RNA, 19 nt, Artificial Sequence
  RNA Oligomer
gaacuccauaaagaaauug

SEQ ID NO: 1160 - RNA, 19 nt, Artificial Sequence
  RNA Oligomer
guagccuuccuccauuucc

SEQ ID NO: 1161 - RNA, 19 nt, Artificial Sequence
  RNA Oligomer
cagcagcauuuacauuuac

SEQ ID NO: 1162 - RNA, 19 nt, Artificial Sequence
  RNA Oligomer
auuucacccucauuccaug

SEQ ID NO: 1163 - RNA, 19 nt, Artificial Sequence
  RNA Oligomer
uccagguacacaucaagca

SEQ ID NO: 1164 - RNA, 19 nt, Artificial Sequence
  RNA Oligomer
cugacuuccaaaucguuga

SEQ ID NO: 1165 - RNA, 19 nt, Artificial Sequence
  RNA Oligomer
ucacuguucucuguacugg

SEQ ID NO: 1166 - RNA, 19 nt, Artificial Sequence
  RNA Oligomer
ucucuguacuggcauuccc

SEQ ID NO: 1167 - RNA, 19 nt, Artificial Sequence
  RNA Oligomer
uucugaauauuuggcccau

SEQ ID NO: 1168 - RNA, 19 nt, Artificial Sequence
  RNA Oligomer
guaauagaacuacguuucu

SEQ ID NO: 1169 - RNA, 19 nt, Artificial Sequence
  RNA Oligomer
gaagaacaucaaacauucg

SEQ ID NO: 1170 - RNA, 19 nt, Artificial Sequence
  RNA Oligomer
uagauaagaaaggcaguaa

SEQ ID NO: 1171 - RNA, 19 nt, Artificial Sequence
  RNA Oligomer
uuucguuuucaugguucuc

SEQ ID NO: 1172 - RNA, 19 nt, Artificial Sequence
  RNA Oligomer
uugcuuagaaccuggagaa

SEQ ID NO: 1173 - RNA, 19 nt, Artificial Sequence
  RNA Oligomer
caacugcugagaacuuccg

SEQ ID NO: 1174 - RNA, 19 nt, Artificial Sequence
  RNA Oligomer
cugcugagaacuuccgucu

SEQ ID NO: 1175 - RNA, 19 nt, Artificial Sequence
  RNA Oligomer
aucuucacugcucugguuc

SEQ ID NO: 1176 - RNA, 19 nt, Artificial Sequence
  RNA Oligomer
uuucuucucuuucucccuc

SEQ ID NO: 1177 - RNA, 19 nt, Artificial Sequence
  RNA Oligomer
cuuugagguacagaagcag

SEQ ID NO: 1178 - RNA, 19 nt, Artificial Sequence
  RNA Oligomer
auuaacacgcuuauccaug

SEQ ID NO: 1179 - RNA, 19 nt, Artificial Sequence
  RNA Oligomer
cuacuuuugacacagccag

SEQ ID NO: 1180 - RNA, 19 nt, Artificial Sequence
  RNA Oligomer
uacuuuugacacagccagg

SEQ ID NO: 1181 - RNA, 19 nt, Artificial Sequence
  RNA Oligomer
uuuaaguuucuccugcuca

SEQ ID NO: 1182 - RNA, 19 nt, Artificial Sequence
  RNA Oligomer
aacuuuaagcgcuguuccu

SEQ ID NO: 1183 - RNA, 19 nt, Artificial Sequence
  RNA Oligomer
augccauuuccugaaguuc

SEQ ID NO: 1184 - RNA, 19 nt, Artificial Sequence
  RNA Oligomer
auccuaggacuauuaacac

SEQ ID NO: 1185 - RNA, 19 nt, Artificial Sequence
  RNA Oligomer
cuaggacuauuaacaccgu

SEQ ID NO: 1186 - RNA, 19 nt, Artificial Sequence
  RNA Oligomer
uaggacuauuaacaccguu

SEQ ID NO: 1187 - RNA, 19 nt, Artificial Sequence
  RNA Oligomer
aagucuguagcaaguuucu

SEQ ID NO: 1188 - RNA, 19 nt, Artificial Sequence
  RNA Oligomer
guagcaaguuucuaauuuc

SEQ ID NO: 1189 - RNA, 19 nt, Artificial Sequence
  RNA Oligomer
auucagccuacaaacaaga

SEQ ID NO: 1190 - RNA, 19 nt, Artificial Sequence
  RNA Oligomer
acugacaauauacaagugu

SEQ ID NO: 1191 - RNA, 19 nt, Artificial Sequence
  RNA Oligomer
gaggacugguuuaggagca

SEQ ID NO: 1192 - RNA, 19 nt, Artificial Sequence
  RNA Oligomer
cagcugcugaaaacacuca

SEQ ID NO: 1193 - RNA, 19 nt, Artificial Sequence
  RNA Oligomer
gagcugauuucccaacugc

SEQ ID NO: 1194 - RNA, 19 nt, Artificial Sequence
  RNA Oligomer
uauuuacuagacaggauuc

SEQ ID NO: 1195 - RNA, 19 nt, Artificial Sequence
  RNA Oligomer
auucaccaggaacuuuuac

SEQ ID NO: 1196 - RNA, 19 nt, Artificial Sequence
  RNA Oligomer
uucaccaggaacuuuuaca

SEQ ID NO: 1197 - RNA, 19 nt, Artificial Sequence
  RNA Oligomer
auacacgguaagaaacauc

SEQ ID NO: 1198 - RNA, 19 nt, Artificial Sequence
  RNA Oligomer
gacuaaaauucugugugga

SEQ ID NO: 1199 - RNA, 19 nt, Artificial Sequence
  RNA Oligomer
uuucaggccaagcuccuuu

SEQ ID NO: 1200 - RNA, 19 nt, Artificial Sequence
  RNA Oligomer
aucaucauucugagguuca

SEQ ID NO: 1201 - RNA, 19 nt, Artificial Sequence
  RNA Oligomer
cauaaagaaauugggagca

SEQ ID NO: 1202 - RNA, 19 nt, Artificial Sequence
  RNA Oligomer
uugguccacucacaauguc

SEQ ID NO: 1203 - RNA, 19 nt, Artificial Sequence
  RNA Oligomer
uuccuccauuuccucgcac

SEQ ID NO: 1204 - RNA, 19 nt, Artificial Sequence
  RNA Oligomer
acuaucagcagcauuuaca

SEQ ID NO: 1205 - RNA, 19 nt, Artificial Sequence
  RNA Oligomer
cagcauuuacauuuacacc

SEQ ID NO: 1206 - RNA, 19 nt, Artificial Sequence
  RNA Oligomer
uuucacccucauuccauga

SEQ ID NO: 1207 - RNA, 19 nt, Artificial Sequence
  RNA Oligomer
guuauucuggagauuuggg

SEQ ID NO: 1208 - RNA, 19 nt, Artificial Sequence
  RNA Oligomer
uauucuggagauuugggcu

SEQ ID NO: 1209 - RNA, 19 nt, Artificial Sequence
  RNA Oligomer
uagaacuacguuucuuuag

SEQ ID NO: 1210 - RNA, 19 nt, Artificial Sequence
  RNA Oligomer
aacaucaaacauucgcuca

SEQ ID NO: 1211 - RNA, 19 nt, Artificial Sequence
  RNA Oligomer
gauuagauaagaaaggcag

SEQ ID NO: 1212 - RNA, 19 nt, Artificial Sequence
  RNA Oligomer
uauauugaacuugcugcca

SEQ ID NO: 1213 - RNA, 19 nt, Artificial Sequence
  RNA Oligomer
auugaacuugcugccacgg

SEQ ID NO: 1214 - RNA, 19 nt, Artificial Sequence
  RNA Oligomer
agcagcagguggacuuucu

SEQ ID NO: 1215 - RNA, 19 nt, Artificial Sequence
  RNA Oligomer
ggcaaauuaaucuguuuug

SEQ ID NO: 1216 - RNA, 19 nt, Artificial Sequence
  RNA Oligomer
uucuuccucagaguaccaa

SEQ ID NO: 1217 - RNA, 19 nt, Artificial Sequence
  RNA Oligomer
ucuacugcaucaaacauug

SEQ ID NO: 1218 - RNA, 19 nt, Artificial Sequence
  RNA Oligomer
cacuuucuucucuuucucc

SEQ ID NO: 1219 - RNA, 19 nt, Artificial Sequence
  RNA Oligomer
aaccucuccaucaucaacu

SEQ ID NO: 1220 - RNA, 19 nt, Artificial Sequence
  RNA Oligomer
cugcauuugaaggacucca

SEQ ID NO: 1221 - RNA, 19 nt, Artificial Sequence
  RNA Oligomer
uccgaggcauaguagacga

SEQ ID NO: 1222 - RNA, 19 nt, Artificial Sequence
  RNA Oligomer
uuuuugcuguagagcugcc

SEQ ID NO: 1223 - RNA, 19 nt, Artificial Sequence
  RNA Oligomer
ucaauuuguuucuuagcug

SEQ ID NO: 1224 - RNA, 19 nt, Artificial Sequence
  RNA Oligomer
uuugacacagccaggacga

SEQ ID NO: 1225 - RNA, 19 nt, Artificial Sequence
  RNA Oligomer
cuggaacaaauuauucauc

SEQ ID NO: 1226 - RNA, 19 nt, Artificial Sequence
  RNA Oligomer
uuccuccacaaguuuccca

SEQ ID NO: 1227 - RNA, 19 nt, Artificial Sequence
  RNA Oligomer
aguuucccauugcuuaguc

SEQ ID NO: 1228 - RNA, 19 nt, Artificial Sequence
  RNA Oligomer
uucccauugcuuagucucu

SEQ ID NO: 1229 - RNA, 19 nt, Artificial Sequence
  RNA Oligomer
cuuagucucuucuguucca

SEQ ID NO: 1230 - RNA, 19 nt, Artificial Sequence
  RNA Oligomer
uagucucuucuguuccacg

SEQ ID NO: 1231 - RNA, 19 nt, Artificial Sequence
  RNA Oligomer
agucucuucuguuccacgu

SEQ ID NO: 1232 - RNA, 19 nt, Artificial Sequence
  RNA Oligomer
cuuuuaaguuucuccugcu

SEQ ID NO: 1233 - RNA, 19 nt, Artificial Sequence
  RNA Oligomer
ucaaaaacuuuaagcgcug

SEQ ID NO: 1234 - RNA, 19 nt, Artificial Sequence
  RNA Oligomer
gcaaguuucuaauuucuga

SEQ ID NO: 1235 - RNA, 19 nt, Artificial Sequence
  RNA Oligomer
acaaacaagauucuacauc

SEQ ID NO: 1236 - RNA, 19 nt, Artificial Sequence
  RNA Oligomer
uucacugacaauauacaag

SEQ ID NO: 1237 - RNA, 19 nt, Artificial Sequence
  RNA Oligomer
cugcccaauaaaugauccu

SEQ ID NO: 1238 - RNA, 19 nt, Artificial Sequence
  RNA Oligomer
ucaccaggaacuuuuacac

SEQ ID NO: 1239 - RNA, 19 nt, Artificial Sequence
  RNA Oligomer
cuucuuucaugggcagcuc

SEQ ID NO: 1240 - RNA, 19 nt, Artificial Sequence
  RNA Oligomer
caucaucauucugagguuc

SEQ ID NO: 1241 - RNA, 19 nt, Artificial Sequence
  RNA Oligomer
uucauuaugcccaucuucu

SEQ ID NO: 1242 - RNA, 19 nt, Artificial Sequence
  RNA Oligomer
auucucccuccaaagacga

SEQ ID NO: 1243 - RNA, 19 nt, Artificial Sequence
  RNA Oligomer
ucccuccaaagacgaaucu

SEQ ID NO: 1244 - RNA, 19 nt, Artificial Sequence
  RNA Oligomer
cucaggcucauaaucaagg

SEQ ID NO: 1245 - RNA, 19 nt, Artificial Sequence
  RNA Oligomer
guucucuguacuggcauuc

SEQ ID NO: 1246 - RNA, 19 nt, Artificial Sequence
  RNA Oligomer
ugauucaggaaccagagag

SEQ ID NO: 1247 - RNA, 19 nt, Artificial Sequence
  RNA Oligomer
uuucuuuagaggccuuggu

SEQ ID NO: 1248 - RNA, 19 nt, Artificial Sequence
  RNA Oligomer
aauguucucugggugcugc

SEQ ID NO: 1249 - RNA, 19 nt, Artificial Sequence
  RNA Oligomer
uugaaaaguguggcccucu

SEQ ID NO: 1250 - RNA, 19 nt, Artificial Sequence
  RNA Oligomer
aacugcugagaacuuccgu

SEQ ID NO: 1251 - RNA, 19 nt, Artificial Sequence
  RNA Oligomer
acugcugagaacuuccguc

SEQ ID NO: 1252 - RNA, 19 nt, Artificial Sequence
  RNA Oligomer
uucacugcucugguucuuc

SEQ ID NO: 1253 - RNA, 19 nt, Artificial Sequence
  RNA Oligomer
aucaaacauugagaacgga

SEQ ID NO: 1254 - RNA, 19 nt, Artificial Sequence
  RNA Oligomer
cucuccaucaucaacuuga

SEQ ID NO: 1255 - RNA, 19 nt, Artificial Sequence
  RNA Oligomer
aacuugauccagagcauuc

SEQ ID NO: 1256 - RNA, 19 nt, Artificial Sequence
  RNA Oligomer
cuugauccagagcauuccc

SEQ ID NO: 1257 - RNA, 19 nt, Artificial Sequence
  RNA Oligomer
cgucucugcauauuguuuc

SEQ ID NO: 1258 - RNA, 19 nt, Artificial Sequence
  RNA Oligomer
ucugcauauuguuucugga

SEQ ID NO: 1259 - RNA, 19 nt, Artificial Sequence
  RNA Oligomer
ucugaagccugaaugacca

SEQ ID NO: 1260 - RNA, 19 nt, Artificial Sequence
  RNA Oligomer
cuucaccagcaauucaggc

SEQ ID NO: 1261 - RNA, 19 nt, Artificial Sequence
  RNA Oligomer
ucaccagcaauucaggccu

SEQ ID NO: 1262 - RNA, 19 nt, Artificial Sequence
  RNA Oligomer
ugaaacugguagauuuucu

SEQ ID NO: 1263 - RNA, 19 nt, Artificial Sequence
  RNA Oligomer
aacacgcuuauccaugacu

SEQ ID NO: 1264 - RNA, 19 nt, Artificial Sequence
  RNA Oligomer
uuauccaugacugccacuu

SEQ ID NO: 1265 - RNA, 19 nt, Artificial Sequence
  RNA Oligomer
acuuuugacacagccagga

SEQ ID NO: 1266 - RNA, 19 nt, Artificial Sequence
  RNA Oligomer
uucugugaagugcugcuca

SEQ ID NO: 1267 - RNA, 19 nt, Artificial Sequence
  RNA Oligomer
ucuguucaauuuccuccac

SEQ ID NO: 1268 - RNA, 19 nt, Artificial Sequence
  RNA Oligomer
guuucccauugcuuagucu

SEQ ID NO: 1269 - RNA, 19 nt, Artificial Sequence
  RNA Oligomer
agcuuagcuuccugauucu

SEQ ID NO: 1270 - RNA, 19 nt, Artificial Sequence
  RNA Oligomer
agccuuuuaaguuucuccu

SEQ ID NO: 1271 - RNA, 19 nt, Artificial Sequence
  RNA Oligomer
uaaguuucuccugcucagc

SEQ ID NO: 1272 - RNA, 19 nt, Artificial Sequence
  RNA Oligomer
caaaaacuuuaagcgcugu

SEQ ID NO: 1273 - RNA, 19 nt, Artificial Sequence
  RNA Oligomer
aaaaacuuuaagcgcuguu

SEQ ID NO: 1274 - RNA, 19 nt, Artificial Sequence
  RNA Oligomer
aauauacaagugugcagug

SEQ ID NO: 1275 - RNA, 19 nt, Artificial Sequence
  RNA Oligomer
aagugugcagugccuucga

SEQ ID NO: 1276 - RNA, 19 nt, Artificial Sequence
  RNA Oligomer
gauccuauuuacuagacag

SEQ ID NO: 1277 - RNA, 19 nt, Artificial Sequence
  RNA Oligomer
uuucaucacgcuaaauguc

SEQ ID NO: 1278 - RNA, 19 nt, Artificial Sequence
  RNA Oligomer
caucacgcuaaauguccuc

SEQ ID NO: 1279 - RNA, 19 nt, Artificial Sequence
  RNA Oligomer
uaugcccaucuucuccuga

SEQ ID NO: 1280 - RNA, 19 nt, Artificial Sequence
  RNA Oligomer
uaaagaaauugggagcacu

SEQ ID NO: 1281 - RNA, 19 nt, Artificial Sequence
  RNA Oligomer
aggggguugaauuucaccc

SEQ ID NO: 1282 - RNA, 19 nt, Artificial Sequence
  RNA Oligomer
gaauaaauguucucugggu

SEQ ID NO: 1283 - RNA, 19 nt, Artificial Sequence
  RNA Oligomer
ggggguugaauuucacccu

SEQ ID NO: 1284 - RNA, 19 nt, Artificial Sequence
  RNA Oligomer
gggguugaauuucacccuc

SEQ ID NO: 1285 - RNA, 19 nt, Artificial Sequence
  RNA Oligomer
cgcaccugaagaaugugaa

SEQ ID NO: 1286 - RNA, 19 nt, Artificial Sequence
  RNA Oligomer
gcacuguuucuuucaccuc

SEQ ID NO: 1287 - RNA, 19 nt, Artificial Sequence
  RNA Oligomer
gucuucuacucgcaccuga

SEQ ID NO: 1288 - RNA, 19 nt, Artificial Sequence
  RNA Oligomer
gggaugacaucacagcuca

SEQ ID NO: 1289 - RNA, 19 nt, Artificial Sequence
  RNA Oligomer
uccucacagugacacacaa

SEQ ID NO: 1290 - RNA, 19 nt, Artificial Sequence
  RNA Oligomer
gcaccugaagaaugugaag

SEQ ID NO: 1291 - RNA, 19 nt, Artificial Sequence
  RNA Oligomer
gcuuugucuucuacucgca

SEQ ID NO: 1292 - RNA, 19 nt, Artificial Sequence
  RNA Oligomer
ugcacuguuucuuucaccu

SEQ ID NO: 1293 - RNA, 19 nt, Artificial Sequence
  RNA Oligomer
ccugugagcaacaaaacug

SEQ ID NO: 1294 - RNA, 19 nt, Artificial Sequence
  RNA Oligomer
gggaugaucuggaugagca

SEQ ID NO: 1295 - RNA, 19 nt, Artificial Sequence
  RNA Oligomer
accugaagaaugugaagga

SEQ ID NO: 1296 - RNA, 19 nt, Artificial Sequence
  RNA Oligomer
cuacucgcaccugaagaau

SEQ ID NO: 1297 - RNA, 19 nt, Artificial Sequence
  RNA Oligomer
cgagggcgaagaguucuuu

SEQ ID NO: 1298 - RNA, 19 nt, Artificial Sequence
  RNA Oligomer
ugcugcagguggaauucuu

SEQ ID NO: 1299 - RNA, 19 nt, Artificial Sequence
  RNA Oligomer
ccugaagaaugugaaggag

SEQ ID NO: 1300 - RNA, 19 nt, Artificial Sequence
  RNA Oligomer
agaaucugcuuugucuucu

SEQ ID NO: 1301 - RNA, 19 nt, Artificial Sequence
  RNA Oligomer
agaguucuuugcggccuuc

SEQ ID NO: 1302 - RNA, 19 nt, Artificial Sequence
  RNA Oligomer
ggaugacaucacagcucag

SEQ ID NO: 1303 - RNA, 19 nt, Artificial Sequence
  RNA Oligomer
accucagauuuggacagcu

SEQ ID NO: 1304 - RNA, 19 nt, Artificial Sequence
  RNA Oligomer
agauccgucacaugcucuu

SEQ ID NO: 1305 - RNA, 19 nt, Artificial Sequence
  RNA Oligomer
ugaagaaugugaaggaggu

SEQ ID NO: 1306 - RNA, 19 nt, Artificial Sequence
  RNA Oligomer
aagaguucuuugcggccuu

SEQ ID NO: 1307 - RNA, 19 nt, Artificial Sequence
  RNA Oligomer
gaagaguucuuugcggccu

SEQ ID NO: 1308 - RNA, 19 nt, Artificial Sequence
  RNA Oligomer
ugcaccgugugaaccucau

SEQ ID NO: 1309 - RNA, 19 nt, Artificial Sequence
  RNA Oligomer
caccugggaugacaucaca

SEQ ID NO: 1310 - RNA, 19 nt, Artificial Sequence
  RNA Oligomer
uccgucacaugcucuucuc

SEQ ID NO: 1311 - RNA, 19 nt, Artificial Sequence
  RNA Oligomer
cucagauuuggacagcuuu

SEQ ID NO: 1312 - RNA, 19 nt, Artificial Sequence
  RNA Oligomer
acuguguggagggcagaau

SEQ ID NO: 1313 - RNA, 19 nt, Artificial Sequence
  RNA Oligomer
uggaauucuugcgucugag

SEQ ID NO: 1314 - RNA, 19 nt, Artificial Sequence
  RNA Oligomer
ucgagggcgaagaguucuu

SEQ ID NO: 1315 - RNA, 19 nt, Artificial Sequence
  RNA Oligomer
cacuucuccugguuccuug

SEQ ID NO: 1316 - RNA, 19 nt, Artificial Sequence
  RNA Oligomer
gucacaugcucuucuccug

SEQ ID NO: 1317 - RNA, 19 nt, Artificial Sequence
  RNA Oligomer
acacgguggagauguucga

SEQ ID NO: 1318 - RNA, 19 nt, Artificial Sequence
  RNA Oligomer
cuguuccugaccucagauu

SEQ ID NO: 1319 - RNA, 19 nt, Artificial Sequence
  RNA Oligomer
cgcucuugcugucucacaa

SEQ ID NO: 1320 - RNA, 19 nt, Artificial Sequence
  RNA Oligomer
accuggaccugagcuucaa

SEQ ID NO: 1321 - RNA, 19 nt, Artificial Sequence
  RNA Oligomer
ggagggcagaaucugcuuu

SEQ ID NO: 1322 - RNA, 19 nt, Artificial Sequence
  RNA Oligomer
acccuugaaucugggagau

SEQ ID NO: 1323 - RNA, 19 nt, Artificial Sequence
  RNA Oligomer
cacccuugaaucugggaga

SEQ ID NO: 1324 - RNA, 19 nt, Artificial Sequence
  RNA Oligomer
gucccugugagcaacaaaa

SEQ ID NO: 1325 - RNA, 19 nt, Artificial Sequence
  RNA Oligomer
gggcagaaucugcuuuguc

SEQ ID NO: 1326 - RNA, 19 nt, Artificial Sequence
  RNA Oligomer
cuggaccugagcuucaaca

SEQ ID NO: 1327 - RNA, 19 nt, Artificial Sequence
  RNA Oligomer
gcuuucugacgcagagcaa

SEQ ID NO: 1328 - RNA, 19 nt, Artificial Sequence
  RNA Oligomer
ccucgaucucucucagaau

SEQ ID NO: 1329 - RNA, 19 nt, Artificial Sequence
  RNA Oligomer
cucuugcugucucacaacu

SEQ ID NO: 1330 - RNA, 19 nt, Artificial Sequence
  RNA Oligomer
agagcaaccugcugagugu

SEQ ID NO: 1331 - RNA, 19 nt, Artificial Sequence
  RNA Oligomer
gcagaaucugcuuugucuu

SEQ ID NO: 1332 - RNA, 19 nt, Artificial Sequence
  RNA Oligomer
ggcagaaucugcuuugucu

SEQ ID NO: 1333 - RNA, 19 nt, Artificial Sequence
  RNA Oligomer
agggcagaaucugcuuugu

SEQ ID NO: 1334 - RNA, 19 nt, Artificial Sequence
  RNA Oligomer
cucugguacaccaccaaga

SEQ ID NO: 1335 - RNA, 19 nt, Artificial Sequence
  RNA Oligomer
ccugguuccuugugguuuc

SEQ ID NO: 1336 - RNA, 19 nt, Artificial Sequence
  RNA Oligomer
ggucccugugagcaacaaa

SEQ ID NO: 1337 - RNA, 19 nt, Artificial Sequence
  RNA Oligomer
ugagcuucaacagccugga

SEQ ID NO: 1338 - RNA, 19 nt, Artificial Sequence
  RNA Oligomer
cuccuuggcacccuugaau

SEQ ID NO: 1339 - RNA, 19 nt, Artificial Sequence
  RNA Oligomer
ucgcaccugaagaauguga

SEQ ID NO: 1340 - RNA, 19 nt, Artificial Sequence
  RNA Oligomer
gagggcagaaucugcuuug

SEQ ID NO: 1341 - RNA, 19 nt, Artificial Sequence
  RNA Oligomer
agguggaauucuugcgucu

SEQ ID NO: 1342 - RNA, 19 nt, Artificial Sequence
  RNA Oligomer
cagguggaauucuugcguc

SEQ ID NO: 1343 - RNA, 19 nt, Artificial Sequence
  RNA Oligomer
gacuguuccugaccucaga

SEQ ID NO: 1344 - RNA, 19 nt, Artificial Sequence
  RNA Oligomer
agcccucauuccagaaaug

SEQ ID NO: 1345 - RNA, 19 nt, Artificial Sequence
  RNA Oligomer
cccugugagcaacaaaacu

SEQ ID NO: 1346 - RNA, 19 nt, Artificial Sequence
  RNA Oligomer
gcagguggaauucuugcgu

SEQ ID NO: 1347 - RNA, 19 nt, Artificial Sequence
  RNA Oligomer
ugaccucagauuuggacag

SEQ ID NO: 1348 - RNA, 19 nt, Artificial Sequence
  RNA Oligomer
ccugaccucagauuuggac

SEQ ID NO: 1349 - RNA, 19 nt, Artificial Sequence
  RNA Oligomer
agauguucgagggcgaaga

SEQ ID NO: 1350 - RNA, 19 nt, Artificial Sequence
  RNA Oligomer
cuccugguuccuugugguu

SEQ ID NO: 1351 - RNA, 19 nt, Artificial Sequence
  RNA Oligomer
cagcccucauuccagaaau

SEQ ID NO: 1352 - RNA, 19 nt, Artificial Sequence
  RNA Oligomer
gcuaccuccugagauugga

SEQ ID NO: 1353 - RNA, 19 nt, Artificial Sequence
  RNA Oligomer
acacgcuaccuccugagau

SEQ ID NO: 1354 - RNA, 19 nt, Artificial Sequence
  RNA Oligomer
cucagaaucugcuggacac

SEQ ID NO: 1355 - RNA, 19 nt, Artificial Sequence
  RNA Oligomer
ugguacaccaccaagaacu

SEQ ID NO: 1356 - RNA, 19 nt, Artificial Sequence
  RNA Oligomer
agcugcugcagguggaauu

SEQ ID NO: 1357 - RNA, 19 nt, Artificial Sequence
  RNA Oligomer
ugaucuggaugagcagauc

SEQ ID NO: 1358 - RNA, 19 nt, Artificial Sequence
  RNA Oligomer
ugaaccucaucgcucugca

SEQ ID NO: 1359 - RNA, 19 nt, Artificial Sequence
  RNA Oligomer
ugacaucacagcucaggug

SEQ ID NO: 1360 - RNA, 19 nt, Artificial Sequence
  RNA Oligomer
gggucaaagucaucuuccc

SEQ ID NO: 1361 - RNA, 19 nt, Artificial Sequence
  RNA Oligomer
ggaugaucuggaugagcag

SEQ ID NO: 1362 - RNA, 19 nt, Artificial Sequence
  RNA Oligomer
uggacagcuuuccugugac

SEQ ID NO: 1363 - RNA, 19 nt, Artificial Sequence
  RNA Oligomer
accugagcuucaacagccu

SEQ ID NO: 1364 - RNA, 19 nt, Artificial Sequence
  RNA Oligomer
augaucuggaugagcagau

SEQ ID NO: 1365 - RNA, 19 nt, Artificial Sequence
  RNA Oligomer
gugugaaccucaucgcucu

SEQ ID NO: 1366 - RNA, 19 nt, Artificial Sequence
  RNA Oligomer
agaaucugcuggacacgcu

SEQ ID NO: 1367 - RNA, 19 nt, Artificial Sequence
  RNA Oligomer
cucucagaaucugcuggac

SEQ ID NO: 1368 - RNA, 19 nt, Artificial Sequence
  RNA Oligomer
cgaucucucucagaaucug

SEQ ID NO: 1369 - RNA, 19 nt, Artificial Sequence
  RNA Oligomer
cccuugaaucugggagaug

SEQ ID NO: 1370 - RNA, 19 nt, Artificial Sequence
  RNA Oligomer
acaacugccucucugagcu

SEQ ID NO: 1371 - RNA, 19 nt, Artificial Sequence
  RNA Oligomer
ugggaugacaucacagcuc

SEQ ID NO: 1372 - RNA, 19 nt, Artificial Sequence
  RNA Oligomer
acaccaccaagaacugugu

SEQ ID NO: 1373 - RNA, 19 nt, Artificial Sequence
  RNA Oligomer
uccgggaugaucuggauga

SEQ ID NO: 1374 - RNA, 19 nt, Artificial Sequence
  RNA Oligomer
uucacauucuucaggugcg

SEQ ID NO: 1375 - RNA, 19 nt, Artificial Sequence
  RNA Oligomer
gaggugaaagaaacagugc

SEQ ID NO: 1376 - RNA, 19 nt, Artificial Sequence
  RNA Oligomer
ucaggugcgaguagaagac

SEQ ID NO: 1377 - RNA, 19 nt, Artificial Sequence
  RNA Oligomer
ugagcugugaugucauccc

SEQ ID NO: 1378 - RNA, 19 nt, Artificial Sequence
  RNA Oligomer
uugugugucacugugagga

SEQ ID NO: 1379 - RNA, 19 nt, Artificial Sequence
  RNA Oligomer
cuucacauucuucaggugc

SEQ ID NO: 1380 - RNA, 19 nt, Artificial Sequence
  RNA Oligomer
ugcgaguagaagacaaagc

SEQ ID NO: 1381 - RNA, 19 nt, Artificial Sequence
  RNA Oligomer
aggugaaagaaacagugca

SEQ ID NO: 1382 - RNA, 19 nt, Artificial Sequence
  RNA Oligomer
caguuuuguugcucacagg

SEQ ID NO: 1383 - RNA, 19 nt, Artificial Sequence
  RNA Oligomer
ugcucauccagaucauccc

SEQ ID NO: 1384 - RNA, 19 nt, Artificial Sequence
  RNA Oligomer
uccuucacauucuucaggu

SEQ ID NO: 1385 - RNA, 19 nt, Artificial Sequence
  RNA Oligomer
auucuucaggugcgaguag

SEQ ID NO: 1386 - RNA, 19 nt, Artificial Sequence
  RNA Oligomer
aaagaacucuucgcccucg

SEQ ID NO: 1387 - RNA, 19 nt, Artificial Sequence
  RNA Oligomer
aagaauuccaccugcagca

SEQ ID NO: 1388 - RNA, 19 nt, Artificial Sequence
  RNA Oligomer
cuccuucacauucuucagg

SEQ ID NO: 1389 - RNA, 19 nt, Artificial Sequence
  RNA Oligomer
agaagacaaagcagauucu

SEQ ID NO: 1390 - RNA, 19 nt, Artificial Sequence
  RNA Oligomer
gaaggccgcaaagaacucu

SEQ ID NO: 1391 - RNA, 19 nt, Artificial Sequence
  RNA Oligomer
cugagcugugaugucaucc

SEQ ID NO: 1392 - RNA, 19 nt, Artificial Sequence
  RNA Oligomer
agcuguccaaaucugaggu

SEQ ID NO: 1393 - RNA, 19 nt, Artificial Sequence
  RNA Oligomer
aagagcaugugacggaucu

SEQ ID NO: 1394 - RNA, 19 nt, Artificial Sequence
  RNA Oligomer
accuccuucacauucuuca

SEQ ID NO: 1395 - RNA, 19 nt, Artificial Sequence
  RNA Oligomer
aaggccgcaaagaacucuu

SEQ ID NO: 1396 - RNA, 19 nt, Artificial Sequence
  RNA Oligomer
aggccgcaaagaacucuuc

SEQ ID NO: 1397 - RNA, 19 nt, Artificial Sequence
  RNA Oligomer
augagguucacacggugca

SEQ ID NO: 1398 - RNA, 19 nt, Artificial Sequence
  RNA Oligomer
ugugaugucaucccaggug

SEQ ID NO: 1399 - RNA, 19 nt, Artificial Sequence
  RNA Oligomer
gagaagagcaugugacgga

SEQ ID NO: 1400 - RNA, 19 nt, Artificial Sequence
  RNA Oligomer
aaagcuguccaaaucugag

SEQ ID NO: 1401 - RNA, 19 nt, Artificial Sequence
  RNA Oligomer
auucugcccuccacacagu

SEQ ID NO: 1402 - RNA, 19 nt, Artificial Sequence
  RNA Oligomer
cucagacgcaagaauucca

SEQ ID NO: 1403 - RNA, 19 nt, Artificial Sequence
  RNA Oligomer
aagaacucuucgcccucga

SEQ ID NO: 1404 - RNA, 19 nt, Artificial Sequence
  RNA Oligomer
caaggaaccaggagaagug

SEQ ID NO: 1405 - RNA, 19 nt, Artificial Sequence
  RNA Oligomer
caggagaagagcaugugac

SEQ ID NO: 1406 - RNA, 19 nt, Artificial Sequence
  RNA Oligomer
ucgaacaucuccaccgugu

SEQ ID NO: 1407 - RNA, 19 nt, Artificial Sequence
  RNA Oligomer
aaucugaggucaggaacag

SEQ ID NO: 1408 - RNA, 19 nt, Artificial Sequence
  RNA Oligomer
uugugagacagcaagagcg

SEQ ID NO: 1409 - RNA, 19 nt, Artificial Sequence
  RNA Oligomer
uugaagcucagguccaggu

SEQ ID NO: 1410 - RNA, 19 nt, Artificial Sequence
  RNA Oligomer
aaagcagauucugcccucc

SEQ ID NO: 1411 - RNA, 19 nt, Artificial Sequence
  RNA Oligomer
aucucccagauucaagggu

SEQ ID NO: 1412 - RNA, 19 nt, Artificial Sequence
  RNA Oligomer
ucucccagauucaagggug

SEQ ID NO: 1413 - RNA, 19 nt, Artificial Sequence
  RNA Oligomer
uuuuguugcucacagggac

SEQ ID NO: 1414 - RNA, 19 nt, Artificial Sequence
  RNA Oligomer
gacaaagcagauucugccc

SEQ ID NO: 1415 - RNA, 19 nt, Artificial Sequence
  RNA Oligomer
uguugaagcucagguccag

SEQ ID NO: 1416 - RNA, 19 nt, Artificial Sequence
  RNA Oligomer
uugcucugcgucagaaagc

SEQ ID NO: 1417 - RNA, 19 nt, Artificial Sequence
  RNA Oligomer
auucugagagagaucgagg

SEQ ID NO: 1418 - RNA, 19 nt, Artificial Sequence
  RNA Oligomer
aguugugagacagcaagag

SEQ ID NO: 1419 - RNA, 19 nt, Artificial Sequence
  RNA Oligomer
acacucagcagguugcucu

SEQ ID NO: 1420 - RNA, 19 nt, Artificial Sequence
  RNA Oligomer
aagacaaagcagauucugc

SEQ ID NO: 1421 - RNA, 19 nt, Artificial Sequence
  RNA Oligomer
agacaaagcagauucugcc

SEQ ID NO: 1422 - RNA, 19 nt, Artificial Sequence
  RNA Oligomer
acaaagcagauucugcccu

SEQ ID NO: 1423 - RNA, 19 nt, Artificial Sequence
  RNA Oligomer
ucuuggugguguaccagag

SEQ ID NO: 1424 - RNA, 19 nt, Artificial Sequence
  RNA Oligomer
gaaaccacaaggaaccagg

SEQ ID NO: 1425 - RNA, 19 nt, Artificial Sequence
  RNA Oligomer
uuuguugcucacagggacc

SEQ ID NO: 1426 - RNA, 19 nt, Artificial Sequence
  RNA Oligomer
uccaggcuguugaagcuca

SEQ ID NO: 1427 - RNA, 19 nt, Artificial Sequence
  RNA Oligomer
auucaagggugccaaggag

SEQ ID NO: 1428 - RNA, 19 nt, Artificial Sequence
  RNA Oligomer
ucacauucuucaggugcga

SEQ ID NO: 1429 - RNA, 19 nt, Artificial Sequence
  RNA Oligomer
caaagcagauucugcccuc

SEQ ID NO: 1430 - RNA, 19 nt, Artificial Sequence
  RNA Oligomer
agacgcaagaauuccaccu

SEQ ID NO: 1431 - RNA, 19 nt, Artificial Sequence
  RNA Oligomer
gacgcaagaauuccaccug

SEQ ID NO: 1432 - RNA, 19 nt, Artificial Sequence
  RNA Oligomer
ucugaggucaggaacaguc

SEQ ID NO: 1433 - RNA, 19 nt, Artificial Sequence
  RNA Oligomer
cauuucuggaaugagggcu

SEQ ID NO: 1434 - RNA, 19 nt, Artificial Sequence
  RNA Oligomer
aguuuuguugcucacaggg

SEQ ID NO: 1435 - RNA, 19 nt, Artificial Sequence
  RNA Oligomer
acgcaagaauuccaccugc

SEQ ID NO: 1436 - RNA, 19 nt, Artificial Sequence
  RNA Oligomer
cuguccaaaucugagguca

SEQ ID NO: 1437 - RNA, 19 nt, Artificial Sequence
  RNA Oligomer
guccaaaucugaggucagg

SEQ ID NO: 1438 - RNA, 19 nt, Artificial Sequence
  RNA Oligomer
ucuucgcccucgaacaucu

SEQ ID NO: 1439 - RNA, 19 nt, Artificial Sequence
  RNA Oligomer
aaccacaaggaaccaggag

SEQ ID NO: 1440 - RNA, 19 nt, Artificial Sequence
  RNA Oligomer
auuucuggaaugagggcug

SEQ ID NO: 1441 - RNA, 19 nt, Artificial Sequence
  RNA Oligomer
uccaaucucaggagguagc

SEQ ID NO: 1442 - RNA, 19 nt, Artificial Sequence
  RNA Oligomer
aucucaggagguagcgugu

SEQ ID NO: 1443 - RNA, 19 nt, Artificial Sequence
  RNA Oligomer
guguccagcagauucugag

SEQ ID NO: 1444 - RNA, 19 nt, Artificial Sequence
  RNA Oligomer
aguucuuggugguguacca

SEQ ID NO: 1445 - RNA, 19 nt, Artificial Sequence
  RNA Oligomer
aauuccaccugcagcagcu

SEQ ID NO: 1446 - RNA, 19 nt, Artificial Sequence
  RNA Oligomer
gaucugcucauccagauca

SEQ ID NO: 1447 - RNA, 19 nt, Artificial Sequence
  RNA Oligomer
ugcagagcgaugagguuca

SEQ ID NO: 1448 - RNA, 19 nt, Artificial Sequence
  RNA Oligomer
caccugagcugugauguca

SEQ ID NO: 1449 - RNA, 19 nt, Artificial Sequence
  RNA Oligomer
gggaagaugacuuugaccc

SEQ ID NO: 1450 - RNA, 19 nt, Artificial Sequence
  RNA Oligomer
cugcucauccagaucaucc

SEQ ID NO: 1451 - RNA, 19 nt, Artificial Sequence
  RNA Oligomer
gucacaggaaagcugucca

SEQ ID NO: 1452 - RNA, 19 nt, Artificial Sequence
  RNA Oligomer
aggcuguugaagcucaggu

SEQ ID NO: 1453 - RNA, 19 nt, Artificial Sequence
  RNA Oligomer
aucugcucauccagaucau

SEQ ID NO: 1454 - RNA, 19 nt, Artificial Sequence
  RNA Oligomer
agagcgaugagguucacac

SEQ ID NO: 1455 - RNA, 19 nt, Artificial Sequence
  RNA Oligomer
agcguguccagcagauucu

SEQ ID NO: 1456 - RNA, 19 nt, Artificial Sequence
  RNA Oligomer
guccagcagauucugagag

SEQ ID NO: 1457 - RNA, 19 nt, Artificial Sequence
  RNA Oligomer
cagauucugagagagaucg

SEQ ID NO: 1458 - RNA, 19 nt, Artificial Sequence
  RNA Oligomer
caucucccagauucaaggg

SEQ ID NO: 1459 - RNA, 19 nt, Artificial Sequence
  RNA Oligomer
agcucagagaggcaguugu

SEQ ID NO: 1460 - RNA, 19 nt, Artificial Sequence
  RNA Oligomer
gagcugugaugucauccca

SEQ ID NO: 1461 - RNA, 19 nt, Artificial Sequence
  RNA Oligomer
acacaguucuugguggugu

SEQ ID NO: 1462 - RNA, 19 nt, Artificial Sequence
  RNA Oligomer
ucauccagaucaucccgga

SEQ ID NO: 1463 - RNA, 19 nt, Artificial Sequence
  RNA Oligomer
ccaggaauuacuauguucg

SEQ ID NO: 1464 - RNA, 19 nt, Artificial Sequence
  RNA Oligomer
accaggaauuacuauguuc

SEQ ID NO: 1465 - RNA, 19 nt, Artificial Sequence
  RNA Oligomer
ggaauuacuauguucgggc

SEQ ID NO: 1466 - RNA, 19 nt, Artificial Sequence
  RNA Oligomer
gggcccuuuaccaggaauu

SEQ ID NO: 1467 - RNA, 19 nt, Artificial Sequence
  RNA Oligomer
agaaguacaugaccgccgu

SEQ ID NO: 1468 - RNA, 19 nt, Artificial Sequence
  RNA Oligomer
ggcccuuuaccaggaauua

SEQ ID NO: 1469 - RNA, 19 nt, Artificial Sequence
  RNA Oligomer
cccuuuaccaggaauuacu

SEQ ID NO: 1470 - RNA, 19 nt, Artificial Sequence
  RNA Oligomer
gcuucacccagugguacuu

SEQ ID NO: 1471 - RNA, 19 nt, Artificial Sequence
  RNA Oligomer
ccuuuaccaggaauuacua

SEQ ID NO: 1472 - RNA, 19 nt, Artificial Sequence
  RNA Oligomer
gcccuuuaccaggaauuac

SEQ ID NO: 1473 - RNA, 19 nt, Artificial Sequence
  RNA Oligomer
gugguacuuuggugccuac

SEQ ID NO: 1474 - RNA, 19 nt, Artificial Sequence
  RNA Oligomer
agugguacuuuggugccua

SEQ ID NO: 1475 - RNA, 19 nt, Artificial Sequence
  RNA Oligomer
ggacagaaguacaugaccg

SEQ ID NO: 1476 - RNA, 19 nt, Artificial Sequence
  RNA Oligomer
acccagugguacuuuggug

SEQ ID NO: 1477 - RNA, 19 nt, Artificial Sequence
  RNA Oligomer
agaucggaggcaccaucaa

SEQ ID NO: 1478 - RNA, 19 nt, Artificial Sequence
  RNA Oligomer
ugcacccaccugcaauaaa

SEQ ID NO: 1479 - RNA, 19 nt, Artificial Sequence
  RNA Oligomer
gugcacccaccugcaauaa

SEQ ID NO: 1480 - RNA, 19 nt, Artificial Sequence
  RNA Oligomer
cagugguacuuuggugccu

SEQ ID NO: 1481 - RNA, 19 nt, Artificial Sequence
  RNA Oligomer
uggggacagaaguacauga

SEQ ID NO: 1482 - RNA, 19 nt, Artificial Sequence
  RNA Oligomer
cgaacauaguaauuccugg

SEQ ID NO: 1483 - RNA, 19 nt, Artificial Sequence
  RNA Oligomer
gaacauaguaauuccuggu

SEQ ID NO: 1484 - RNA, 19 nt, Artificial Sequence
  RNA Oligomer
gcccgaacauaguaauucc

SEQ ID NO: 1485 - RNA, 19 nt, Artificial Sequence
  RNA Oligomer
aauuccugguaaagggccc

SEQ ID NO: 1486 - RNA, 19 nt, Artificial Sequence
  RNA Oligomer
acggcggucauguacuucu

SEQ ID NO: 1487 - RNA, 19 nt, Artificial Sequence
  RNA Oligomer
uaauuccugguaaagggcc

SEQ ID NO: 1488 - RNA, 19 nt, Artificial Sequence
  RNA Oligomer
aguaauuccugguaaaggg

SEQ ID NO: 1489 - RNA, 19 nt, Artificial Sequence
  RNA Oligomer
aaguaccacugggugaagc

SEQ ID NO: 1490 - RNA, 19 nt, Artificial Sequence
  RNA Oligomer
uaguaauuccugguaaagg

SEQ ID NO: 1491 - RNA, 19 nt, Artificial Sequence
  RNA Oligomer
guaauuccugguaaagggc

SEQ ID NO: 1492 - RNA, 19 nt, Artificial Sequence
  RNA Oligomer
guaggcaccaaaguaccac

SEQ ID NO: 1493 - RNA, 19 nt, Artificial Sequence
  RNA Oligomer
uaggcaccaaaguaccacu

SEQ ID NO: 1494 - RNA, 19 nt, Artificial Sequence
  RNA Oligomer
cggucauguacuucugucc

SEQ ID NO: 1495 - RNA, 19 nt, Artificial Sequence
  RNA Oligomer
caccaaaguaccacugggu

SEQ ID NO: 1496 - RNA, 19 nt, Artificial Sequence
  RNA Oligomer
uugauggugccuccgaucu

SEQ ID NO: 1497 - RNA, 19 nt, Artificial Sequence
  RNA Oligomer
uuuauugcaggugggugca

SEQ ID NO: 1498 - RNA, 19 nt, Artificial Sequence
  RNA Oligomer
uuauugcaggugggugcac

SEQ ID NO: 1499 - RNA, 19 nt, Artificial Sequence
  RNA Oligomer
aggcaccaaaguaccacug

SEQ ID NO: 1500 - RNA, 19 nt, Artificial Sequence
  RNA Oligomer
ucauguacuucugucccca

SEQ ID NO: 1501 - RNA, 19 nt, Artificial Sequence
  RNA Oligomer
ggcgacgagaaagaaauaa

SEQ ID NO: 1502 - RNA, 19 nt, Artificial Sequence
  RNA Oligomer
ccucauuuuauacccaaaa

SEQ ID NO: 1503 - RNA, 19 nt, Artificial Sequence
  RNA Oligomer
gaagaagaugaaaggaaaa

SEQ ID NO: 1504 - RNA, 19 nt, Artificial Sequence
  RNA Oligomer
cugaagaagaugaaaggaa

SEQ ID NO: 1505 - RNA, 19 nt, Artificial Sequence
  RNA Oligomer
uccucauuuuauacccaaa

SEQ ID NO: 1506 - RNA, 19 nt, Artificial Sequence
  RNA Oligomer
gcgacgagaaagaaauaag

SEQ ID NO: 1507 - RNA, 19 nt, Artificial Sequence
  RNA Oligomer
gaagaugaaaggaaaaaga

SEQ ID NO: 1508 - RNA, 19 nt, Artificial Sequence
  RNA Oligomer
cucauugaauccucauuuu

SEQ ID NO: 1509 - RNA, 19 nt, Artificial Sequence
  RNA Oligomer
agaagaugaaaggaaaaag

SEQ ID NO: 1510 - RNA, 19 nt, Artificial Sequence
  RNA Oligomer
gcauuguuuuugucaugua

SEQ ID NO: 1511 - RNA, 19 nt, Artificial Sequence
  RNA Oligomer
auccucauuuuauacccaa

SEQ ID NO: 1512 - RNA, 19 nt, Artificial Sequence
  RNA Oligomer
gccgaaacaagaagaagga

SEQ ID NO: 1513 - RNA, 19 nt, Artificial Sequence
  RNA Oligomer
gacgagaaagaaauaagau

SEQ ID NO: 1514 - RNA, 19 nt, Artificial Sequence
  RNA Oligomer
gaggcgacgagaaagaaau

SEQ ID NO: 1515 - RNA, 19 nt, Artificial Sequence
  RNA Oligomer
cgaaacaagaagaaggaga

SEQ ID NO: 1516 - RNA, 19 nt, Artificial Sequence
  RNA Oligomer
aggcgacgagaaagaaaua

SEQ ID NO: 1517 - RNA, 19 nt, Artificial Sequence
  RNA Oligomer
ggaugucaauagcauuguu

SEQ ID NO: 1518 - RNA, 19 nt, Artificial Sequence
  RNA Oligomer
gcaagaggaggacagaauu

SEQ ID NO: 1519 - RNA, 19 nt, Artificial Sequence
  RNA Oligomer
ccagaaauugugugugcaa

SEQ ID NO: 1520 - RNA, 19 nt, Artificial Sequence
  RNA Oligomer
ucaucuggauucuacaaaa

SEQ ID NO: 1521 - RNA, 19 nt, Artificial Sequence
  RNA Oligomer
cacuggccauucuuauguu

SEQ ID NO: 1522 - RNA, 19 nt, Artificial Sequence
  RNA Oligomer
cccaaaacccugaagccau

SEQ ID NO: 1523 - RNA, 19 nt, Artificial Sequence
  RNA Oligomer
gccaaagaauauuccauuu

SEQ ID NO: 1524 - RNA, 19 nt, Artificial Sequence
  RNA Oligomer
uccucauugaauccucauu

SEQ ID NO: 1525 - RNA, 19 nt, Artificial Sequence
  RNA Oligomer
gaaaaagaggcgacgagaa

SEQ ID NO: 1526 - RNA, 19 nt, Artificial Sequence
  RNA Oligomer
ggaaaaagaggcgacgaga

SEQ ID NO: 1527 - RNA, 19 nt, Artificial Sequence
  RNA Oligomer
aggaaaaagaggcgacgag

SEQ ID NO: 1528 - RNA, 19 nt, Artificial Sequence
  RNA Oligomer
acagaauucucccagcguu

SEQ ID NO: 1529 - RNA, 19 nt, Artificial Sequence
  RNA Oligomer
agcaagaggaggacagaau

SEQ ID NO: 1530 - RNA, 19 nt, Artificial Sequence
  RNA Oligomer
ggccauucuuauguuccag

SEQ ID NO: 1531 - RNA, 19 nt, Artificial Sequence
  RNA Oligomer
caacagauaaaagaaggaa

SEQ ID NO: 1532 - RNA, 19 nt, Artificial Sequence
  RNA Oligomer
ccaacagauaaaagaagga

SEQ ID NO: 1533 - RNA, 19 nt, Artificial Sequence
  RNA Oligomer
agugccgaaacaagaagaa

SEQ ID NO: 1534 - RNA, 19 nt, Artificial Sequence
  RNA Oligomer
gaaagaaauaagauugcag

SEQ ID NO: 1535 - RNA, 19 nt, Artificial Sequence
  RNA Oligomer
agaggcgacgagaaagaaa

SEQ ID NO: 1536 - RNA, 19 nt, Artificial Sequence
  RNA Oligomer
gaaaggaaaaagaggcgac

SEQ ID NO: 1537 - RNA, 19 nt, Artificial Sequence
  RNA Oligomer
aagaaaacuaggcaaugua

SEQ ID NO: 1538 - RNA, 19 nt, Artificial Sequence
  RNA Oligomer
uuauacccaaaacccugaa

SEQ ID NO: 1539 - RNA, 19 nt, Artificial Sequence
  RNA Oligomer
ugauauacaugcucaaccu

SEQ ID NO: 1540 - RNA, 19 nt, Artificial Sequence
  RNA Oligomer
acaagaagaaggagaagac

SEQ ID NO: 1541 - RNA, 19 nt, Artificial Sequence
  RNA Oligomer
guagcuguuuuaagaaauc

SEQ ID NO: 1542 - RNA, 19 nt, Artificial Sequence
  RNA Oligomer
guggagagauguuuggaaa

SEQ ID NO: 1543 - RNA, 19 nt, Artificial Sequence
  RNA Oligomer
ccauuuuccuuuccuugug

SEQ ID NO: 1544 - RNA, 19 nt, Artificial Sequence
  RNA Oligomer
ugcaaacucaguuccaaag

SEQ ID NO: 1545 - RNA, 19 nt, Artificial Sequence
  RNA Oligomer
gcaagaaaacuaggcaaug

SEQ ID NO: 1546 - RNA, 19 nt, Artificial Sequence
  RNA Oligomer
caucuggauucuacaaaaa

SEQ ID NO: 1547 - RNA, 19 nt, Artificial Sequence
  RNA Oligomer
gccuuucaucuggauucua

SEQ ID NO: 1548 - RNA, 19 nt, Artificial Sequence
  RNA Oligomer
cgccuuucaucuggauucu

SEQ ID NO: 1549 - RNA, 19 nt, Artificial Sequence
  RNA Oligomer
ccuuaacacacuggccauu

SEQ ID NO: 1550 - RNA, 19 nt, Artificial Sequence
  RNA Oligomer
ggaacauugcagagcuaag

SEQ ID NO: 1551 - RNA, 19 nt, Artificial Sequence
  RNA Oligomer
acgagaagcagcauuugau

SEQ ID NO: 1552 - RNA, 19 nt, Artificial Sequence
  RNA Oligomer
agaaauaagauugcagcug

SEQ ID NO: 1553 - RNA, 19 nt, Artificial Sequence
  RNA Oligomer
caucacaaaagccgaggua

SEQ ID NO: 1554 - RNA, 19 nt, Artificial Sequence
  RNA Oligomer
ggcuacugucuauuaaaau

SEQ ID NO: 1555 - RNA, 19 nt, Artificial Sequence
  RNA Oligomer
ggaagagccaaagaauauu

SEQ ID NO: 1556 - RNA, 19 nt, Artificial Sequence
  RNA Oligomer
ugugugugcaagaaaacua

SEQ ID NO: 1557 - RNA, 19 nt, Artificial Sequence
  RNA Oligomer
cacugguguuugaggauuu

SEQ ID NO: 1558 - RNA, 19 nt, Artificial Sequence
  RNA Oligomer
uucaucuggauucuacaaa

SEQ ID NO: 1559 - RNA, 19 nt, Artificial Sequence
  RNA Oligomer
ccgccuuucaucuggauuc

SEQ ID NO: 1560 - RNA, 19 nt, Artificial Sequence
  RNA Oligomer
ccgaaacaagaagaaggag

SEQ ID NO: 1561 - RNA, 19 nt, Artificial Sequence
  RNA Oligomer
ggagagauguuuggaaacc

SEQ ID NO: 1562 - RNA, 19 nt, Artificial Sequence
  RNA Oligomer
agccaaagaauauuccauu

SEQ ID NO: 1563 - RNA, 19 nt, Artificial Sequence
  RNA Oligomer
ccaaagucacaggaagaaa

SEQ ID NO: 1564 - RNA, 19 nt, Artificial Sequence
  RNA Oligomer
guccucuguugcaaacuca

SEQ ID NO: 1565 - RNA, 19 nt, Artificial Sequence
  RNA Oligomer
gugugugcaagaaaacuag

SEQ ID NO: 1566 - RNA, 19 nt, Artificial Sequence
  RNA Oligomer
cagaaauugugugugcaag

SEQ ID NO: 1567 - RNA, 19 nt, Artificial Sequence
  RNA Oligomer
ccuuucaucuggauucuac

SEQ ID NO: 1568 - RNA, 19 nt, Artificial Sequence
  RNA Oligomer
acacacuggccauucuuau

SEQ ID NO: 1569 - RNA, 19 nt, Artificial Sequence
  RNA Oligomer
guccucauugaauccucau

SEQ ID NO: 1570 - RNA, 19 nt, Artificial Sequence
  RNA Oligomer
aggaacauugcagagcuaa

SEQ ID NO: 1571 - RNA, 19 nt, Artificial Sequence
  RNA Oligomer
agaagcuggaaagugugaa

SEQ ID NO: 1572 - RNA, 19 nt, Artificial Sequence
  RNA Oligomer
ccauccagaacaagcaccu

SEQ ID NO: 1573 - RNA, 19 nt, Artificial Sequence
  RNA Oligomer
gaugucaauagcauuguuu

SEQ ID NO: 1574 - RNA, 19 nt, Artificial Sequence
  RNA Oligomer
agucaguggagagauguuu

SEQ ID NO: 1575 - RNA, 19 nt, Artificial Sequence
  RNA Oligomer
cagucaguggagagauguu

SEQ ID NO: 1576 - RNA, 19 nt, Artificial Sequence
  RNA Oligomer
agaaagcagaaaguucaac

SEQ ID NO: 1577 - RNA, 19 nt, Artificial Sequence
  RNA Oligomer
caggaagaaagcagaaagu

SEQ ID NO: 1578 - RNA, 19 nt, Artificial Sequence
  RNA Oligomer
agaucugguuucuaagagu

SEQ ID NO: 1579 - RNA, 19 nt, Artificial Sequence
  RNA Oligomer
agaaauugugugugcaaga

SEQ ID NO: 1580 - RNA, 19 nt, Artificial Sequence
  RNA Oligomer
uccagaaauugugugugca

SEQ ID NO: 1581 - RNA, 19 nt, Artificial Sequence
  RNA Oligomer
acugguguuugaggauuuu

SEQ ID NO: 1582 - RNA, 19 nt, Artificial Sequence
  RNA Oligomer
uccagaagaugagagaaac

SEQ ID NO: 1583 - RNA, 19 nt, Artificial Sequence
  RNA Oligomer
agaaggagaagacggagug

SEQ ID NO: 1584 - RNA, 19 nt, Artificial Sequence
  RNA Oligomer
agaagaaggagaagacgga

SEQ ID NO: 1585 - RNA, 19 nt, Artificial Sequence
  RNA Oligomer
cugauguuucugugaaauu

SEQ ID NO: 1586 - RNA, 19 nt, Artificial Sequence
  RNA Oligomer
ucugauguuucugugaaau

SEQ ID NO: 1587 - RNA, 19 nt, Artificial Sequence
  RNA Oligomer
uucugauguuucugugaaa

SEQ ID NO: 1588 - RNA, 19 nt, Artificial Sequence
  RNA Oligomer
agcuguuuuaagaaaucug

SEQ ID NO: 1589 - RNA, 19 nt, Artificial Sequence
  RNA Oligomer
agcauuguuuuugucaugu

SEQ ID NO: 1590 - RNA, 19 nt, Artificial Sequence
  RNA Oligomer
caauagcauuguuuuuguc

SEQ ID NO: 1591 - RNA, 19 nt, Artificial Sequence
  RNA Oligomer
gagagauguuuggaaacca

SEQ ID NO: 1592 - RNA, 19 nt, Artificial Sequence
  RNA Oligomer
aguggagagauguuuggaa

SEQ ID NO: 1593 - RNA, 19 nt, Artificial Sequence
  RNA Oligomer
caggaguugugucuaggcu

SEQ ID NO: 1594 - RNA, 19 nt, Artificial Sequence
  RNA Oligomer
cagaucugguuucuaagag

SEQ ID NO: 1595 - RNA, 19 nt, Artificial Sequence
  RNA Oligomer
aacuaggcaauguacucuu

SEQ ID NO: 1596 - RNA, 19 nt, Artificial Sequence
  RNA Oligomer
guccagaaauugugugugc

SEQ ID NO: 1597 - RNA, 19 nt, Artificial Sequence
  RNA Oligomer
uggagugagaacagcauuu

SEQ ID NO: 1598 - RNA, 19 nt, Artificial Sequence
  RNA Oligomer
cuacaaaaaaccaggaugc

SEQ ID NO: 1599 - RNA, 19 nt, Artificial Sequence
  RNA Oligomer
uucuacaaaaaaccaggau

SEQ ID NO: 1600 - RNA, 19 nt, Artificial Sequence
  RNA Oligomer
ucuggauucuacaaaaaac

SEQ ID NO: 1601 - RNA, 19 nt, Artificial Sequence
  RNA Oligomer
cagaagaugagagaaaccu

SEQ ID NO: 1602 - RNA, 19 nt, Artificial Sequence
  RNA Oligomer
ccagaagaugagagaaacc

SEQ ID NO: 1603 - RNA, 19 nt, Artificial Sequence
  RNA Oligomer
caagaacgagaagcagcau

SEQ ID NO: 1604 - RNA, 19 nt, Artificial Sequence
  RNA Oligomer
ucaagaacgagaagcagca

SEQ ID NO: 1605 - RNA, 19 nt, Artificial Sequence
  RNA Oligomer
ucacucacacuggccacaa

SEQ ID NO: 1606 - RNA, 19 nt, Artificial Sequence
  RNA Oligomer
gucaauagcauuguuuuug

SEQ ID NO: 1607 - RNA, 19 nt, Artificial Sequence
  RNA Oligomer
uggaugucaauagcauugu

SEQ ID NO: 1608 - RNA, 19 nt, Artificial Sequence
  RNA Oligomer
gagccaaagaauauuccau

SEQ ID NO: 1609 - RNA, 19 nt, Artificial Sequence
  RNA Oligomer
aguugugucuaggcuggaa

SEQ ID NO: 1610 - RNA, 19 nt, Artificial Sequence
  RNA Oligomer
ccacucaaugucuuagguc

SEQ ID NO: 1611 - RNA, 19 nt, Artificial Sequence
  RNA Oligomer
aggaagaaagcagaaaguu

SEQ ID NO: 1612 - RNA, 19 nt, Artificial Sequence
  RNA Oligomer
acaggaagaaagcagaaag

SEQ ID NO: 1613 - RNA, 19 nt, Artificial Sequence
  RNA Oligomer
cacaggaagaaagcagaaa

SEQ ID NO: 1614 - RNA, 19 nt, Artificial Sequence
  RNA Oligomer
agaaaccucuuuauccaac

SEQ ID NO: 1615 - RNA, 19 nt, Artificial Sequence
  RNA Oligomer
ggagaagcuggaaagugug

SEQ ID NO: 1616 - RNA, 19 nt, Artificial Sequence
  RNA Oligomer
agguuugccauccagaaca

SEQ ID NO: 1617 - RNA, 19 nt, Artificial Sequence
  RNA Oligomer
ugauguuucugugaaauuc

SEQ ID NO: 1618 - RNA, 19 nt, Artificial Sequence
  RNA Oligomer
gcuguuuuaagaaaucugg

SEQ ID NO: 1619 - RNA, 19 nt, Artificial Sequence
  RNA Oligomer
uugucauguagcuguuuua

SEQ ID NO: 1620 - RNA, 19 nt, Artificial Sequence
  RNA Oligomer
cauuguuuuugucauguag

SEQ ID NO: 1621 - RNA, 19 nt, Artificial Sequence
  RNA Oligomer
uagcauuguuuuugucaug

SEQ ID NO: 1622 - RNA, 19 nt, Artificial Sequence
  RNA Oligomer
uguuugaggauuuugcuaa

SEQ ID NO: 1623 - RNA, 19 nt, Artificial Sequence
  RNA Oligomer
uccugggucacugguguuu

SEQ ID NO: 1624 - RNA, 19 nt, Artificial Sequence
  RNA Oligomer
gaagagccaaagaauauuc

SEQ ID NO: 1625 - RNA, 19 nt, Artificial Sequence
  RNA Oligomer
cacucaaugucuuagguca

SEQ ID NO: 1626 - RNA, 19 nt, Artificial Sequence
  RNA Oligomer
ccaaaggguuaggacucuc

SEQ ID NO: 1627 - RNA, 19 nt, Artificial Sequence
  RNA Oligomer
ucugguuucuaagaguuuu

SEQ ID NO: 1628 - RNA, 19 nt, Artificial Sequence
  RNA Oligomer
gaugugacuuuuauaugcu

SEQ ID NO: 1629 - RNA, 19 nt, Artificial Sequence
  RNA Oligomer
ugaugugacuuuuauaugc

SEQ ID NO: 1630 - RNA, 19 nt, Artificial Sequence
  RNA Oligomer
guguuugaggauuuugcua

SEQ ID NO: 1631 - RNA, 19 nt, Artificial Sequence
  RNA Oligomer
ggucacugguguuugagga

SEQ ID NO: 1632 - RNA, 19 nt, Artificial Sequence
  RNA Oligomer
ggaaccaagacaugguaaa

SEQ ID NO: 1633 - RNA, 19 nt, Artificial Sequence
  RNA Oligomer
uggaagagccaaagaauau

SEQ ID NO: 1634 - RNA, 19 nt, Artificial Sequence
  RNA Oligomer
caaugucuuaggucaggag

SEQ ID NO: 1635 - RNA, 19 nt, Artificial Sequence
  RNA Oligomer
ucaaugucuuaggucagga

SEQ ID NO: 1636 - RNA, 19 nt, Artificial Sequence
  RNA Oligomer
acucuccacucaaugucuu

SEQ ID NO: 1637 - RNA, 19 nt, Artificial Sequence
  RNA Oligomer
ucacaggaagaaagcagaa

SEQ ID NO: 1638 - RNA, 19 nt, Artificial Sequence
  RNA Oligomer
gucacugguguuugaggau

SEQ ID NO: 1639 - RNA, 19 nt, Artificial Sequence
  RNA Oligomer
ggauguggagugagaacag

SEQ ID NO: 1640 - RNA, 19 nt, Artificial Sequence
  RNA Oligomer
cucuccacucaaugucuua

SEQ ID NO: 1641 - RNA, 19 nt, Artificial Sequence
  RNA Oligomer
guggagugagaacagcauu

SEQ ID NO: 1642 - RNA, 19 nt, Artificial Sequence
  RNA Oligomer
gguugugcuuucuagcaaa

SEQ ID NO: 1643 - RNA, 19 nt, Artificial Sequence
  RNA Oligomer
uguggagugagaacagcau

SEQ ID NO: 1644 - RNA, 19 nt, Artificial Sequence
  RNA Oligomer
ccauucuuauguuccagau

SEQ ID NO: 1645 - RNA, 19 nt, Artificial Sequence
  RNA Oligomer
ugggaggacuccagaagau

SEQ ID NO: 1646 - RNA, 19 nt, Artificial Sequence
  RNA Oligomer
cucaaugguaucauuacaa

SEQ ID NO: 1647 - RNA, 19 nt, Artificial Sequence
  RNA Oligomer
agaagagcuugucagcaag

SEQ ID NO: 1648 - RNA, 19 nt, Artificial Sequence
  RNA Oligomer
ugugcuuucuagcaaauau

SEQ ID NO: 1649 - RNA, 19 nt, Artificial Sequence
  RNA Oligomer
ggguugugcuuucuagcaa

SEQ ID NO: 1650 - RNA, 19 nt, Artificial Sequence
  RNA Oligomer
ccaggauuuaggccuuaac

SEQ ID NO: 1651 - RNA, 19 nt, Artificial Sequence
  RNA Oligomer
cccagcguuaacacaaaau

SEQ ID NO: 1652 - RNA, 19 nt, Artificial Sequence
  RNA Oligomer
guugugcuuucuagcaaau

SEQ ID NO: 1653 - RNA, 19 nt, Artificial Sequence
  RNA Oligomer
cucauuuuauacccaaaac

SEQ ID NO: 1654 - RNA, 19 nt, Artificial Sequence
  RNA Oligomer
cccugaagaagaugaaagg

SEQ ID NO: 1655 - RNA, 19 nt, Artificial Sequence
  RNA Oligomer
ggguguccaucacaaaagc

SEQ ID NO: 1656 - RNA, 19 nt, Artificial Sequence
  RNA Oligomer
gagcuugucagcaagagga

SEQ ID NO: 1657 - RNA, 19 nt, Artificial Sequence
  RNA Oligomer
gccaggguugugcuuucua

SEQ ID NO: 1658 - RNA, 19 nt, Artificial Sequence
  RNA Oligomer
aggagcucaagaacgagaa

SEQ ID NO: 1659 - RNA, 19 nt, Artificial Sequence
  RNA Oligomer
ccuaaccugucagaauaau

SEQ ID NO: 1660 - RNA, 19 nt, Artificial Sequence
  RNA Oligomer
cucccagcguuaacacaaa

SEQ ID NO: 1661 - RNA, 19 nt, Artificial Sequence
  RNA Oligomer
cuccaggauuuaggccuua

SEQ ID NO: 1662 - RNA, 19 nt, Artificial Sequence
  RNA Oligomer
gugcaucuuugccucaacu

SEQ ID NO: 1663 - RNA, 19 nt, Artificial Sequence
  RNA Oligomer
cugaacugaaggcucagau

SEQ ID NO: 1664 - RNA, 19 nt, Artificial Sequence
  RNA Oligomer
cugcaaagugccgaaacaa

SEQ ID NO: 1665 - RNA, 19 nt, Artificial Sequence
  RNA Oligomer
gcaaacucaguuccaaagu

SEQ ID NO: 1666 - RNA, 19 nt, Artificial Sequence
  RNA Oligomer
cucuguugcaaacucaguu

SEQ ID NO: 1667 - RNA, 19 nt, Artificial Sequence
  RNA Oligomer
ccagcguuaacacaaaauc

SEQ ID NO: 1668 - RNA, 19 nt, Artificial Sequence
  RNA Oligomer
ucccagcguuaacacaaaa

SEQ ID NO: 1669 - RNA, 19 nt, Artificial Sequence
  RNA Oligomer
gccauucuuauguuccaga

SEQ ID NO: 1670 - RNA, 19 nt, Artificial Sequence
  RNA Oligomer
agaugagagaaaccucuuu

SEQ ID NO: 1671 - RNA, 19 nt, Artificial Sequence
  RNA Oligomer
agcagcauuugauauacau

SEQ ID NO: 1672 - RNA, 19 nt, Artificial Sequence
  RNA Oligomer
ggagcucaagaacgagaag

SEQ ID NO: 1673 - RNA, 19 nt, Artificial Sequence
  RNA Oligomer
ccaucacaaaagccgaggu

SEQ ID NO: 1674 - RNA, 19 nt, Artificial Sequence
  RNA Oligomer
cagaaaguucaacuuccaa

SEQ ID NO: 1675 - RNA, 19 nt, Artificial Sequence
  RNA Oligomer
caaacucaguuccaaaguc

SEQ ID NO: 1676 - RNA, 19 nt, Artificial Sequence
  RNA Oligomer
ggaggacagaauucuccca

SEQ ID NO: 1677 - RNA, 19 nt, Artificial Sequence
  RNA Oligomer
ccagaagagcuugucagca

SEQ ID NO: 1678 - RNA, 19 nt, Artificial Sequence
  RNA Oligomer
ugcaagaaaacuaggcaau

SEQ ID NO: 1679 - RNA, 19 nt, Artificial Sequence
  RNA Oligomer
cuccagaagaugagagaaa

SEQ ID NO: 1680 - RNA, 19 nt, Artificial Sequence
  RNA Oligomer
ugaacugaaggcucagauu

SEQ ID NO: 1681 - RNA, 19 nt, Artificial Sequence
  RNA Oligomer
uggaaucagucacugucag

SEQ ID NO: 1682 - RNA, 19 nt, Artificial Sequence
  RNA Oligomer
uggaaccaagacaugguaa

SEQ ID NO: 1683 - RNA, 19 nt, Artificial Sequence
  RNA Oligomer
cuaaccugucagaauaaua

SEQ ID NO: 1684 - RNA, 19 nt, Artificial Sequence
  RNA Oligomer
acucaaugguaucauuaca

SEQ ID NO: 1685 - RNA, 19 nt, Artificial Sequence
  RNA Oligomer
agaaaguucaacuuccaaa

SEQ ID NO: 1686 - RNA, 19 nt, Artificial Sequence
  RNA Oligomer
gcaguaucucaagauauuc

SEQ ID NO: 1687 - RNA, 19 nt, Artificial Sequence
  RNA Oligomer
gugcaagaaaacuaggcaa

SEQ ID NO: 1688 - RNA, 19 nt, Artificial Sequence
  RNA Oligomer
ugcuguuauguccagaaau

SEQ ID NO: 1689 - RNA, 19 nt, Artificial Sequence
  RNA Oligomer
augcuguuauguccagaaa

SEQ ID NO: 1690 - RNA, 19 nt, Artificial Sequence
  RNA Oligomer
gugcuuucuagcaaauaug

SEQ ID NO: 1691 - RNA, 19 nt, Artificial Sequence
  RNA Oligomer
uggccauucuuauguucca

SEQ ID NO: 1692 - RNA, 19 nt, Artificial Sequence
  RNA Oligomer
agugcaucuuugccucaac

SEQ ID NO: 1693 - RNA, 19 nt, Artificial Sequence
  RNA Oligomer
ucauuuuauacccaaaacc

SEQ ID NO: 1694 - RNA, 19 nt, Artificial Sequence
  RNA Oligomer
ggaguccucauugaauccu

SEQ ID NO: 1695 - RNA, 19 nt, Artificial Sequence
  RNA Oligomer
agcucaagaacgagaagca

SEQ ID NO: 1696 - RNA, 19 nt, Artificial Sequence
  RNA Oligomer
gcugaacugaaggcucaga

SEQ ID NO: 1697 - RNA, 19 nt, Artificial Sequence
  RNA Oligomer
uccuaaccugucagaauaa

SEQ ID NO: 1698 - RNA, 19 nt, Artificial Sequence
  RNA Oligomer
ccacagucaguggagagau

SEQ ID NO: 1699 - RNA, 19 nt, Artificial Sequence
  RNA Oligomer
cuuuccuugugguugaaaa

SEQ ID NO: 1700 - RNA, 19 nt, Artificial Sequence
  RNA Oligomer
caguaucucaagauauuca

SEQ ID NO: 1701 - RNA, 19 nt, Artificial Sequence
  RNA Oligomer
ucggaagugagugcuucug

SEQ ID NO: 1702 - RNA, 19 nt, Artificial Sequence
  RNA Oligomer
gccuuaacacacuggccau

SEQ ID NO: 1703 - RNA, 19 nt, Artificial Sequence
  RNA Oligomer
acuccaggauuuaggccuu

SEQ ID NO: 1704 - RNA, 19 nt, Artificial Sequence
  RNA Oligomer
accucuuuauccaacagau

SEQ ID NO: 1705 - RNA, 19 nt, Artificial Sequence
  RNA Oligomer
agcugugagaagucacuca

SEQ ID NO: 1706 - RNA, 19 nt, Artificial Sequence
  RNA Oligomer
gcagcugugagaagucacu

SEQ ID NO: 1707 - RNA, 19 nt, Artificial Sequence
  RNA Oligomer
agcugagguuugccaucca

SEQ ID NO: 1708 - RNA, 19 nt, Artificial Sequence
  RNA Oligomer
ggcuggaagagccaaagaa

SEQ ID NO: 1709 - RNA, 19 nt, Artificial Sequence
  RNA Oligomer
cuaggcuggaagagccaaa

SEQ ID NO: 1710 - RNA, 19 nt, Artificial Sequence
  RNA Oligomer
aaagcagaaaguucaacuu

SEQ ID NO: 1711 - RNA, 19 nt, Artificial Sequence
  RNA Oligomer
uccaggauuuaggccuuaa

SEQ ID NO: 1712 - RNA, 19 nt, Artificial Sequence
  RNA Oligomer
gcaagugcaucuuugccuc

SEQ ID NO: 1713 - RNA, 19 nt, Artificial Sequence
  RNA Oligomer
gaugagagaaaccucuuua

SEQ ID NO: 1714 - RNA, 19 nt, Artificial Sequence
  RNA Oligomer
ggacuccagaagaugagag

SEQ ID NO: 1715 - RNA, 19 nt, Artificial Sequence
  RNA Oligomer
guacucaaugguaucauua

SEQ ID NO: 1716 - RNA, 19 nt, Artificial Sequence
  RNA Oligomer
uguacucaaugguaucauu

SEQ ID NO: 1717 - RNA, 19 nt, Artificial Sequence
  RNA Oligomer
ggaaaccacagucagugga

SEQ ID NO: 1718 - RNA, 19 nt, Artificial Sequence
  RNA Oligomer
ugguugaaaaccacaguca

SEQ ID NO: 1719 - RNA, 19 nt, Artificial Sequence
  RNA Oligomer
gaaagcagaaaguucaacu

SEQ ID NO: 1720 - RNA, 19 nt, Artificial Sequence
  RNA Oligomer
gguccucuguugcaaacuc

SEQ ID NO: 1721 - RNA, 19 nt, Artificial Sequence
  RNA Oligomer
cacugaugugacuuuuaua

SEQ ID NO: 1722 - RNA, 19 nt, Artificial Sequence
  RNA Oligomer
ggauucuacaaaaaaccag

SEQ ID NO: 1723 - RNA, 19 nt, Artificial Sequence
  RNA Oligomer
gccucaacuccaggauuua

SEQ ID NO: 1724 - RNA, 19 nt, Artificial Sequence
  RNA Oligomer
ggcaagugcaucuuugccu

SEQ ID NO: 1725 - RNA, 19 nt, Artificial Sequence
  RNA Oligomer
accucuagaaucccagcag

SEQ ID NO: 1726 - RNA, 19 nt, Artificial Sequence
  RNA Oligomer
ccucuuuauccaacagaua

SEQ ID NO: 1727 - RNA, 19 nt, Artificial Sequence
  RNA Oligomer
augagagaaaccucuuuau

SEQ ID NO: 1728 - RNA, 19 nt, Artificial Sequence
  RNA Oligomer
cagcugcaaagugccgaaa

SEQ ID NO: 1729 - RNA, 19 nt, Artificial Sequence
  RNA Oligomer
uccuaguauuccuaaccug

SEQ ID NO: 1730 - RNA, 19 nt, Artificial Sequence
  RNA Oligomer
agagauguuuggaaaccac

SEQ ID NO: 1731 - RNA, 19 nt, Artificial Sequence
  RNA Oligomer
gaaaaccacagucagugga

SEQ ID NO: 1732 - RNA, 19 nt, Artificial Sequence
  RNA Oligomer
ccuuugucaaggaagagcu

SEQ ID NO: 1733 - RNA, 19 nt, Artificial Sequence
  RNA Oligomer
gcccuuugucaaggaagag

SEQ ID NO: 1734 - RNA, 19 nt, Artificial Sequence
  RNA Oligomer
ucaacuuccaaaggguuag

SEQ ID NO: 1735 - RNA, 19 nt, Artificial Sequence
  RNA Oligomer
gaaaguucaacuuccaaag

SEQ ID NO: 1736 - RNA, 19 nt, Artificial Sequence
  RNA Oligomer
uccaaagucacaggaagaa

SEQ ID NO: 1737 - RNA, 19 nt, Artificial Sequence
  RNA Oligomer
gaggacagaauucucccag

SEQ ID NO: 1738 - RNA, 19 nt, Artificial Sequence
  RNA Oligomer
ugaggauuuugcuaaccug

SEQ ID NO: 1739 - RNA, 19 nt, Artificial Sequence
  RNA Oligomer
ugcccaccguuaggauuca

SEQ ID NO: 1740 - RNA, 19 nt, Artificial Sequence
  RNA Oligomer
cccgccuuucaucuggauu

SEQ ID NO: 1741 - RNA, 19 nt, Artificial Sequence
  RNA Oligomer
gaguccucauugaauccuc

SEQ ID NO: 1742 - RNA, 19 nt, Artificial Sequence
  RNA Oligomer
ggaggacuccagaagauga

SEQ ID NO: 1743 - RNA, 19 nt, Artificial Sequence
  RNA Oligomer
gaaauaagauugcagcugc

SEQ ID NO: 1744 - RNA, 19 nt, Artificial Sequence
  RNA Oligomer
guauuccuaaccugucaga

SEQ ID NO: 1745 - RNA, 19 nt, Artificial Sequence
  RNA Oligomer
uuguacucaaugguaucau

SEQ ID NO: 1746 - RNA, 19 nt, Artificial Sequence
  RNA Oligomer
gugguugaaaaccacaguc

SEQ ID NO: 1747 - RNA, 19 nt, Artificial Sequence
  RNA Oligomer
cccuuugucaaggaagagc

SEQ ID NO: 1748 - RNA, 19 nt, Artificial Sequence
  RNA Oligomer
cagguccucuguugcaaac

SEQ ID NO: 1749 - RNA, 19 nt, Artificial Sequence
  RNA Oligomer
aggcaauguacucuuccga

SEQ ID NO: 1750 - RNA, 19 nt, Artificial Sequence
  RNA Oligomer
aagugcaucuuugccucaa

SEQ ID NO: 1751 - RNA, 19 nt, Artificial Sequence
  RNA Oligomer
cugaagccauuggagagcu

SEQ ID NO: 1752 - RNA, 19 nt, Artificial Sequence
  RNA Oligomer
cucuuuauccaacagauaa

SEQ ID NO: 1753 - RNA, 19 nt, Artificial Sequence
  RNA Oligomer
gaagaugagagaaaccucu

SEQ ID NO: 1754 - RNA, 19 nt, Artificial Sequence
  RNA Oligomer
uuggaaccaagacauggua

SEQ ID NO: 1755 - RNA, 19 nt, Artificial Sequence
  RNA Oligomer
auccuaguauuccuaaccu

SEQ ID NO: 1756 - RNA, 19 nt, Artificial Sequence
  RNA Oligomer
ugagguuugccauccagaa

SEQ ID NO: 1757 - RNA, 19 nt, Artificial Sequence
  RNA Oligomer
gcugugagaagucacucac

SEQ ID NO: 1758 - RNA, 19 nt, Artificial Sequence
  RNA Oligomer
uccuugugguugaaaacca

SEQ ID NO: 1759 - RNA, 19 nt, Artificial Sequence
  RNA Oligomer
ggacucuccacucaauguc

SEQ ID NO: 1760 - RNA, 19 nt, Artificial Sequence
  RNA Oligomer
aggguuaggacucuccacu

SEQ ID NO: 1761 - RNA, 19 nt, Artificial Sequence
  RNA Oligomer
ugauggcagguccucuguu

SEQ ID NO: 1762 - RNA, 19 nt, Artificial Sequence
  RNA Oligomer
accguuaggauucaggcag

SEQ ID NO: 1763 - RNA, 19 nt, Artificial Sequence
  RNA Oligomer
caaaaaaccaggaugccca

SEQ ID NO: 1764 - RNA, 19 nt, Artificial Sequence
  RNA Oligomer
caggauuuaggccuuaaca

SEQ ID NO: 1765 - RNA, 19 nt, Artificial Sequence
  RNA Oligomer
gacuccagaagaugagaga

SEQ ID NO: 1766 - RNA, 19 nt, Artificial Sequence
  RNA Oligomer
gaggacuccagaagaugag

SEQ ID NO: 1767 - RNA, 19 nt, Artificial Sequence
  RNA Oligomer
gcuggaaucagucacuguc

SEQ ID NO: 1768 - RNA, 19 nt, Artificial Sequence
  RNA Oligomer
cgcuggaaucagucacugu

SEQ ID NO: 1769 - RNA, 19 nt, Artificial Sequence
  RNA Oligomer
ugcgcuggaaucagucacu

SEQ ID NO: 1770 - RNA, 19 nt, Artificial Sequence
  RNA Oligomer
agaacaagcaccucugcca

SEQ ID NO: 1771 - RNA, 19 nt, Artificial Sequence
  RNA Oligomer
ugagaagucacucacacug

SEQ ID NO: 1772 - RNA, 19 nt, Artificial Sequence
  RNA Oligomer
ccuugugguugaaaaccac

SEQ ID NO: 1773 - RNA, 19 nt, Artificial Sequence
  RNA Oligomer
caguuccaaagucacagga

SEQ ID NO: 1774 - RNA, 19 nt, Artificial Sequence
  RNA Oligomer
agcguuaacacaaaaucca

SEQ ID NO: 1775 - RNA, 19 nt, Artificial Sequence
  RNA Oligomer
agagaaaccucuuuaucca

SEQ ID NO: 1776 - RNA, 19 nt, Artificial Sequence
  RNA Oligomer
guauuguccgggcucagaa

SEQ ID NO: 1777 - RNA, 19 nt, Artificial Sequence
  RNA Oligomer
uccagaacaagcaccucug

SEQ ID NO: 1778 - RNA, 19 nt, Artificial Sequence
  RNA Oligomer
cugugaaauucucagagug

SEQ ID NO: 1779 - RNA, 19 nt, Artificial Sequence
  RNA Oligomer
ucugugaaauucucagagu

SEQ ID NO: 1780 - RNA, 19 nt, Artificial Sequence
  RNA Oligomer
cuggaagagccaaagaaua

SEQ ID NO: 1781 - RNA, 19 nt, Artificial Sequence
  RNA Oligomer
gcuggaagagccaaagaau

SEQ ID NO: 1782 - RNA, 19 nt, Artificial Sequence
  RNA Oligomer
uccacucaaugucuuaggu

SEQ ID NO: 1783 - RNA, 19 nt, Artificial Sequence
  RNA Oligomer
gaagagcugagguuugcca

SEQ ID NO: 1784 - RNA, 19 nt, Artificial Sequence
  RNA Oligomer
uccaaaggguuaggacucu

SEQ ID NO: 1785 - RNA, 19 nt, Artificial Sequence
  RNA Oligomer
ugagagaaaccucuuuauc

SEQ ID NO: 1786 - RNA, 19 nt, Artificial Sequence
  RNA Oligomer
uuauuucuuucucgucgcc

SEQ ID NO: 1787 - RNA, 19 nt, Artificial Sequence
  RNA Oligomer
uuuuggguauaaaaugagg

SEQ ID NO: 1788 - RNA, 19 nt, Artificial Sequence
  RNA Oligomer
uuuuccuuucaucuucuuc

SEQ ID NO: 1789 - RNA, 19 nt, Artificial Sequence
  RNA Oligomer
uuccuuucaucuucuucag

SEQ ID NO: 1790 - RNA, 19 nt, Artificial Sequence
  RNA Oligomer
uuuggguauaaaaugagga

SEQ ID NO: 1791 - RNA, 19 nt, Artificial Sequence
  RNA Oligomer
cuuauuucuuucucgucgc

SEQ ID NO: 1792 - RNA, 19 nt, Artificial Sequence
  RNA Oligomer
ucuuuuuccuuucaucuuc

SEQ ID NO: 1793 - RNA, 19 nt, Artificial Sequence
  RNA Oligomer
aaaaugaggauucaaugag

SEQ ID NO: 1794 - RNA, 19 nt, Artificial Sequence
  RNA Oligomer
cuuuuuccuuucaucuucu

SEQ ID NO: 1795 - RNA, 19 nt, Artificial Sequence
  RNA Oligomer
uacaugacaaaaacaaugc

SEQ ID NO: 1796 - RNA, 19 nt, Artificial Sequence
  RNA Oligomer
uuggguauaaaaugaggau

SEQ ID NO: 1797 - RNA, 19 nt, Artificial Sequence
  RNA Oligomer
uccuucuucuuguuucggc

SEQ ID NO: 1798 - RNA, 19 nt, Artificial Sequence
  RNA Oligomer
aucuuauuucuuucucguc

SEQ ID NO: 1799 - RNA, 19 nt, Artificial Sequence
  RNA Oligomer
auuucuuucucgucgccuc

SEQ ID NO: 1800 - RNA, 19 nt, Artificial Sequence
  RNA Oligomer
ucuccuucuucuuguuucg

SEQ ID NO: 1801 - RNA, 19 nt, Artificial Sequence
  RNA Oligomer
uauuucuuucucgucgccu

SEQ ID NO: 1802 - RNA, 19 nt, Artificial Sequence
  RNA Oligomer
aacaaugcuauugacaucc

SEQ ID NO: 1803 - RNA, 19 nt, Artificial Sequence
  RNA Oligomer
aauucuguccuccucuugc

SEQ ID NO: 1804 - RNA, 19 nt, Artificial Sequence
  RNA Oligomer
uugcacacacaauuucugg

SEQ ID NO: 1805 - RNA, 19 nt, Artificial Sequence
  RNA Oligomer
uuuuguagaauccagauga

SEQ ID NO: 1806 - RNA, 19 nt, Artificial Sequence
  RNA Oligomer
aacauaagaauggccagug

SEQ ID NO: 1807 - RNA, 19 nt, Artificial Sequence
  RNA Oligomer
auggcuucaggguuuuggg

SEQ ID NO: 1808 - RNA, 19 nt, Artificial Sequence
  RNA Oligomer
aaauggaauauucuuuggc

SEQ ID NO: 1809 - RNA, 19 nt, Artificial Sequence
  RNA Oligomer
aaugaggauucaaugagga

SEQ ID NO: 1810 - RNA, 19 nt, Artificial Sequence
  RNA Oligomer
uucucgucgccucuuuuuc

SEQ ID NO: 1811 - RNA, 19 nt, Artificial Sequence
  RNA Oligomer
ucucgucgccucuuuuucc

SEQ ID NO: 1812 - RNA, 19 nt, Artificial Sequence
  RNA Oligomer
cucgucgccucuuuuuccu

SEQ ID NO: 1813 - RNA, 19 nt, Artificial Sequence
  RNA Oligomer
aacgcugggagaauucugu

SEQ ID NO: 1814 - RNA, 19 nt, Artificial Sequence
  RNA Oligomer
auucuguccuccucuugcu

SEQ ID NO: 1815 - RNA, 19 nt, Artificial Sequence
  RNA Oligomer
cuggaacauaagaauggcc

SEQ ID NO: 1816 - RNA, 19 nt, Artificial Sequence
  RNA Oligomer
uuccuucuuuuaucuguug

SEQ ID NO: 1817 - RNA, 19 nt, Artificial Sequence
  RNA Oligomer
uccuucuuuuaucuguugg

SEQ ID NO: 1818 - RNA, 19 nt, Artificial Sequence
  RNA Oligomer
uucuucuuguuucggcacu

SEQ ID NO: 1819 - RNA, 19 nt, Artificial Sequence
  RNA Oligomer
cugcaaucuuauuucuuuc

SEQ ID NO: 1820 - RNA, 19 nt, Artificial Sequence
  RNA Oligomer
uuucuuucucgucgccucu

SEQ ID NO: 1821 - RNA, 19 nt, Artificial Sequence
  RNA Oligomer
gucgccucuuuuuccuuuc

SEQ ID NO: 1822 - RNA, 19 nt, Artificial Sequence
  RNA Oligomer
uacauugccuaguuuucuu

SEQ ID NO: 1823 - RNA, 19 nt, Artificial Sequence
  RNA Oligomer
uucaggguuuuggguauaa

SEQ ID NO: 1824 - RNA, 19 nt, Artificial Sequence
  RNA Oligomer
agguugagcauguauauca

SEQ ID NO: 1825 - RNA, 19 nt, Artificial Sequence
  RNA Oligomer
gucuucuccuucuucuugu

SEQ ID NO: 1826 - RNA, 19 nt, Artificial Sequence
  RNA Oligomer
gauuucuuaaaacagcuac

SEQ ID NO: 1827 - RNA, 19 nt, Artificial Sequence
  RNA Oligomer
uuuccaaacaucucuccac

SEQ ID NO: 1828 - RNA, 19 nt, Artificial Sequence
  RNA Oligomer
cacaaggaaaggaaaaugg

SEQ ID NO: 1829 - RNA, 19 nt, Artificial Sequence
  RNA Oligomer
cuuuggaacugaguuugca

SEQ ID NO: 1830 - RNA, 19 nt, Artificial Sequence
  RNA Oligomer
cauugccuaguuuucuugc

SEQ ID NO: 1831 - RNA, 19 nt, Artificial Sequence
  RNA Oligomer
uuuuuguagaauccagaug

SEQ ID NO: 1832 - RNA, 19 nt, Artificial Sequence
  RNA Oligomer
uagaauccagaugaaaggc

SEQ ID NO: 1833 - RNA, 19 nt, Artificial Sequence
  RNA Oligomer
agaauccagaugaaaggcg

SEQ ID NO: 1834 - RNA, 19 nt, Artificial Sequence
  RNA Oligomer
aauggccaguguguuaagg

SEQ ID NO: 1835 - RNA, 19 nt, Artificial Sequence
  RNA Oligomer
cuuagcucugcaauguucc

SEQ ID NO: 1836 - RNA, 19 nt, Artificial Sequence
  RNA Oligomer
aucaaaugcugcuucucgu

SEQ ID NO: 1837 - RNA, 19 nt, Artificial Sequence
  RNA Oligomer
cagcugcaaucuuauuucu

SEQ ID NO: 1838 - RNA, 19 nt, Artificial Sequence
  RNA Oligomer
uaccucggcuuuugugaug

SEQ ID NO: 1839 - RNA, 19 nt, Artificial Sequence
  RNA Oligomer
auuuuaauagacaguagcc

SEQ ID NO: 1840 - RNA, 19 nt, Artificial Sequence
  RNA Oligomer
aauauucuuuggcucuucc

SEQ ID NO: 1841 - RNA, 19 nt, Artificial Sequence
  RNA Oligomer
uaguuuucuugcacacaca

SEQ ID NO: 1842 - RNA, 19 nt, Artificial Sequence
  RNA Oligomer
aaauccucaaacaccagug

SEQ ID NO: 1843 - RNA, 19 nt, Artificial Sequence
  RNA Oligomer
uuuguagaauccagaugaa

SEQ ID NO: 1844 - RNA, 19 nt, Artificial Sequence
  RNA Oligomer
gaauccagaugaaaggcgg

SEQ ID NO: 1845 - RNA, 19 nt, Artificial Sequence
  RNA Oligomer
cuccuucuucuuguuucgg

SEQ ID NO: 1846 - RNA, 19 nt, Artificial Sequence
  RNA Oligomer
gguuuccaaacaucucucc

SEQ ID NO: 1847 - RNA, 19 nt, Artificial Sequence
  RNA Oligomer
aauggaauauucuuuggcu

SEQ ID NO: 1848 - RNA, 19 nt, Artificial Sequence
  RNA Oligomer
uuucuuccugugacuuugg

SEQ ID NO: 1849 - RNA, 19 nt, Artificial Sequence
  RNA Oligomer
ugaguuugcaacagaggac

SEQ ID NO: 1850 - RNA, 19 nt, Artificial Sequence
  RNA Oligomer
cuaguuuucuugcacacac

SEQ ID NO: 1851 - RNA, 19 nt, Artificial Sequence
  RNA Oligomer
cuugcacacacaauuucug

SEQ ID NO: 1852 - RNA, 19 nt, Artificial Sequence
  RNA Oligomer
guagaauccagaugaaagg

SEQ ID NO: 1853 - RNA, 19 nt, Artificial Sequence
  RNA Oligomer
auaagaauggccagugugu

SEQ ID NO: 1854 - RNA, 19 nt, Artificial Sequence
  RNA Oligomer
augaggauucaaugaggac

SEQ ID NO: 1855 - RNA, 19 nt, Artificial Sequence
  RNA Oligomer
uuagcucugcaauguuccu

SEQ ID NO: 1856 - RNA, 19 nt, Artificial Sequence
  RNA Oligomer
uucacacuuuccagcuucu

SEQ ID NO: 1857 - RNA, 19 nt, Artificial Sequence
  RNA Oligomer
aggugcuuguucuggaugg

SEQ ID NO: 1858 - RNA, 19 nt, Artificial Sequence
  RNA Oligomer
aaacaaugcuauugacauc

SEQ ID NO: 1859 - RNA, 19 nt, Artificial Sequence
  RNA Oligomer
aaacaucucuccacugacu

SEQ ID NO: 1860 - RNA, 19 nt, Artificial Sequence
  RNA Oligomer
aacaucucuccacugacug

SEQ ID NO: 1861 - RNA, 19 nt, Artificial Sequence
  RNA Oligomer
guugaacuuucugcuuucu

SEQ ID NO: 1862 - RNA, 19 nt, Artificial Sequence
  RNA Oligomer
acuuucugcuuucuuccug

SEQ ID NO: 1863 - RNA, 19 nt, Artificial Sequence
  RNA Oligomer
acucuuagaaaccagaucu

SEQ ID NO: 1864 - RNA, 19 nt, Artificial Sequence
  RNA Oligomer
ucuugcacacacaauuucu

SEQ ID NO: 1865 - RNA, 19 nt, Artificial Sequence
  RNA Oligomer
ugcacacacaauuucugga

SEQ ID NO: 1866 - RNA, 19 nt, Artificial Sequence
  RNA Oligomer
aaaauccucaaacaccagu

SEQ ID NO: 1867 - RNA, 19 nt, Artificial Sequence
  RNA Oligomer
guuucucucaucuucugga

SEQ ID NO: 1868 - RNA, 19 nt, Artificial Sequence
  RNA Oligomer
cacuccgucuucuccuucu

SEQ ID NO: 1869 - RNA, 19 nt, Artificial Sequence
  RNA Oligomer
uccgucuucuccuucuucu

SEQ ID NO: 1870 - RNA, 19 nt, Artificial Sequence
  RNA Oligomer
aauuucacagaaacaucag

SEQ ID NO: 1871 - RNA, 19 nt, Artificial Sequence
  RNA Oligomer
auuucacagaaacaucaga

SEQ ID NO: 1872 - RNA, 19 nt, Artificial Sequence
  RNA Oligomer
uuucacagaaacaucagaa

SEQ ID NO: 1873 - RNA, 19 nt, Artificial Sequence
  RNA Oligomer
cagauuucuuaaaacagcu

SEQ ID NO: 1874 - RNA, 19 nt, Artificial Sequence
  RNA Oligomer
acaugacaaaaacaaugcu

SEQ ID NO: 1875 - RNA, 19 nt, Artificial Sequence
  RNA Oligomer
gacaaaaacaaugcuauug

SEQ ID NO: 1876 - RNA, 19 nt, Artificial Sequence
  RNA Oligomer
ugguuuccaaacaucucuc

SEQ ID NO: 1877 - RNA, 19 nt, Artificial Sequence
  RNA Oligomer
uuccaaacaucucuccacu

SEQ ID NO: 1878 - RNA, 19 nt, Artificial Sequence
  RNA Oligomer
agccuagacacaacuccug

SEQ ID NO: 1879 - RNA, 19 nt, Artificial Sequence
  RNA Oligomer
cucuuagaaaccagaucug

SEQ ID NO: 1880 - RNA, 19 nt, Artificial Sequence
  RNA Oligomer
aagaguacauugccuaguu

SEQ ID NO: 1881 - RNA, 19 nt, Artificial Sequence
  RNA Oligomer
gcacacacaauuucuggac

SEQ ID NO: 1882 - RNA, 19 nt, Artificial Sequence
  RNA Oligomer
aaaugcuguucucacucca

SEQ ID NO: 1883 - RNA, 19 nt, Artificial Sequence
  RNA Oligomer
gcauccugguuuuuuguag

SEQ ID NO: 1884 - RNA, 19 nt, Artificial Sequence
  RNA Oligomer
auccugguuuuuuguagaa

SEQ ID NO: 1885 - RNA, 19 nt, Artificial Sequence
  RNA Oligomer
guuuuuuguagaauccaga

SEQ ID NO: 1886 - RNA, 19 nt, Artificial Sequence
  RNA Oligomer
agguuucucucaucuucug

SEQ ID NO: 1887 - RNA, 19 nt, Artificial Sequence
  RNA Oligomer
gguuucucucaucuucugg

SEQ ID NO: 1888 - RNA, 19 nt, Artificial Sequence
  RNA Oligomer
augcugcuucucguucuug

SEQ ID NO: 1889 - RNA, 19 nt, Artificial Sequence
  RNA Oligomer
ugcugcuucucguucuuga

SEQ ID NO: 1890 - RNA, 19 nt, Artificial Sequence
  RNA Oligomer
uuguggccagugugaguga

SEQ ID NO: 1891 - RNA, 19 nt, Artificial Sequence
  RNA Oligomer
caaaaacaaugcuauugac

SEQ ID NO: 1892 - RNA, 19 nt, Artificial Sequence
  RNA Oligomer
acaaugcuauugacaucca

SEQ ID NO: 1893 - RNA, 19 nt, Artificial Sequence
  RNA Oligomer
auggaauauucuuuggcuc

SEQ ID NO: 1894 - RNA, 19 nt, Artificial Sequence
  RNA Oligomer
uuccagccuagacacaacu

SEQ ID NO: 1895 - RNA, 19 nt, Artificial Sequence
  RNA Oligomer
gaccuaagacauugagugg

SEQ ID NO: 1896 - RNA, 19 nt, Artificial Sequence
  RNA Oligomer
aacuuucugcuuucuuccu

SEQ ID NO: 1897 - RNA, 19 nt, Artificial Sequence
  RNA Oligomer
cuuucugcuuucuuccugu

SEQ ID NO: 1898 - RNA, 19 nt, Artificial Sequence
  RNA Oligomer
uuucugcuuucuuccugug

SEQ ID NO: 1899 - RNA, 19 nt, Artificial Sequence
  RNA Oligomer
guuggauaaagagguuucu

SEQ ID NO: 1900 - RNA, 19 nt, Artificial Sequence
  RNA Oligomer
cacacuuuccagcuucucc

SEQ ID NO: 1901 - RNA, 19 nt, Artificial Sequence
  RNA Oligomer
uguucuggauggcaaaccu

SEQ ID NO: 1902 - RNA, 19 nt, Artificial Sequence
  RNA Oligomer
gaauuucacagaaacauca

SEQ ID NO: 1903 - RNA, 19 nt, Artificial Sequence
  RNA Oligomer
ccagauuucuuaaaacagc

SEQ ID NO: 1904 - RNA, 19 nt, Artificial Sequence
  RNA Oligomer
uaaaacagcuacaugacaa

SEQ ID NO: 1905 - RNA, 19 nt, Artificial Sequence
  RNA Oligomer
cuacaugacaaaaacaaug

SEQ ID NO: 1906 - RNA, 19 nt, Artificial Sequence
  RNA Oligomer
caugacaaaaacaaugcua

SEQ ID NO: 1907 - RNA, 19 nt, Artificial Sequence
  RNA Oligomer
uuagcaaaauccucaaaca

SEQ ID NO: 1908 - RNA, 19 nt, Artificial Sequence
  RNA Oligomer
aaacaccagugacccagga

SEQ ID NO: 1909 - RNA, 19 nt, Artificial Sequence
  RNA Oligomer
gaauauucuuuggcucuuc

SEQ ID NO: 1910 - RNA, 19 nt, Artificial Sequence
  RNA Oligomer
ugaccuaagacauugagug

SEQ ID NO: 1911 - RNA, 19 nt, Artificial Sequence
  RNA Oligomer
gagaguccuaacccuuugg

SEQ ID NO: 1912 - RNA, 19 nt, Artificial Sequence
  RNA Oligomer
aaaacucuuagaaaccaga

SEQ ID NO: 1913 - RNA, 19 nt, Artificial Sequence
  RNA Oligomer
agcauauaaaagucacauc

SEQ ID NO: 1914 - RNA, 19 nt, Artificial Sequence
  RNA Oligomer
gcauauaaaagucacauca

SEQ ID NO: 1915 - RNA, 19 nt, Artificial Sequence
  RNA Oligomer
uagcaaaauccucaaacac

SEQ ID NO: 1916 - RNA, 19 nt, Artificial Sequence
  RNA Oligomer
uccucaaacaccagugacc

SEQ ID NO: 1917 - RNA, 19 nt, Artificial Sequence
  RNA Oligomer
uuuaccaugucuugguucc

SEQ ID NO: 1918 - RNA, 19 nt, Artificial Sequence
  RNA Oligomer
auauucuuuggcucuucca

SEQ ID NO: 1919 - RNA, 19 nt, Artificial Sequence
  RNA Oligomer
cuccugaccuaagacauug

SEQ ID NO: 1920 - RNA, 19 nt, Artificial Sequence
  RNA Oligomer
uccugaccuaagacauuga

SEQ ID NO: 1921 - RNA, 19 nt, Artificial Sequence
  RNA Oligomer
aagacauugaguggagagu

SEQ ID NO: 1922 - RNA, 19 nt, Artificial Sequence
  RNA Oligomer
uucugcuuucuuccuguga

SEQ ID NO: 1923 - RNA, 19 nt, Artificial Sequence
  RNA Oligomer
auccucaaacaccagugac

SEQ ID NO: 1924 - RNA, 19 nt, Artificial Sequence
  RNA Oligomer
cuguucucacuccacaucc

SEQ ID NO: 1925 - RNA, 19 nt, Artificial Sequence
  RNA Oligomer
uaagacauugaguggagag

SEQ ID NO: 1926 - RNA, 19 nt, Artificial Sequence
  RNA Oligomer
aaugcuguucucacuccac

SEQ ID NO: 1927 - RNA, 19 nt, Artificial Sequence
  RNA Oligomer
uuugcuagaaagcacaacc

SEQ ID NO: 1928 - RNA, 19 nt, Artificial Sequence
  RNA Oligomer
augcuguucucacuccaca

SEQ ID NO: 1929 - RNA, 19 nt, Artificial Sequence
  RNA Oligomer
aucuggaacauaagaaugg

SEQ ID NO: 1930 - RNA, 19 nt, Artificial Sequence
  RNA Oligomer
aucuucuggaguccuccca

SEQ ID NO: 1931 - RNA, 19 nt, Artificial Sequence
  RNA Oligomer
uuguaaugauaccauugag

SEQ ID NO: 1932 - RNA, 19 nt, Artificial Sequence
  RNA Oligomer
cuugcugacaagcucuucu

SEQ ID NO: 1933 - RNA, 19 nt, Artificial Sequence
  RNA Oligomer
auauuugcuagaaagcaca

SEQ ID NO: 1934 - RNA, 19 nt, Artificial Sequence
  RNA Oligomer
uugcuagaaagcacaaccc

SEQ ID NO: 1935 - RNA, 19 nt, Artificial Sequence
  RNA Oligomer
guuaaggccuaaauccugg

SEQ ID NO: 1936 - RNA, 19 nt, Artificial Sequence
  RNA Oligomer
auuuuguguuaacgcuggg

SEQ ID NO: 1937 - RNA, 19 nt, Artificial Sequence
  RNA Oligomer
auuugcuagaaagcacaac

SEQ ID NO: 1938 - RNA, 19 nt, Artificial Sequence
  RNA Oligomer
guuuuggguauaaaaugag

SEQ ID NO: 1939 - RNA, 19 nt, Artificial Sequence
  RNA Oligomer
ccuuucaucuucuucaggg

SEQ ID NO: 1940 - RNA, 19 nt, Artificial Sequence
  RNA Oligomer
gcuuuugugauggacaccc

SEQ ID NO: 1941 - RNA, 19 nt, Artificial Sequence
  RNA Oligomer
uccucuugcugacaagcuc

SEQ ID NO: 1942 - RNA, 19 nt, Artificial Sequence
  RNA Oligomer
uagaaagcacaacccuggc

SEQ ID NO: 1943 - RNA, 19 nt, Artificial Sequence
  RNA Oligomer
uucucguucuugagcuccu

SEQ ID NO: 1944 - RNA, 19 nt, Artificial Sequence
  RNA Oligomer
auuauucugacagguuagg

SEQ ID NO: 1945 - RNA, 19 nt, Artificial Sequence
  RNA Oligomer
uuuguguuaacgcugggag

SEQ ID NO: 1946 - RNA, 19 nt, Artificial Sequence
  RNA Oligomer
uaaggccuaaauccuggag

SEQ ID NO: 1947 - RNA, 19 nt, Artificial Sequence
  RNA Oligomer
aguugaggcaaagaugcac

SEQ ID NO: 1948 - RNA, 19 nt, Artificial Sequence
  RNA Oligomer
aucugagccuucaguucag

SEQ ID NO: 1949 - RNA, 19 nt, Artificial Sequence
  RNA Oligomer
uuguuucggcacuuugcag

SEQ ID NO: 1950 - RNA, 19 nt, Artificial Sequence
  RNA Oligomer
acuuuggaacugaguuugc

SEQ ID NO: 1951 - RNA, 19 nt, Artificial Sequence
  RNA Oligomer
aacugaguuugcaacagag

SEQ ID NO: 1952 - RNA, 19 nt, Artificial Sequence
  RNA Oligomer
gauuuuguguuaacgcugg

SEQ ID NO: 1953 - RNA, 19 nt, Artificial Sequence
  RNA Oligomer
uuuuguguuaacgcuggga

SEQ ID NO: 1954 - RNA, 19 nt, Artificial Sequence
  RNA Oligomer
ucuggaacauaagaauggc

SEQ ID NO: 1955 - RNA, 19 nt, Artificial Sequence
  RNA Oligomer
aaagagguuucucucaucu

SEQ ID NO: 1956 - RNA, 19 nt, Artificial Sequence
  RNA Oligomer
auguauaucaaaugcugcu

SEQ ID NO: 1957 - RNA, 19 nt, Artificial Sequence
  RNA Oligomer
cuucucguucuugagcucc

SEQ ID NO: 1958 - RNA, 19 nt, Artificial Sequence
  RNA Oligomer
accucggcuuuugugaugg

SEQ ID NO: 1959 - RNA, 19 nt, Artificial Sequence
  RNA Oligomer
uuggaaguugaacuuucug

SEQ ID NO: 1960 - RNA, 19 nt, Artificial Sequence
  RNA Oligomer
gacuuuggaacugaguuug

SEQ ID NO: 1961 - RNA, 19 nt, Artificial Sequence
  RNA Oligomer
ugggagaauucuguccucc

SEQ ID NO: 1962 - RNA, 19 nt, Artificial Sequence
  RNA Oligomer
ugcugacaagcucuucugg

SEQ ID NO: 1963 - RNA, 19 nt, Artificial Sequence
  RNA Oligomer
auugccuaguuuucuugca

SEQ ID NO: 1964 - RNA, 19 nt, Artificial Sequence
  RNA Oligomer
uuucucucaucuucuggag

SEQ ID NO: 1965 - RNA, 19 nt, Artificial Sequence
  RNA Oligomer
aaucugagccuucaguuca

SEQ ID NO: 1966 - RNA, 19 nt, Artificial Sequence
  RNA Oligomer
cugacagugacugauucca

SEQ ID NO: 1967 - RNA, 19 nt, Artificial Sequence
  RNA Oligomer
uuaccaugucuugguucca

SEQ ID NO: 1968 - RNA, 19 nt, Artificial Sequence
  RNA Oligomer
uauuauucugacagguuag

SEQ ID NO: 1969 - RNA, 19 nt, Artificial Sequence
  RNA Oligomer
uguaaugauaccauugagu

SEQ ID NO: 1970 - RNA, 19 nt, Artificial Sequence
  RNA Oligomer
uuuggaaguugaacuuucu

SEQ ID NO: 1971 - RNA, 19 nt, Artificial Sequence
  RNA Oligomer
gaauaucuugagauacugc

SEQ ID NO: 1972 - RNA, 19 nt, Artificial Sequence
  RNA Oligomer
uugccuaguuuucuugcac

SEQ ID NO: 1973 - RNA, 19 nt, Artificial Sequence
  RNA Oligomer
auuucuggacauaacagca

SEQ ID NO: 1974 - RNA, 19 nt, Artificial Sequence
  RNA Oligomer
uuucuggacauaacagcau

SEQ ID NO: 1975 - RNA, 19 nt, Artificial Sequence
  RNA Oligomer
cauauuugcuagaaagcac

SEQ ID NO: 1976 - RNA, 19 nt, Artificial Sequence
  RNA Oligomer
uggaacauaagaauggcca

SEQ ID NO: 1977 - RNA, 19 nt, Artificial Sequence
  RNA Oligomer
guugaggcaaagaugcacu

SEQ ID NO: 1978 - RNA, 19 nt, Artificial Sequence
  RNA Oligomer
gguuuuggguauaaaauga

SEQ ID NO: 1979 - RNA, 19 nt, Artificial Sequence
  RNA Oligomer
aggauucaaugaggacucc

SEQ ID NO: 1980 - RNA, 19 nt, Artificial Sequence
  RNA Oligomer
ugcuucucguucuugagcu

SEQ ID NO: 1981 - RNA, 19 nt, Artificial Sequence
  RNA Oligomer
ucugagccuucaguucagc

SEQ ID NO: 1982 - RNA, 19 nt, Artificial Sequence
  RNA Oligomer
uuauucugacagguuagga

SEQ ID NO: 1983 - RNA, 19 nt, Artificial Sequence
  RNA Oligomer
aucucuccacugacugugg

SEQ ID NO: 1984 - RNA, 19 nt, Artificial Sequence
  RNA Oligomer
uuuucaaccacaaggaaag

SEQ ID NO: 1985 - RNA, 19 nt, Artificial Sequence
  RNA Oligomer
ugaauaucuugagauacug

SEQ ID NO: 1986 - RNA, 19 nt, Artificial Sequence
  RNA Oligomer
cagaagcacucacuuccga

SEQ ID NO: 1987 - RNA, 19 nt, Artificial Sequence
  RNA Oligomer
auggccaguguguuaaggc

SEQ ID NO: 1988 - RNA, 19 nt, Artificial Sequence
  RNA Oligomer
aaggccuaaauccuggagu

SEQ ID NO: 1989 - RNA, 19 nt, Artificial Sequence
  RNA Oligomer
aucuguuggauaaagaggu

SEQ ID NO: 1990 - RNA, 19 nt, Artificial Sequence
  RNA Oligomer
ugagugacuucucacagcu

SEQ ID NO: 1991 - RNA, 19 nt, Artificial Sequence
  RNA Oligomer
agugacuucucacagcugc

SEQ ID NO: 1992 - RNA, 19 nt, Artificial Sequence
  RNA Oligomer
uggauggcaaaccucagcu

SEQ ID NO: 1993 - RNA, 19 nt, Artificial Sequence
  RNA Oligomer
uucuuuggcucuuccagcc

SEQ ID NO: 1994 - RNA, 19 nt, Artificial Sequence
  RNA Oligomer
uuuggcucuuccagccuag

SEQ ID NO: 1995 - RNA, 19 nt, Artificial Sequence
  RNA Oligomer
aaguugaacuuucugcuuu

SEQ ID NO: 1996 - RNA, 19 nt, Artificial Sequence
  RNA Oligomer
uuaaggccuaaauccugga

SEQ ID NO: 1997 - RNA, 19 nt, Artificial Sequence
  RNA Oligomer
gaggcaaagaugcacuugc

SEQ ID NO: 1998 - RNA, 19 nt, Artificial Sequence
  RNA Oligomer
uaaagagguuucucucauc

SEQ ID NO: 1999 - RNA, 19 nt, Artificial Sequence
  RNA Oligomer
cucucaucuucuggagucc

SEQ ID NO: 2000 - RNA, 19 nt, Artificial Sequence
  RNA Oligomer
uaaugauaccauugaguac

SEQ ID NO: 2001 - RNA, 19 nt, Artificial Sequence
  RNA Oligomer
aaugauaccauugaguaca

SEQ ID NO: 2002 - RNA, 19 nt, Artificial Sequence
  RNA Oligomer
uccacugacugugguuucc

SEQ ID NO: 2003 - RNA, 19 nt, Artificial Sequence
  RNA Oligomer
ugacugugguuuucaacca

SEQ ID NO: 2004 - RNA, 19 nt, Artificial Sequence
  RNA Oligomer
aguugaacuuucugcuuuc

SEQ ID NO: 2005 - RNA, 19 nt, Artificial Sequence
  RNA Oligomer
gaguuugcaacagaggacc

SEQ ID NO: 2006 - RNA, 19 nt, Artificial Sequence
  RNA Oligomer
uauaaaagucacaucagug

SEQ ID NO: 2007 - RNA, 19 nt, Artificial Sequence
  RNA Oligomer
cugguuuuuuguagaaucc

SEQ ID NO: 2008 - RNA, 19 nt, Artificial Sequence
  RNA Oligomer
uaaauccuggaguugaggc

SEQ ID NO: 2009 - RNA, 19 nt, Artificial Sequence
  RNA Oligomer
aggcaaagaugcacuugcc

SEQ ID NO: 2010 - RNA, 19 nt, Artificial Sequence
  RNA Oligomer
cugcugggauucuagaggu

SEQ ID NO: 2011 - RNA, 19 nt, Artificial Sequence
  RNA Oligomer
uaucuguuggauaaagagg

SEQ ID NO: 2012 - RNA, 19 nt, Artificial Sequence
  RNA Oligomer
auaaagagguuucucucau

SEQ ID NO: 2013 - RNA, 19 nt, Artificial Sequence
  RNA Oligomer
uuucggcacuuugcagcug

SEQ ID NO: 2014 - RNA, 19 nt, Artificial Sequence
  RNA Oligomer
cagguuaggaauacuagga

SEQ ID NO: 2015 - RNA, 19 nt, Artificial Sequence
  RNA Oligomer
gugguuuccaaacaucucu

SEQ ID NO: 2016 - RNA, 19 nt, Artificial Sequence
  RNA Oligomer
uccacugacugugguuuuc

SEQ ID NO: 2017 - RNA, 19 nt, Artificial Sequence
  RNA Oligomer
agcucuuccuugacaaagg

SEQ ID NO: 2018 - RNA, 19 nt, Artificial Sequence
  RNA Oligomer
cucuuccuugacaaagggc

SEQ ID NO: 2019 - RNA, 19 nt, Artificial Sequence
  RNA Oligomer
cuaacccuuuggaaguuga

SEQ ID NO: 2020 - RNA, 19 nt, Artificial Sequence
  RNA Oligomer
cuuuggaaguugaacuuuc

SEQ ID NO: 2021 - RNA, 19 nt, Artificial Sequence
  RNA Oligomer
uucuuccugugacuuugga

SEQ ID NO: 2022 - RNA, 19 nt, Artificial Sequence
  RNA Oligomer
cugggagaauucuguccuc

SEQ ID NO: 2023 - RNA, 19 nt, Artificial Sequence
  RNA Oligomer
cagguuagcaaaauccuca

SEQ ID NO: 2024 - RNA, 19 nt, Artificial Sequence
  RNA Oligomer
ugaauccuaacggugggca

SEQ ID NO: 2025 - RNA, 19 nt, Artificial Sequence
  RNA Oligomer
aauccagaugaaaggcggg

SEQ ID NO: 2026 - RNA, 19 nt, Artificial Sequence
  RNA Oligomer
gaggauucaaugaggacuc

SEQ ID NO: 2027 - RNA, 19 nt, Artificial Sequence
  RNA Oligomer
ucaucuucuggaguccucc

SEQ ID NO: 2028 - RNA, 19 nt, Artificial Sequence
  RNA Oligomer
gcagcugcaaucuuauuuc

SEQ ID NO: 2029 - RNA, 19 nt, Artificial Sequence
  RNA Oligomer
ucugacagguuaggaauac

SEQ ID NO: 2030 - RNA, 19 nt, Artificial Sequence
  RNA Oligomer
augauaccauugaguacaa

SEQ ID NO: 2031 - RNA, 19 nt, Artificial Sequence
  RNA Oligomer
gacugugguuuucaaccac

SEQ ID NO: 2032 - RNA, 19 nt, Artificial Sequence
  RNA Oligomer
gcucuuccuugacaaaggg

SEQ ID NO: 2033 - RNA, 19 nt, Artificial Sequence
  RNA Oligomer
guuugcaacagaggaccug

SEQ ID NO: 2034 - RNA, 19 nt, Artificial Sequence
  RNA Oligomer
ucggaagaguacauugccu

SEQ ID NO: 2035 - RNA, 19 nt, Artificial Sequence
  RNA Oligomer
uugaggcaaagaugcacuu

SEQ ID NO: 2036 - RNA, 19 nt, Artificial Sequence
  RNA Oligomer
agcucuccaauggcuucag

SEQ ID NO: 2037 - RNA, 19 nt, Artificial Sequence
  RNA Oligomer
uuaucuguuggauaaagag

SEQ ID NO: 2038 - RNA, 19 nt, Artificial Sequence
  RNA Oligomer
agagguuucucucaucuuc

SEQ ID NO: 2039 - RNA, 19 nt, Artificial Sequence
  RNA Oligomer
uaccaugucuugguuccaa

SEQ ID NO: 2040 - RNA, 19 nt, Artificial Sequence
  RNA Oligomer
agguuaggaauacuaggau

SEQ ID NO: 2041 - RNA, 19 nt, Artificial Sequence
  RNA Oligomer
uucuggauggcaaaccuca

SEQ ID NO: 2042 - RNA, 19 nt, Artificial Sequence
  RNA Oligomer
gugagugacuucucacagc

SEQ ID NO: 2043 - RNA, 19 nt, Artificial Sequence
  RNA Oligomer
ugguuuucaaccacaagga

SEQ ID NO: 2044 - RNA, 19 nt, Artificial Sequence
  RNA Oligomer
gacauugaguggagagucc

SEQ ID NO: 2045 - RNA, 19 nt, Artificial Sequence
  RNA Oligomer
aguggagaguccuaacccu

SEQ ID NO: 2046 - RNA, 19 nt, Artificial Sequence
  RNA Oligomer
aacagaggaccugccauca

SEQ ID NO: 2047 - RNA, 19 nt, Artificial Sequence
  RNA Oligomer
cugccugaauccuaacggu

SEQ ID NO: 2048 - RNA, 19 nt, Artificial Sequence
  RNA Oligomer
ugggcauccugguuuuuug

SEQ ID NO: 2049 - RNA, 19 nt, Artificial Sequence
  RNA Oligomer
uguuaaggccuaaauccug

SEQ ID NO: 2050 - RNA, 19 nt, Artificial Sequence
  RNA Oligomer
ucucucaucuucuggaguc

SEQ ID NO: 2051 - RNA, 19 nt, Artificial Sequence
  RNA Oligomer
cucaucuucuggaguccuc

SEQ ID NO: 2052 - RNA, 19 nt, Artificial Sequence
  RNA Oligomer
gacagugacugauuccagc

SEQ ID NO: 2053 - RNA, 19 nt, Artificial Sequence
  RNA Oligomer
acagugacugauuccagcg

SEQ ID NO: 2054 - RNA, 19 nt, Artificial Sequence
  RNA Oligomer
agugacugauuccagcgca

SEQ ID NO: 2055 - RNA, 19 nt, Artificial Sequence
  RNA Oligomer
uggcagaggugcuuguucu

SEQ ID NO: 2056 - RNA, 19 nt, Artificial Sequence
  RNA Oligomer
cagugugagugacuucuca

SEQ ID NO: 2057 - RNA, 19 nt, Artificial Sequence
  RNA Oligomer
gugguuuucaaccacaagg

SEQ ID NO: 2058 - RNA, 19 nt, Artificial Sequence
  RNA Oligomer
uccugugacuuuggaacug

SEQ ID NO: 2059 - RNA, 19 nt, Artificial Sequence
  RNA Oligomer
uggauuuuguguuaacgcu

SEQ ID NO: 2060 - RNA, 19 nt, Artificial Sequence
  RNA Oligomer
uggauaaagagguuucucu

SEQ ID NO: 2061 - RNA, 19 nt, Artificial Sequence
  RNA Oligomer
uucugagcccggacaauac

SEQ ID NO: 2062 - RNA, 19 nt, Artificial Sequence
  RNA Oligomer
cagaggugcuuguucugga

SEQ ID NO: 2063 - RNA, 19 nt, Artificial Sequence
  RNA Oligomer
cacucugagaauuucacag

SEQ ID NO: 2064 - RNA, 19 nt, Artificial Sequence
  RNA Oligomer
acucugagaauuucacaga

SEQ ID NO: 2065 - RNA, 19 nt, Artificial Sequence
  RNA Oligomer
uauucuuuggcucuuccag

SEQ ID NO: 2066 - RNA, 19 nt, Artificial Sequence
  RNA Oligomer
auucuuuggcucuuccagc

SEQ ID NO: 2067 - RNA, 19 nt, Artificial Sequence
  RNA Oligomer
accuaagacauugagugga

SEQ ID NO: 2068 - RNA, 19 nt, Artificial Sequence
  RNA Oligomer
uggcaaaccucagcucuuc

SEQ ID NO: 2069 - RNA, 19 nt, Artificial Sequence
  RNA Oligomer
agaguccuaacccuuugga

SEQ ID NO: 2070 - RNA, 19 nt, Artificial Sequence
  RNA Oligomer
gauaaagagguuucucuca

SEQ ID NO: 2071 - RNA, 19 nt, Artificial Sequence
  RNA Oligomer
ccauguguuuugcuuuuau

SEQ ID NO: 2072 - RNA, 19 nt, Artificial Sequence
  RNA Oligomer
ccuugcauuuguaccuuau

SEQ ID NO: 2073 - RNA, 19 nt, Artificial Sequence
  RNA Oligomer
ccaucuccuaucuuuuauu

SEQ ID NO: 2074 - RNA, 19 nt, Artificial Sequence
  RNA Oligomer
gccuacagaacaaaccaaa

SEQ ID NO: 2075 - RNA, 19 nt, Artificial Sequence
  RNA Oligomer
gcaaaaugcuaggccugua

SEQ ID NO: 2076 - RNA, 19 nt, Artificial Sequence
  RNA Oligomer
gcagaaaccuuguuuguuu

SEQ ID NO: 2077 - RNA, 19 nt, Artificial Sequence
  RNA Oligomer
ccucauuaaauggugauuu

SEQ ID NO: 2078 - RNA, 19 nt, Artificial Sequence
  RNA Oligomer
gcauuuguaccuuauugau

SEQ ID NO: 2079 - RNA, 19 nt, Artificial Sequence
  RNA Oligomer
cgacauaguauggaaguau

SEQ ID NO: 2080 - RNA, 19 nt, Artificial Sequence
  RNA Oligomer
gggccuucauuaaauguuu

SEQ ID NO: 2081 - RNA, 19 nt, Artificial Sequence
  RNA Oligomer
gcuacuuuuacuuguucau

SEQ ID NO: 2082 - RNA, 19 nt, Artificial Sequence
  RNA Oligomer
cccuugaaccucauuaaau

SEQ ID NO: 2083 - RNA, 19 nt, Artificial Sequence
  RNA Oligomer
uccucaacuugcugccuaa

SEQ ID NO: 2084 - RNA, 19 nt, Artificial Sequence
  RNA Oligomer
ggaucauguaaaugcucaa

SEQ ID NO: 2085 - RNA, 19 nt, Artificial Sequence
  RNA Oligomer
cgaauuguuagaacaucuu

SEQ ID NO: 2086 - RNA, 19 nt, Artificial Sequence
  RNA Oligomer
gagauaacuuccuucacau

SEQ ID NO: 2087 - RNA, 19 nt, Artificial Sequence
  RNA Oligomer
ugagauaacuuccuucaca

SEQ ID NO: 2088 - RNA, 19 nt, Artificial Sequence
  RNA Oligomer
uccauguguuuugcuuuua

SEQ ID NO: 2089 - RNA, 19 nt, Artificial Sequence
  RNA Oligomer
cucauuaaauggugauuuc

SEQ ID NO: 2090 - RNA, 19 nt, Artificial Sequence
  RNA Oligomer
cccuucugcuuucuauuac

SEQ ID NO: 2091 - RNA, 19 nt, Artificial Sequence
  RNA Oligomer
cuccucaacuugcugccua

SEQ ID NO: 2092 - RNA, 19 nt, Artificial Sequence
  RNA Oligomer
ccgcccuuuuuguccuaga

SEQ ID NO: 2093 - RNA, 19 nt, Artificial Sequence
  RNA Oligomer
uugcacuccugaauuuuau

SEQ ID NO: 2094 - RNA, 19 nt, Artificial Sequence
  RNA Oligomer
gggucgacauaguauggaa

SEQ ID NO: 2095 - RNA, 19 nt, Artificial Sequence
  RNA Oligomer
gcauuuuuagcuccuugaa

SEQ ID NO: 2096 - RNA, 19 nt, Artificial Sequence
  RNA Oligomer
guacuuuguuuuuccaugu

SEQ ID NO: 2097 - RNA, 19 nt, Artificial Sequence
  RNA Oligomer
gccuucauuaaauguuugu

SEQ ID NO: 2098 - RNA, 19 nt, Artificial Sequence
  RNA Oligomer
ccucucagcuucuaauuuu

SEQ ID NO: 2099 - RNA, 19 nt, Artificial Sequence
  RNA Oligomer
ccuuugauauuauguggcu

SEQ ID NO: 2100 - RNA, 19 nt, Artificial Sequence
  RNA Oligomer
ugcacuucauaucuagauu

SEQ ID NO: 2101 - RNA, 19 nt, Artificial Sequence
  RNA Oligomer
cccacuuucauucaaucaa

SEQ ID NO: 2102 - RNA, 19 nt, Artificial Sequence
  RNA Oligomer
ugcauuuguaccuuauuga

SEQ ID NO: 2103 - RNA, 19 nt, Artificial Sequence
  RNA Oligomer
cuugcauuuguaccuuauu

SEQ ID NO: 2104 - RNA, 19 nt, Artificial Sequence
  RNA Oligomer
accaucuccuaucuuuuau

SEQ ID NO: 2105 - RNA, 19 nt, Artificial Sequence
  RNA Oligomer
cuuuguuuuuccauguguu

SEQ ID NO: 2106 - RNA, 19 nt, Artificial Sequence
  RNA Oligomer
ggccuucauuaaauguuug

SEQ ID NO: 2107 - RNA, 19 nt, Artificial Sequence
  RNA Oligomer
ccuuguuuguuuuauucac

SEQ ID NO: 2108 - RNA, 19 nt, Artificial Sequence
  RNA Oligomer
ucaaccuagaaaccuuuau

SEQ ID NO: 2109 - RNA, 19 nt, Artificial Sequence
  RNA Oligomer
cacuucauaucuagauuuc

SEQ ID NO: 2110 - RNA, 19 nt, Artificial Sequence
  RNA Oligomer
cugcacuucauaucuagau

SEQ ID NO: 2111 - RNA, 19 nt, Artificial Sequence
  RNA Oligomer
ccacuuucauucaaucaac

SEQ ID NO: 2112 - RNA, 19 nt, Artificial Sequence
  RNA Oligomer
cccuuacuauucccacuuu

SEQ ID NO: 2113 - RNA, 19 nt, Artificial Sequence
  RNA Oligomer
ugacaagugaaguuguaaa

SEQ ID NO: 2114 - RNA, 19 nt, Artificial Sequence
  RNA Oligomer
ccuacagaacaaaccaaaa

SEQ ID NO: 2115 - RNA, 19 nt, Artificial Sequence
  RNA Oligomer
uuccauguguuuugcuuuu

SEQ ID NO: 2116 - RNA, 19 nt, Artificial Sequence
  RNA Oligomer
ugcuacuuuuacuuguuca

SEQ ID NO: 2117 - RNA, 19 nt, Artificial Sequence
  RNA Oligomer
ugguguccuucuuccucaa

SEQ ID NO: 2118 - RNA, 19 nt, Artificial Sequence
  RNA Oligomer
gaacccuucugcuuucuau

SEQ ID NO: 2119 - RNA, 19 nt, Artificial Sequence
  RNA Oligomer
uuauuucagugccauacau

SEQ ID NO: 2120 - RNA, 19 nt, Artificial Sequence
  RNA Oligomer
ucccuagacucuguaacca

SEQ ID NO: 2121 - RNA, 19 nt, Artificial Sequence
  RNA Oligomer
ggaagucucaaagaucuuu

SEQ ID NO: 2122 - RNA, 19 nt, Artificial Sequence
  RNA Oligomer
uugcauuuguaccuuauug

SEQ ID NO: 2123 - RNA, 19 nt, Artificial Sequence
  RNA Oligomer
cuccgcccuuuuuguccua

SEQ ID NO: 2124 - RNA, 19 nt, Artificial Sequence
  RNA Oligomer
ccugacaagugaaguugua

SEQ ID NO: 2125 - RNA, 19 nt, Artificial Sequence
  RNA Oligomer
cccaucaucucugccuuug

SEQ ID NO: 2126 - RNA, 19 nt, Artificial Sequence
  RNA Oligomer
gcaggauauugggagugug

SEQ ID NO: 2127 - RNA, 19 nt, Artificial Sequence
  RNA Oligomer
agagaaacugcagaauuuu

SEQ ID NO: 2128 - RNA, 19 nt, Artificial Sequence
  RNA Oligomer
cgcaggauauugggagugu

SEQ ID NO: 2129 - RNA, 19 nt, Artificial Sequence
  RNA Oligomer
ccuugcacuccugaauuuu

SEQ ID NO: 2130 - RNA, 19 nt, Artificial Sequence
  RNA Oligomer
agccuugcacuccugaauu

SEQ ID NO: 2131 - RNA, 19 nt, Artificial Sequence
  RNA Oligomer
ccaggauuuuguauugcca

SEQ ID NO: 2132 - RNA, 19 nt, Artificial Sequence
  RNA Oligomer
gacauaguauggaaguauu

SEQ ID NO: 2133 - RNA, 19 nt, Artificial Sequence
  RNA Oligomer
ucgacauaguauggaagua

SEQ ID NO: 2134 - RNA, 19 nt, Artificial Sequence
  RNA Oligomer
gcuuuuauccacuggcauu

SEQ ID NO: 2135 - RNA, 19 nt, Artificial Sequence
  RNA Oligomer
acuuuguuuuuccaugugu

SEQ ID NO: 2136 - RNA, 19 nt, Artificial Sequence
  RNA Oligomer
cuacaauccuaccuuuuga

SEQ ID NO: 2137 - RNA, 19 nt, Artificial Sequence
  RNA Oligomer
cagaaaccuuguuuguuuu

SEQ ID NO: 2138 - RNA, 19 nt, Artificial Sequence
  RNA Oligomer
ccuugaaccucauuaaaug

SEQ ID NO: 2139 - RNA, 19 nt, Artificial Sequence
  RNA Oligomer
acccuucugcuuucuauua

SEQ ID NO: 2140 - RNA, 19 nt, Artificial Sequence
  RNA Oligomer
caaccuagaaaccuuuauc

SEQ ID NO: 2141 - RNA, 19 nt, Artificial Sequence
  RNA Oligomer
cuuugauauuauguggcuu

SEQ ID NO: 2142 - RNA, 19 nt, Artificial Sequence
  RNA Oligomer
cccuagacucuguaaccac

SEQ ID NO: 2143 - RNA, 19 nt, Artificial Sequence
  RNA Oligomer
ccaucaucucugccuuuga

SEQ ID NO: 2144 - RNA, 19 nt, Artificial Sequence
  RNA Oligomer
gcgaauuguuagaacaucu

SEQ ID NO: 2145 - RNA, 19 nt, Artificial Sequence
  RNA Oligomer
cagaauuccaccggugcaa

SEQ ID NO: 2146 - RNA, 19 nt, Artificial Sequence
  RNA Oligomer
acaugcugguuaaggugaa

SEQ ID NO: 2147 - RNA, 19 nt, Artificial Sequence
  RNA Oligomer
ccgacaugcugguuaaggu

SEQ ID NO: 2148 - RNA, 19 nt, Artificial Sequence
  RNA Oligomer
ccguggagaugagacugau

SEQ ID NO: 2149 - RNA, 19 nt, Artificial Sequence
  RNA Oligomer
ccauguucuaugugaccag

SEQ ID NO: 2150 - RNA, 19 nt, Artificial Sequence
  RNA Oligomer
ggaaguauuugagagagag

SEQ ID NO: 2151 - RNA, 19 nt, Artificial Sequence
  RNA Oligomer
caaaaugcuaggccuguag

SEQ ID NO: 2152 - RNA, 19 nt, Artificial Sequence
  RNA Oligomer
cuuuuauccacuggcauuu

SEQ ID NO: 2153 - RNA, 19 nt, Artificial Sequence
  RNA Oligomer
ugcuuuuauccacuggcau

SEQ ID NO: 2154 - RNA, 19 nt, Artificial Sequence
  RNA Oligomer
guguuuugcuuuuauccac

SEQ ID NO: 2155 - RNA, 19 nt, Artificial Sequence
  RNA Oligomer
cauguguuuugcuuuuauc

SEQ ID NO: 2156 - RNA, 19 nt, Artificial Sequence
  RNA Oligomer
augcuacuuuuacuuguuc

SEQ ID NO: 2157 - RNA, 19 nt, Artificial Sequence
  RNA Oligomer
ccucaagucuugacaauuc

SEQ ID NO: 2158 - RNA, 19 nt, Artificial Sequence
  RNA Oligomer
ggugauuucuugcuaagcu

SEQ ID NO: 2159 - RNA, 19 nt, Artificial Sequence
  RNA Oligomer
gaucauguaaaugcucaaa

SEQ ID NO: 2160 - RNA, 19 nt, Artificial Sequence
  RNA Oligomer
ucaaccugcacuucauauc

SEQ ID NO: 2161 - RNA, 19 nt, Artificial Sequence
  RNA Oligomer
ugagcuuuguuacugaaau

SEQ ID NO: 2162 - RNA, 19 nt, Artificial Sequence
  RNA Oligomer
ccuuauugaucuuugccca

SEQ ID NO: 2163 - RNA, 19 nt, Artificial Sequence
  RNA Oligomer
gagccugacaagugaaguu

SEQ ID NO: 2164 - RNA, 19 nt, Artificial Sequence
  RNA Oligomer
ccuuuucugugaagcccuu

SEQ ID NO: 2165 - RNA, 19 nt, Artificial Sequence
  RNA Oligomer
ggagaugucugaauacugc

SEQ ID NO: 2166 - RNA, 19 nt, Artificial Sequence
  RNA Oligomer
ccagacugcacaggaaaug

SEQ ID NO: 2167 - RNA, 19 nt, Artificial Sequence
  RNA Oligomer
ucaucaucaggaaacucua

SEQ ID NO: 2168 - RNA, 19 nt, Artificial Sequence
  RNA Oligomer
cugccaggauuuuguauug

SEQ ID NO: 2169 - RNA, 19 nt, Artificial Sequence
  RNA Oligomer
ccacugccaggauuuugua

SEQ ID NO: 2170 - RNA, 19 nt, Artificial Sequence
  RNA Oligomer
cuaggccuguaguagucaa

SEQ ID NO: 2171 - RNA, 19 nt, Artificial Sequence
  RNA Oligomer
uguuuuuccauguguuuug

SEQ ID NO: 2172 - RNA, 19 nt, Artificial Sequence
  RNA Oligomer
uacuuuguuuuuccaugug

SEQ ID NO: 2173 - RNA, 19 nt, Artificial Sequence
  RNA Oligomer
uagcuacaauccuaccuuu

SEQ ID NO: 2174 - RNA, 19 nt, Artificial Sequence
  RNA Oligomer
uuagcuacaauccuaccuu

SEQ ID NO: 2175 - RNA, 19 nt, Artificial Sequence
  RNA Oligomer
ugggccuucauuaaauguu

SEQ ID NO: 2176 - RNA, 19 nt, Artificial Sequence
  RNA Oligomer
gugguguccuucuuccuca

SEQ ID NO: 2177 - RNA, 19 nt, Artificial Sequence
  RNA Oligomer
aaauggugauuucuugcua

SEQ ID NO: 2178 - RNA, 19 nt, Artificial Sequence
  RNA Oligomer
ugcucaaagauguaaugua

SEQ ID NO: 2179 - RNA, 19 nt, Artificial Sequence
  RNA Oligomer
cugucuagaauccugcuuu

SEQ ID NO: 2180 - RNA, 19 nt, Artificial Sequence
  RNA Oligomer
caggaauguuucagcugca

SEQ ID NO: 2181 - RNA, 19 nt, Artificial Sequence
  RNA Oligomer
ccaggaauguuucagcugc

SEQ ID NO: 2182 - RNA, 19 nt, Artificial Sequence
  RNA Oligomer
ggaggugugauagagccuu

SEQ ID NO: 2183 - RNA, 19 nt, Artificial Sequence
  RNA Oligomer
ugccgguaaagaaaaguug

SEQ ID NO: 2184 - RNA, 19 nt, Artificial Sequence
  RNA Oligomer
ugaugccgguaaagaaaag

SEQ ID NO: 2185 - RNA, 19 nt, Artificial Sequence
  RNA Oligomer
accaaaaauguucuucauc

SEQ ID NO: 2186 - RNA, 19 nt, Artificial Sequence
  RNA Oligomer
caggaaacucuaaaaaaga

SEQ ID NO: 2187 - RNA, 19 nt, Artificial Sequence
  RNA Oligomer
cucaucaucaggaaacucu

SEQ ID NO: 2188 - RNA, 19 nt, Artificial Sequence
  RNA Oligomer
ccauggucccuagcaaaau

SEQ ID NO: 2189 - RNA, 19 nt, Artificial Sequence
  RNA Oligomer
uacaauccuaccuuuugau

SEQ ID NO: 2190 - RNA, 19 nt, Artificial Sequence
  RNA Oligomer
agcuacaauccuaccuuuu

SEQ ID NO: 2191 - RNA, 19 nt, Artificial Sequence
  RNA Oligomer
ccaucauguaccaagugcu

SEQ ID NO: 2192 - RNA, 19 nt, Artificial Sequence
  RNA Oligomer
ccuucuuccucaagucuug

SEQ ID NO: 2193 - RNA, 19 nt, Artificial Sequence
  RNA Oligomer
cuucuaauuuugugcucuu

SEQ ID NO: 2194 - RNA, 19 nt, Artificial Sequence
  RNA Oligomer
gugauuucuugcuaagcuc

SEQ ID NO: 2195 - RNA, 19 nt, Artificial Sequence
  RNA Oligomer
ugguuuaugagaacugguu

SEQ ID NO: 2196 - RNA, 19 nt, Artificial Sequence
  RNA Oligomer
gccauacauguuauuguuu

SEQ ID NO: 2197 - RNA, 19 nt, Artificial Sequence
  RNA Oligomer
cauguaaaugcucaaagau

SEQ ID NO: 2198 - RNA, 19 nt, Artificial Sequence
  RNA Oligomer
acaggaucauguaaaugcu

SEQ ID NO: 2199 - RNA, 19 nt, Artificial Sequence
  RNA Oligomer
gcaaacaugacuagagacg

SEQ ID NO: 2200 - RNA, 19 nt, Artificial Sequence
  RNA Oligomer
ugaagaagcaaacaugacu

SEQ ID NO: 2201 - RNA, 19 nt, Artificial Sequence
  RNA Oligomer
acaucaucaccuuggaaau

SEQ ID NO: 2202 - RNA, 19 nt, Artificial Sequence
  RNA Oligomer
gacauuaucuuuuggcucu

SEQ ID NO: 2203 - RNA, 19 nt, Artificial Sequence
  RNA Oligomer
uccgcccuuuuuguccuag

SEQ ID NO: 2204 - RNA, 19 nt, Artificial Sequence
  RNA Oligomer
uuaguuaagaugucugaga

SEQ ID NO: 2205 - RNA, 19 nt, Artificial Sequence
  RNA Oligomer
cuuuuguagauggcacuuu

SEQ ID NO: 2206 - RNA, 19 nt, Artificial Sequence
  RNA Oligomer
gaaguuguaaacacagugu

SEQ ID NO: 2207 - RNA, 19 nt, Artificial Sequence
  RNA Oligomer
gugaaguuguaaacacagu

SEQ ID NO: 2208 - RNA, 19 nt, Artificial Sequence
  RNA Oligomer
caaggaucgggaagguuau

SEQ ID NO: 2209 - RNA, 19 nt, Artificial Sequence
  RNA Oligomer
augccgguaaagaaaaguu

SEQ ID NO: 2210 - RNA, 19 nt, Artificial Sequence
  RNA Oligomer
cuacagaacaaaccaaaaa

SEQ ID NO: 2211 - RNA, 19 nt, Artificial Sequence
  RNA Oligomer
guggaccacaguacucuag

SEQ ID NO: 2212 - RNA, 19 nt, Artificial Sequence
  RNA Oligomer
gccaggauuuuguauugcc

SEQ ID NO: 2213 - RNA, 19 nt, Artificial Sequence
  RNA Oligomer
uggaaguauuugagagaga

SEQ ID NO: 2214 - RNA, 19 nt, Artificial Sequence
  RNA Oligomer
ggucgacauaguauggaag

SEQ ID NO: 2215 - RNA, 19 nt, Artificial Sequence
  RNA Oligomer
gaagacauaucauguguga

SEQ ID NO: 2216 - RNA, 19 nt, Artificial Sequence
  RNA Oligomer
ucaccaucauguaccaagu

SEQ ID NO: 2217 - RNA, 19 nt, Artificial Sequence
  RNA Oligomer
cuguaaaugagggcagaaa

SEQ ID NO: 2218 - RNA, 19 nt, Artificial Sequence
  RNA Oligomer
ggcuguaaaugagggcaga

SEQ ID NO: 2219 - RNA, 19 nt, Artificial Sequence
  RNA Oligomer
cuaccaggcuguaaaugag

SEQ ID NO: 2220 - RNA, 19 nt, Artificial Sequence
  RNA Oligomer
gucaccacaucuugucuuu

SEQ ID NO: 2221 - RNA, 19 nt, Artificial Sequence
  RNA Oligomer
cucucagcuucuaauuuug

SEQ ID NO: 2222 - RNA, 19 nt, Artificial Sequence
  RNA Oligomer
guaaacucuucaccuuggu

SEQ ID NO: 2223 - RNA, 19 nt, Artificial Sequence
  RNA Oligomer
ccuucugcuuucuauuacc

SEQ ID NO: 2224 - RNA, 19 nt, Artificial Sequence
  RNA Oligomer
gcuuagaacccuucugcuu

SEQ ID NO: 2225 - RNA, 19 nt, Artificial Sequence
  RNA Oligomer
ggaacuccucaacuugcug

SEQ ID NO: 2226 - RNA, 19 nt, Artificial Sequence
  RNA Oligomer
aggaucauguaaaugcuca

SEQ ID NO: 2227 - RNA, 19 nt, Artificial Sequence
  RNA Oligomer
accugcacuucauaucuag

SEQ ID NO: 2228 - RNA, 19 nt, Artificial Sequence
  RNA Oligomer
ucccuuacuauucccacuu

SEQ ID NO: 2229 - RNA, 19 nt, Artificial Sequence
  RNA Oligomer
guuucucugagcuuuguua

SEQ ID NO: 2230 - RNA, 19 nt, Artificial Sequence
  RNA Oligomer
gaagucucaaagaucuuuc

SEQ ID NO: 2231 - RNA, 19 nt, Artificial Sequence
  RNA Oligomer
acauuaucuuuuggcucug

SEQ ID NO: 2232 - RNA, 19 nt, Artificial Sequence
  RNA Oligomer
guaaacacagugugguuau

SEQ ID NO: 2233 - RNA, 19 nt, Artificial Sequence
  RNA Oligomer
ugaaguuguaaacacagug

SEQ ID NO: 2234 - RNA, 19 nt, Artificial Sequence
  RNA Oligomer
gccugacaagugaaguugu

SEQ ID NO: 2235 - RNA, 19 nt, Artificial Sequence
  RNA Oligomer
aggaauguuucagcugcag

SEQ ID NO: 2236 - RNA, 19 nt, Artificial Sequence
  RNA Oligomer
ucuucaggaugcacgguuu

SEQ ID NO: 2237 - RNA, 19 nt, Artificial Sequence
  RNA Oligomer
gugugauagagccuuugau

SEQ ID NO: 2238 - RNA, 19 nt, Artificial Sequence
  RNA Oligomer
agaugucugaauacugcag

SEQ ID NO: 2239 - RNA, 19 nt, Artificial Sequence
  RNA Oligomer
cgacaugcugguuaaggug

SEQ ID NO: 2240 - RNA, 19 nt, Artificial Sequence
  RNA Oligomer
cuguuguugagcgaauugu

SEQ ID NO: 2241 - RNA, 19 nt, Artificial Sequence
  RNA Oligomer
gugaugccgguaaagaaaa

SEQ ID NO: 2242 - RNA, 19 nt, Artificial Sequence
  RNA Oligomer
ggauuuuguauugccaucg

SEQ ID NO: 2243 - RNA, 19 nt, Artificial Sequence
  RNA Oligomer
acugccaggauuuuguauu

SEQ ID NO: 2244 - RNA, 19 nt, Artificial Sequence
  RNA Oligomer
ccuuugggucgacauagua

SEQ ID NO: 2245 - RNA, 19 nt, Artificial Sequence
  RNA Oligomer
cuguaguagucaaggugcu

SEQ ID NO: 2246 - RNA, 19 nt, Artificial Sequence
  RNA Oligomer
ugcuaggccuguaguaguc

SEQ ID NO: 2247 - RNA, 19 nt, Artificial Sequence
  RNA Oligomer
ucaugugugagauaacuuc

SEQ ID NO: 2248 - RNA, 19 nt, Artificial Sequence
  RNA Oligomer
gcuacaauccuaccuuuug

SEQ ID NO: 2249 - RNA, 19 nt, Artificial Sequence
  RNA Oligomer
gcacauagugggccuucau

SEQ ID NO: 2250 - RNA, 19 nt, Artificial Sequence
  RNA Oligomer
caccacaucuugucuuuuc

SEQ ID NO: 2251 - RNA, 19 nt, Artificial Sequence
  RNA Oligomer
gcuucuaauuuugugcucu

SEQ ID NO: 2252 - RNA, 19 nt, Artificial Sequence
  RNA Oligomer
ccuugguuuaugagaacug

SEQ ID NO: 2253 - RNA, 19 nt, Artificial Sequence
  RNA Oligomer
cucuucaccuugguuuaug

SEQ ID NO: 2254 - RNA, 19 nt, Artificial Sequence
  RNA Oligomer
ccugcuuagaacccuucug

SEQ ID NO: 2255 - RNA, 19 nt, Artificial Sequence
  RNA Oligomer
cugccaccaaaucugucua

SEQ ID NO: 2256 - RNA, 19 nt, Artificial Sequence
  RNA Oligomer
cucugagcuuuguuacuga

SEQ ID NO: 2257 - RNA, 19 nt, Artificial Sequence
  RNA Oligomer
cguugguuguuucucugag

SEQ ID NO: 2258 - RNA, 19 nt, Artificial Sequence
  RNA Oligomer
aggacacucuuggcucguu

SEQ ID NO: 2259 - RNA, 19 nt, Artificial Sequence
  RNA Oligomer
ugacuagagacgcaccuug

SEQ ID NO: 2260 - RNA, 19 nt, Artificial Sequence
  RNA Oligomer
ucauauccuccgcccuuuu

SEQ ID NO: 2261 - RNA, 19 nt, Artificial Sequence
  RNA Oligomer
gcuuuuguagauggcacuu

SEQ ID NO: 2262 - RNA, 19 nt, Artificial Sequence
  RNA Oligomer
agcuuuuguagauggcacu

SEQ ID NO: 2263 - RNA, 19 nt, Artificial Sequence
  RNA Oligomer
cagcuuuuguagauggcac

SEQ ID NO: 2264 - RNA, 19 nt, Artificial Sequence
  RNA Oligomer
cugacaagugaaguuguaa

SEQ ID NO: 2265 - RNA, 19 nt, Artificial Sequence
  RNA Oligomer
agccugacaagugaaguug

SEQ ID NO: 2266 - RNA, 19 nt, Artificial Sequence
  RNA Oligomer
agcgaauuguuagaacauc

SEQ ID NO: 2267 - RNA, 19 nt, Artificial Sequence
  RNA Oligomer
gcacuuaucaaggaucggg

SEQ ID NO: 2268 - RNA, 19 nt, Artificial Sequence
  RNA Oligomer
gcuguuguugagcgaauug

SEQ ID NO: 2269 - RNA, 19 nt, Artificial Sequence
  RNA Oligomer
ccagcuccaagagguuuuu

SEQ ID NO: 2270 - RNA, 19 nt, Artificial Sequence
  RNA Oligomer
accagacugcacaggaaau

SEQ ID NO: 2271 - RNA, 19 nt, Artificial Sequence
  RNA Oligomer
gaccagacugcacaggaaa

SEQ ID NO: 2272 - RNA, 19 nt, Artificial Sequence
  RNA Oligomer
acguccauguucuauguga

SEQ ID NO: 2273 - RNA, 19 nt, Artificial Sequence
  RNA Oligomer
uggagagaaagaacuggaa

SEQ ID NO: 2274 - RNA, 19 nt, Artificial Sequence
  RNA Oligomer
acgcaggauauugggagug

SEQ ID NO: 2275 - RNA, 19 nt, Artificial Sequence
  RNA Oligomer
aggauuuuguauugccauc

SEQ ID NO: 2276 - RNA, 19 nt, Artificial Sequence
  RNA Oligomer
caggauuuuguauugccau

SEQ ID NO: 2277 - RNA, 19 nt, Artificial Sequence
  RNA Oligomer
ugggucgacauaguaugga

SEQ ID NO: 2278 - RNA, 19 nt, Artificial Sequence
  RNA Oligomer
auauuuguuugggugguuu

SEQ ID NO: 2279 - RNA, 19 nt, Artificial Sequence
  RNA Oligomer
guagucaaggugcucaaua

SEQ ID NO: 2280 - RNA, 19 nt, Artificial Sequence
  RNA Oligomer
guaguagucaaggugcuca

SEQ ID NO: 2281 - RNA, 19 nt, Artificial Sequence
  RNA Oligomer
gacgcaggauauugggagu

SEQ ID NO: 2282 - RNA, 19 nt, Artificial Sequence
  RNA Oligomer
ugaagacauaucaugugug

SEQ ID NO: 2283 - RNA, 19 nt, Artificial Sequence
  RNA Oligomer
gcuccuugaagacauauca

SEQ ID NO: 2284 - RNA, 19 nt, Artificial Sequence
  RNA Oligomer
accuuagcuacaauccuac

SEQ ID NO: 2285 - RNA, 19 nt, Artificial Sequence
  RNA Oligomer
aaccuuagcuacaauccua

SEQ ID NO: 2286 - RNA, 19 nt, Artificial Sequence
  RNA Oligomer
ccugagcagucuacuucug

SEQ ID NO: 2287 - RNA, 19 nt, Artificial Sequence
  RNA Oligomer
caccuugguuuaugagaac

SEQ ID NO: 2288 - RNA, 19 nt, Artificial Sequence
  RNA Oligomer
aaacucuucaccuugguuu

SEQ ID NO: 2289 - RNA, 19 nt, Artificial Sequence
  RNA Oligomer
cccugcuuagaacccuucu

SEQ ID NO: 2290 - RNA, 19 nt, Artificial Sequence
  RNA Oligomer
cugcuuucucuuucaguau

SEQ ID NO: 2291 - RNA, 19 nt, Artificial Sequence
  RNA Oligomer
aguucuuuguuccugcuuu

SEQ ID NO: 2292 - RNA, 19 nt, Artificial Sequence
  RNA Oligomer
guaguucuuuguuccugcu

SEQ ID NO: 2293 - RNA, 19 nt, Artificial Sequence
  RNA Oligomer
ccuuacuauucccacuuuc

SEQ ID NO: 2294 - RNA, 19 nt, Artificial Sequence
  RNA Oligomer
ucugagcuuuguuacugaa

SEQ ID NO: 2295 - RNA, 19 nt, Artificial Sequence
  RNA Oligomer
uggaagucucaaagaucuu

SEQ ID NO: 2296 - RNA, 19 nt, Artificial Sequence
  RNA Oligomer
uucuggagaaggacaucau

SEQ ID NO: 2297 - RNA, 19 nt, Artificial Sequence
  RNA Oligomer
uguaaacacagugugguua

SEQ ID NO: 2298 - RNA, 19 nt, Artificial Sequence
  RNA Oligomer
gagcgaauuguuagaacau

SEQ ID NO: 2299 - RNA, 19 nt, Artificial Sequence
  RNA Oligomer
cacuuaucaaggaucggga

SEQ ID NO: 2300 - RNA, 19 nt, Artificial Sequence
  RNA Oligomer
cugguacaucgaggcucuu

SEQ ID NO: 2301 - RNA, 19 nt, Artificial Sequence
  RNA Oligomer
cccaagccuacagaacaaa

SEQ ID NO: 2302 - RNA, 19 nt, Artificial Sequence
  RNA Oligomer
uccauguucuaugugacca

SEQ ID NO: 2303 - RNA, 19 nt, Artificial Sequence
  RNA Oligomer
cuaugacguccauguucua

SEQ ID NO: 2304 - RNA, 19 nt, Artificial Sequence
  RNA Oligomer
agaaagaacuggaauuucg

SEQ ID NO: 2305 - RNA, 19 nt, Artificial Sequence
  RNA Oligomer
ucacuggagagaaagaacu

SEQ ID NO: 2306 - RNA, 19 nt, Artificial Sequence
  RNA Oligomer
gccaaauaaaugcucauau

SEQ ID NO: 2307 - RNA, 19 nt, Artificial Sequence
  RNA Oligomer
aaguauuugagagagagaa

SEQ ID NO: 2308 - RNA, 19 nt, Artificial Sequence
  RNA Oligomer
gaaguauuugagagagaga

SEQ ID NO: 2309 - RNA, 19 nt, Artificial Sequence
  RNA Oligomer
uagucaaggugcucaauaa

SEQ ID NO: 2310 - RNA, 19 nt, Artificial Sequence
  RNA Oligomer
uaguagucaaggugcucaa

SEQ ID NO: 2311 - RNA, 19 nt, Artificial Sequence
  RNA Oligomer
gcuguaaaugagggcagaa

SEQ ID NO: 2312 - RNA, 19 nt, Artificial Sequence
  RNA Oligomer
ucaccacaucuugucuuuu

SEQ ID NO: 2313 - RNA, 19 nt, Artificial Sequence
  RNA Oligomer
cccugagcagucuacuucu

SEQ ID NO: 2314 - RNA, 19 nt, Artificial Sequence
  RNA Oligomer
ucccugagcagucuacuuc

SEQ ID NO: 2315 - RNA, 19 nt, Artificial Sequence
  RNA Oligomer
gucccugagcagucuacuu

SEQ ID NO: 2316 - RNA, 19 nt, Artificial Sequence
  RNA Oligomer
cuaauuuugugcucuuucc

SEQ ID NO: 2317 - RNA, 19 nt, Artificial Sequence
  RNA Oligomer
cucagcuucuaauuuugug

SEQ ID NO: 2318 - RNA, 19 nt, Artificial Sequence
  RNA Oligomer
ggucuccucucagcuucua

SEQ ID NO: 2319 - RNA, 19 nt, Artificial Sequence
  RNA Oligomer
accuugguuuaugagaacu

SEQ ID NO: 2320 - RNA, 19 nt, Artificial Sequence
  RNA Oligomer
aucugaaacuucccaacuu

SEQ ID NO: 2321 - RNA, 19 nt, Artificial Sequence
  RNA Oligomer
gcuuaucugaaacuuccca

SEQ ID NO: 2322 - RNA, 19 nt, Artificial Sequence
  RNA Oligomer
ucaguauuaaacucuccuu

SEQ ID NO: 2323 - RNA, 19 nt, Artificial Sequence
  RNA Oligomer
caaagauguaauguaguuc

SEQ ID NO: 2324 - RNA, 19 nt, Artificial Sequence
  RNA Oligomer
ucugucuagaauccugcuu

SEQ ID NO: 2325 - RNA, 19 nt, Artificial Sequence
  RNA Oligomer
agcuuuguuacugaaauga

SEQ ID NO: 2326 - RNA, 19 nt, Artificial Sequence
  RNA Oligomer
cugagcuuuguuacugaaa

SEQ ID NO: 2327 - RNA, 19 nt, Artificial Sequence
  RNA Oligomer
cauuaucuuuuggcucuga

SEQ ID NO: 2328 - RNA, 19 nt, Artificial Sequence
  RNA Oligomer
gaagagccugacaagugaa

SEQ ID NO: 2329 - RNA, 19 nt, Artificial Sequence
  RNA Oligomer
ggaugcacgguuucuguuc

SEQ ID NO: 2330 - RNA, 19 nt, Artificial Sequence
  RNA Oligomer
ugagcgaauuguuagaaca

SEQ ID NO: 2331 - RNA, 19 nt, Artificial Sequence
  RNA Oligomer
cuaugguguggaugggaaa

SEQ ID NO: 2332 - RNA, 19 nt, Artificial Sequence
  RNA Oligomer
guauggaaguauuugagag

SEQ ID NO: 2333 - RNA, 19 nt, Artificial Sequence
  RNA Oligomer
ugaauaaaagagggaagaa

SEQ ID NO: 2334 - RNA, 19 nt, Artificial Sequence
  RNA Oligomer
uguugaauaaaagagggaa

SEQ ID NO: 2335 - RNA, 19 nt, Artificial Sequence
  RNA Oligomer
uagugggccuucauuaaau

SEQ ID NO: 2336 - RNA, 19 nt, Artificial Sequence
  RNA Oligomer
aggcuguaaaugagggcag

SEQ ID NO: 2337 - RNA, 19 nt, Artificial Sequence
  RNA Oligomer
cuuaucugaaacuucccaa

SEQ ID NO: 2338 - RNA, 19 nt, Artificial Sequence
  RNA Oligomer
uucauauccuccgcccuuu

SEQ ID NO: 2339 - RNA, 19 nt, Artificial Sequence
  RNA Oligomer
guugagcgaauuguuagaa

SEQ ID NO: 2340 - RNA, 19 nt, Artificial Sequence
  RNA Oligomer
acagaacaaaccaaaaaug

SEQ ID NO: 2341 - RNA, 19 nt, Artificial Sequence
  RNA Oligomer
ugguguggaugggaaacug

SEQ ID NO: 2342 - RNA, 19 nt, Artificial Sequence
  RNA Oligomer
ucuaugguguggaugggaa

SEQ ID NO: 2343 - RNA, 19 nt, Artificial Sequence
  RNA Oligomer
ugcacuucacuggagagaa

SEQ ID NO: 2344 - RNA, 19 nt, Artificial Sequence
  RNA Oligomer
ucaucaggaaacucuaaaa

SEQ ID NO: 2345 - RNA, 19 nt, Artificial Sequence
  RNA Oligomer
acaucucccauggucccua

SEQ ID NO: 2346 - RNA, 19 nt, Artificial Sequence
  RNA Oligomer
gaauaaaagagggaagaag

SEQ ID NO: 2347 - RNA, 19 nt, Artificial Sequence
  RNA Oligomer
caggauuugguuguuuaaa

SEQ ID NO: 2348 - RNA, 19 nt, Artificial Sequence
  RNA Oligomer
guucuuuguuccugcuuuc

SEQ ID NO: 2349 - RNA, 19 nt, Artificial Sequence
  RNA Oligomer
cucccuuacuauucccacu

SEQ ID NO: 2350 - RNA, 19 nt, Artificial Sequence
  RNA Oligomer
gguguccaaauuuaaugua

SEQ ID NO: 2351 - RNA, 19 nt, Artificial Sequence
  RNA Oligomer
gccuugguuggaccuauug

SEQ ID NO: 2352 - RNA, 19 nt, Artificial Sequence
  RNA Oligomer
ggugugauagagccuuuga

SEQ ID NO: 2353 - RNA, 19 nt, Artificial Sequence
  RNA Oligomer
aggugugauagagccuuug

SEQ ID NO: 2354 - RNA, 19 nt, Artificial Sequence
  RNA Oligomer
cuggagagaaagaacugga

SEQ ID NO: 2355 - RNA, 19 nt, Artificial Sequence
  RNA Oligomer
cuccugaauuuuaucaaac

SEQ ID NO: 2356 - RNA, 19 nt, Artificial Sequence
  RNA Oligomer
cacuccugaauuuuaucaa

SEQ ID NO: 2357 - RNA, 19 nt, Artificial Sequence
  RNA Oligomer
gcacuccugaauuuuauca

SEQ ID NO: 2358 - RNA, 19 nt, Artificial Sequence
  RNA Oligomer
ccaaagugggcaguuucag

SEQ ID NO: 2359 - RNA, 19 nt, Artificial Sequence
  RNA Oligomer
gcuuuguuacugaaaugag

SEQ ID NO: 2360 - RNA, 19 nt, Artificial Sequence
  RNA Oligomer
ccaguggaaggacacucuu

SEQ ID NO: 2361 - RNA, 19 nt, Artificial Sequence
  RNA Oligomer
gaauguuucagcugcaguu

SEQ ID NO: 2362 - RNA, 19 nt, Artificial Sequence
  RNA Oligomer
acaggaaaugcaagagaaa

SEQ ID NO: 2363 - RNA, 19 nt, Artificial Sequence
  RNA Oligomer
acauagugggccuucauua

SEQ ID NO: 2364 - RNA, 19 nt, Artificial Sequence
  RNA Oligomer
cacauagugggccuucauu

SEQ ID NO: 2365 - RNA, 19 nt, Artificial Sequence
  RNA Oligomer
ccacaucuugucuuuuccc

SEQ ID NO: 2366 - RNA, 19 nt, Artificial Sequence
  RNA Oligomer
ugcuuucucuuucaguauu

SEQ ID NO: 2367 - RNA, 19 nt, Artificial Sequence
  RNA Oligomer
ugcccauggaagucucaaa

SEQ ID NO: 2368 - RNA, 19 nt, Artificial Sequence
  RNA Oligomer
caucaggaaacucuaaaaa

SEQ ID NO: 2369 - RNA, 19 nt, Artificial Sequence
  RNA Oligomer
ccauucuuucuuccuccag

SEQ ID NO: 2370 - RNA, 19 nt, Artificial Sequence
  RNA Oligomer
uccauucuuucuuccucca

SEQ ID NO: 2371 - RNA, 19 nt, Artificial Sequence
  RNA Oligomer
cccugcuuaucugaaacuu

SEQ ID NO: 2372 - RNA, 19 nt, Artificial Sequence
  RNA Oligomer
gacaagugaaguuguaaac

SEQ ID NO: 2373 - RNA, 19 nt, Artificial Sequence
  RNA Oligomer
gcaagagaaacugcagaau

SEQ ID NO: 2374 - RNA, 19 nt, Artificial Sequence
  RNA Oligomer
ggccuguaguagucaaggu

SEQ ID NO: 2375 - RNA, 19 nt, Artificial Sequence
  RNA Oligomer
gaaaccuuuaucccugcuu

SEQ ID NO: 2376 - RNA, 19 nt, Artificial Sequence
  RNA Oligomer
gguuguuucucugagcuuu

SEQ ID NO: 2377 - RNA, 19 nt, Artificial Sequence
  RNA Oligomer
guguccaaauuuaauguag

SEQ ID NO: 2378 - RNA, 19 nt, Artificial Sequence
  RNA Oligomer
ggaauguuucagcugcagu

SEQ ID NO: 2379 - RNA, 19 nt, Artificial Sequence
  RNA Oligomer
uggccgacaugcugguuaa

SEQ ID NO: 2380 - RNA, 19 nt, Artificial Sequence
  RNA Oligomer
cagcuguuguugagcgaau

SEQ ID NO: 2381 - RNA, 19 nt, Artificial Sequence
  RNA Oligomer
gaauuuugcacaguuaccu

SEQ ID NO: 2382 - RNA, 19 nt, Artificial Sequence
  RNA Oligomer
cucaggugguguccuucuu

SEQ ID NO: 2383 - RNA, 19 nt, Artificial Sequence
  RNA Oligomer
agauggcacuuuagugauu

SEQ ID NO: 2384 - RNA, 19 nt, Artificial Sequence
  RNA Oligomer
agccuuugaucuucaggau

SEQ ID NO: 2385 - RNA, 19 nt, Artificial Sequence
  RNA Oligomer
guaaagaaaaguugccgaa

SEQ ID NO: 2386 - RNA, 19 nt, Artificial Sequence
  RNA Oligomer
ggaaacucuaaaaaagaac

SEQ ID NO: 2387 - RNA, 19 nt, Artificial Sequence
  RNA Oligomer
gcauccucaucaucaggaa

SEQ ID NO: 2388 - RNA, 19 nt, Artificial Sequence
  RNA Oligomer
ucaaggugcucaauaaaua

SEQ ID NO: 2389 - RNA, 19 nt, Artificial Sequence
  RNA Oligomer
ugugugagauaacuuccuu

SEQ ID NO: 2390 - RNA, 19 nt, Artificial Sequence
  RNA Oligomer
agaaugguguguuucccua

SEQ ID NO: 2391 - RNA, 19 nt, Artificial Sequence
  RNA Oligomer
cgcccuuuuuguccuagag

SEQ ID NO: 2392 - RNA, 19 nt, Artificial Sequence
  RNA Oligomer
uggagaaggacaucaucac

SEQ ID NO: 2393 - RNA, 19 nt, Artificial Sequence
  RNA Oligomer
ggcacuuuagugauugcuu

SEQ ID NO: 2394 - RNA, 19 nt, Artificial Sequence
  RNA Oligomer
agccuugguuggaccuauu

SEQ ID NO: 2395 - RNA, 19 nt, Artificial Sequence
  RNA Oligomer
agccuacagaacaaaccaa

SEQ ID NO: 2396 - RNA, 19 nt, Artificial Sequence
  RNA Oligomer
guacucuagucacccucuu

SEQ ID NO: 2397 - RNA, 19 nt, Artificial Sequence
  RNA Oligomer
gugugagauaacuuccuuc

SEQ ID NO: 2398 - RNA, 19 nt, Artificial Sequence
  RNA Oligomer
gagggcagaaaccuuguuu

SEQ ID NO: 2399 - RNA, 19 nt, Artificial Sequence
  RNA Oligomer
ccaagcuuuugaugccuuc

SEQ ID NO: 2400 - RNA, 19 nt, Artificial Sequence
  RNA Oligomer
gcaguuucagccagaaugu

SEQ ID NO: 2401 - RNA, 19 nt, Artificial Sequence
  RNA Oligomer
ugguuguuucucugagcuu

SEQ ID NO: 2402 - RNA, 19 nt, Artificial Sequence
  RNA Oligomer
agguguccaaauuuaaugu

SEQ ID NO: 2403 - RNA, 19 nt, Artificial Sequence
  RNA Oligomer
cccuuuuuguccuagagug

SEQ ID NO: 2404 - RNA, 19 nt, Artificial Sequence
  RNA Oligomer
gcacuuuagugauugcuuu

SEQ ID NO: 2405 - RNA, 19 nt, Artificial Sequence
  RNA Oligomer
ggcucuugcucaaguguuu

SEQ ID NO: 2406 - RNA, 19 nt, Artificial Sequence
  RNA Oligomer
ggaacaccaaacgagguuc

SEQ ID NO: 2407 - RNA, 19 nt, Artificial Sequence
  RNA Oligomer
cggaacaccaaacgagguu

SEQ ID NO: 2408 - RNA, 19 nt, Artificial Sequence
  RNA Oligomer
ggauguggaccacaguacu

SEQ ID NO: 2409 - RNA, 19 nt, Artificial Sequence
  RNA Oligomer
gccaucgggugccaaauaa

SEQ ID NO: 2410 - RNA, 19 nt, Artificial Sequence
  RNA Oligomer
ugagggcagaaaccuuguu

SEQ ID NO: 2411 - RNA, 19 nt, Artificial Sequence
  RNA Oligomer
gcucuuuccugcccuuuuc

SEQ ID NO: 2412 - RNA, 19 nt, Artificial Sequence
  RNA Oligomer
cuccucucagcuucuaauu

SEQ ID NO: 2413 - RNA, 19 nt, Artificial Sequence
  RNA Oligomer
accucauuaaauggugauu

SEQ ID NO: 2414 - RNA, 19 nt, Artificial Sequence
  RNA Oligomer
gaaccucauuaaaugguga

SEQ ID NO: 2415 - RNA, 19 nt, Artificial Sequence
  RNA Oligomer
ggccaggauuugguuguuu

SEQ ID NO: 2416 - RNA, 19 nt, Artificial Sequence
  RNA Oligomer
uccagucuguucucacaua

SEQ ID NO: 2417 - RNA, 19 nt, Artificial Sequence
  RNA Oligomer
ugggcaguuucagccagaa

SEQ ID NO: 2418 - RNA, 19 nt, Artificial Sequence
  RNA Oligomer
ggaccuauugccaggaaug

SEQ ID NO: 2419 - RNA, 19 nt, Artificial Sequence
  RNA Oligomer
caaacgagguuccugguac

SEQ ID NO: 2420 - RNA, 19 nt, Artificial Sequence
  RNA Oligomer
ccaaaaauguucuucaucc

SEQ ID NO: 2421 - RNA, 19 nt, Artificial Sequence
  RNA Oligomer
gcuagccaaacagcuguug

SEQ ID NO: 2422 - RNA, 19 nt, Artificial Sequence
  RNA Oligomer
cucuuugacaacgccaacu

SEQ ID NO: 2423 - RNA, 19 nt, Artificial Sequence
  RNA Oligomer
ucaggaaacucuaaaaaag

SEQ ID NO: 2424 - RNA, 19 nt, Artificial Sequence
  RNA Oligomer
gugccaaauaaaugcucau

SEQ ID NO: 2425 - RNA, 19 nt, Artificial Sequence
  RNA Oligomer
caaggugcucaauaaauau

SEQ ID NO: 2426 - RNA, 19 nt, Artificial Sequence
  RNA Oligomer
gucaaggugcucaauaaau

SEQ ID NO: 2427 - RNA, 19 nt, Artificial Sequence
  RNA Oligomer
ggcauuuuuagcuccuuga

SEQ ID NO: 2428 - RNA, 19 nt, Artificial Sequence
  RNA Oligomer
cauugcauuuauugcaguu

SEQ ID NO: 2429 - RNA, 19 nt, Artificial Sequence
  RNA Oligomer
ucauugcauuuauugcagu

SEQ ID NO: 2430 - RNA, 19 nt, Artificial Sequence
  RNA Oligomer
gucuacuucugugucuguc

SEQ ID NO: 2431 - RNA, 19 nt, Artificial Sequence
  RNA Oligomer
ugacucaggugguguccuu

SEQ ID NO: 2432 - RNA, 19 nt, Artificial Sequence
  RNA Oligomer
cccaagcuuuugaugccuu

SEQ ID NO: 2433 - RNA, 19 nt, Artificial Sequence
  RNA Oligomer
agaaaccuuuaucccugcu

SEQ ID NO: 2434 - RNA, 19 nt, Artificial Sequence
  RNA Oligomer
ccagaauguggaacuccuc

SEQ ID NO: 2435 - RNA, 19 nt, Artificial Sequence
  RNA Oligomer
ucagccagaauguggaacu

SEQ ID NO: 2436 - RNA, 19 nt, Artificial Sequence
  RNA Oligomer
gcccuuuuuguccuagagu

SEQ ID NO: 2437 - RNA, 19 nt, Artificial Sequence
  RNA Oligomer
gagaccaucuccuaucuuu

SEQ ID NO: 2438 - RNA, 19 nt, Artificial Sequence
  RNA Oligomer
ccaaacgagguuccuggua

SEQ ID NO: 2439 - RNA, 19 nt, Artificial Sequence
  RNA Oligomer
gguaaagaaaaguugccga

SEQ ID NO: 2440 - RNA, 19 nt, Artificial Sequence
  RNA Oligomer
cuucaagcuuuugggcuau

SEQ ID NO: 2441 - RNA, 19 nt, Artificial Sequence
  RNA Oligomer
ccugaauuuuaucaaacac

SEQ ID NO: 2442 - RNA, 19 nt, Artificial Sequence
  RNA Oligomer
gccuuugggucgacauagu

SEQ ID NO: 2443 - RNA, 19 nt, Artificial Sequence
  RNA Oligomer
uuagcuccuugaagacaua

SEQ ID NO: 2444 - RNA, 19 nt, Artificial Sequence
  RNA Oligomer
agggcagaaaccuuguuug

SEQ ID NO: 2445 - RNA, 19 nt, Artificial Sequence
  RNA Oligomer
gugucugucaccacaucuu

SEQ ID NO: 2446 - RNA, 19 nt, Artificial Sequence
  RNA Oligomer
ucuccucucagcuucuaau

SEQ ID NO: 2447 - RNA, 19 nt, Artificial Sequence
  RNA Oligomer
cacauaacagaguaguuuu

SEQ ID NO: 2448 - RNA, 19 nt, Artificial Sequence
  RNA Oligomer
cuagaaaccuuuaucccug

SEQ ID NO: 2449 - RNA, 19 nt, Artificial Sequence
  RNA Oligomer
gaauguggaacuccucaac

SEQ ID NO: 2450 - RNA, 19 nt, Artificial Sequence
  RNA Oligomer
cuuuacaggaucauguaaa

SEQ ID NO: 2451 - RNA, 19 nt, Artificial Sequence
  RNA Oligomer
cagccagaauguggaacuc

SEQ ID NO: 2452 - RNA, 19 nt, Artificial Sequence
  RNA Oligomer
gaaaagcuuccuagcuuau

SEQ ID NO: 2453 - RNA, 19 nt, Artificial Sequence
  RNA Oligomer
aggccaaagugggcaguuu

SEQ ID NO: 2454 - RNA, 19 nt, Artificial Sequence
  RNA Oligomer
ugguguguuucccuagacu

SEQ ID NO: 2455 - RNA, 19 nt, Artificial Sequence
  RNA Oligomer
uggcacuuuagugauugcu

SEQ ID NO: 2456 - RNA, 19 nt, Artificial Sequence
  RNA Oligomer
agcuguuguugagcgaauu

SEQ ID NO: 2457 - RNA, 19 nt, Artificial Sequence
  RNA Oligomer
acagcuguuguugagcgaa

SEQ ID NO: 2458 - RNA, 19 nt, Artificial Sequence
  RNA Oligomer
caaaaauguucuucaucca

SEQ ID NO: 2459 - RNA, 19 nt, Artificial Sequence
  RNA Oligomer
ccacaguacucuagucacc

SEQ ID NO: 2460 - RNA, 19 nt, Artificial Sequence
  RNA Oligomer
aucaucaggaaacucuaaa

SEQ ID NO: 2461 - RNA, 19 nt, Artificial Sequence
  RNA Oligomer
gggugccaaauaaaugcuc

SEQ ID NO: 2462 - RNA, 19 nt, Artificial Sequence
  RNA Oligomer
gccuguaguagucaaggug

SEQ ID NO: 2463 - RNA, 19 nt, Artificial Sequence
  RNA Oligomer
ccuaccuuuugauaaaaug

SEQ ID NO: 2464 - RNA, 19 nt, Artificial Sequence
  RNA Oligomer
ggcagaaaccuuguuuguu

SEQ ID NO: 2465 - RNA, 19 nt, Artificial Sequence
  RNA Oligomer
cagucuacuucugugucug

SEQ ID NO: 2466 - RNA, 19 nt, Artificial Sequence
  RNA Oligomer
guucucacauaacagagua

SEQ ID NO: 2467 - RNA, 19 nt, Artificial Sequence
  RNA Oligomer
gccagaauguggaacuccu

SEQ ID NO: 2468 - RNA, 19 nt, Artificial Sequence
  RNA Oligomer
gcuuuacaggaucauguaa

SEQ ID NO: 2469 - RNA, 19 nt, Artificial Sequence
  RNA Oligomer
gggcaguuucagccagaau

SEQ ID NO: 2470 - RNA, 19 nt, Artificial Sequence
  RNA Oligomer
ugcguucccuucaguacug

SEQ ID NO: 2471 - RNA, 19 nt, Artificial Sequence
  RNA Oligomer
guccaaauuuaauguagac

SEQ ID NO: 2472 - RNA, 19 nt, Artificial Sequence
  RNA Oligomer
uggaagguguccaaauuua

SEQ ID NO: 2473 - RNA, 19 nt, Artificial Sequence
  RNA Oligomer
agaaggacaucaucaccuu

SEQ ID NO: 2474 - RNA, 19 nt, Artificial Sequence
  RNA Oligomer
agaccaucuccuaucuuuu

SEQ ID NO: 2475 - RNA, 19 nt, Artificial Sequence
  RNA Oligomer
gguuaaggugaacgcacuu

SEQ ID NO: 2476 - RNA, 19 nt, Artificial Sequence
  RNA Oligomer
aggcucuugcucaaguguu

SEQ ID NO: 2477 - RNA, 19 nt, Artificial Sequence
  RNA Oligomer
caaaccaaaaauguucuuc

SEQ ID NO: 2478 - RNA, 19 nt, Artificial Sequence
  RNA Oligomer
ccaagccuacagaacaaac

SEQ ID NO: 2479 - RNA, 19 nt, Artificial Sequence
  RNA Oligomer
ugcuagccaaacagcuguu

SEQ ID NO: 2480 - RNA, 19 nt, Artificial Sequence
  RNA Oligomer
ugcagaauuuugcacaguu

SEQ ID NO: 2481 - RNA, 19 nt, Artificial Sequence
  RNA Oligomer
ucaagcuuuugggcuauga

SEQ ID NO: 2482 - RNA, 19 nt, Artificial Sequence
  RNA Oligomer
cucuaaaaaagaaccgagu

SEQ ID NO: 2483 - RNA, 19 nt, Artificial Sequence
  RNA Oligomer
gaacuggaauuucgcucug

SEQ ID NO: 2484 - RNA, 19 nt, Artificial Sequence
  RNA Oligomer
aagccuugcacuccugaau

SEQ ID NO: 2485 - RNA, 19 nt, Artificial Sequence
  RNA Oligomer
uccucaucaucaggaaacu

SEQ ID NO: 2486 - RNA, 19 nt, Artificial Sequence
  RNA Oligomer
ggugccaaauaaaugcuca

SEQ ID NO: 2487 - RNA, 19 nt, Artificial Sequence
  RNA Oligomer
ugggugguuugugagccuu

SEQ ID NO: 2488 - RNA, 19 nt, Artificial Sequence
  RNA Oligomer
ccaagugcuuggcacauag

SEQ ID NO: 2489 - RNA, 19 nt, Artificial Sequence
  RNA Oligomer
accaagugcuuggcacaua

SEQ ID NO: 2490 - RNA, 19 nt, Artificial Sequence
  RNA Oligomer
gcagucuacuucugugucu

SEQ ID NO: 2491 - RNA, 19 nt, Artificial Sequence
  RNA Oligomer
guguccuucuuccucaagu

SEQ ID NO: 2492 - RNA, 19 nt, Artificial Sequence
  RNA Oligomer
uccucucagcuucuaauuu

SEQ ID NO: 2493 - RNA, 19 nt, Artificial Sequence
  RNA Oligomer
gucuccucucagcuucuaa

SEQ ID NO: 2494 - RNA, 19 nt, Artificial Sequence
  RNA Oligomer
uggccaggauuugguuguu

SEQ ID NO: 2495 - RNA, 19 nt, Artificial Sequence
  RNA Oligomer
ucacauaacagaguaguuu

SEQ ID NO: 2496 - RNA, 19 nt, Artificial Sequence
  RNA Oligomer
ccagucuguucucacauaa

SEQ ID NO: 2497 - RNA, 19 nt, Artificial Sequence
  RNA Oligomer
cucuuucaguauuaaacuc

SEQ ID NO: 2498 - RNA, 19 nt, Artificial Sequence
  RNA Oligomer
guuccugcuuucucuuuca

SEQ ID NO: 2499 - RNA, 19 nt, Artificial Sequence
  RNA Oligomer
agaauguggaacuccucaa

SEQ ID NO: 2500 - RNA, 19 nt, Artificial Sequence
  RNA Oligomer
ugcuuuacaggaucaugua

SEQ ID NO: 2501 - RNA, 19 nt, Artificial Sequence
  RNA Oligomer
agaaaagcuuccuagcuua

SEQ ID NO: 2502 - RNA, 19 nt, Artificial Sequence
  RNA Oligomer
ggcaguuucagccagaaug

SEQ ID NO: 2503 - RNA, 19 nt, Artificial Sequence
  RNA Oligomer
agagaccaucuccuaucuu

SEQ ID NO: 2504 - RNA, 19 nt, Artificial Sequence
  RNA Oligomer
cagcuccuuuucugugaag

SEQ ID NO: 2505 - RNA, 19 nt, Artificial Sequence
  RNA Oligomer
aggugaacgcacuuaucaa

SEQ ID NO: 2506 - RNA, 19 nt, Artificial Sequence
  RNA Oligomer
guuaaggugaacgcacuua

SEQ ID NO: 2507 - RNA, 19 nt, Artificial Sequence
  RNA Oligomer
auaugcacguggccgacau

SEQ ID NO: 2508 - RNA, 19 nt, Artificial Sequence
  RNA Oligomer
ugaccaacaagauggaaag

SEQ ID NO: 2509 - RNA, 19 nt, Artificial Sequence
  RNA Oligomer
uagccaaacagcuguuguu

SEQ ID NO: 2510 - RNA, 19 nt, Artificial Sequence
  RNA Oligomer
gaacaaaccaaaaauguuc

SEQ ID NO: 2511 - RNA, 19 nt, Artificial Sequence
  RNA Oligomer
agcucuuugacaacgccaa

SEQ ID NO: 2512 - RNA, 19 nt, Artificial Sequence
  RNA Oligomer
uccagcuccaagagguuuu

SEQ ID NO: 2513 - RNA, 19 nt, Artificial Sequence
  RNA Oligomer
gaccacaguacucuaguca

SEQ ID NO: 2514 - RNA, 19 nt, Artificial Sequence
  RNA Oligomer
uguugagcaaugugcacuu

SEQ ID NO: 2515 - RNA, 19 nt, Artificial Sequence
  RNA Oligomer
uagcacugguguugagcaa

SEQ ID NO: 2516 - RNA, 19 nt, Artificial Sequence
  RNA Oligomer
gaagccuugcacuccugaa

SEQ ID NO: 2517 - RNA, 19 nt, Artificial Sequence
  RNA Oligomer
ugccaaauaaaugcucaua

SEQ ID NO: 2518 - RNA, 19 nt, Artificial Sequence
  RNA Oligomer
ccaucgggugccaaauaaa

SEQ ID NO: 2519 - RNA, 19 nt, Artificial Sequence
  RNA Oligomer
uccuugaagacauaucaug

SEQ ID NO: 2520 - RNA, 19 nt, Artificial Sequence
  RNA Oligomer
acaauccuaccuuuugaua

SEQ ID NO: 2521 - RNA, 19 nt, Artificial Sequence
  RNA Oligomer
ggcaagccaaccuuagcua

SEQ ID NO: 2522 - RNA, 19 nt, Artificial Sequence
  RNA Oligomer
gggcagaaaccuuguuugu

SEQ ID NO: 2523 - RNA, 19 nt, Artificial Sequence
  RNA Oligomer
cccuaccaggcuguaaaug

SEQ ID NO: 2524 - RNA, 19 nt, Artificial Sequence
  RNA Oligomer
ugagcagucuacuucugug

SEQ ID NO: 2525 - RNA, 19 nt, Artificial Sequence
  RNA Oligomer
uuccucaagucuugacaau

SEQ ID NO: 2526 - RNA, 19 nt, Artificial Sequence
  RNA Oligomer
uccuucuuccucaagucuu

SEQ ID NO: 2527 - RNA, 19 nt, Artificial Sequence
  RNA Oligomer
aaccucauuaaauggugau

SEQ ID NO: 2528 - RNA, 19 nt, Artificial Sequence
  RNA Oligomer
ugaaccucauuaaauggug

SEQ ID NO: 2529 - RNA, 19 nt, Artificial Sequence
  RNA Oligomer
gagaacugguucuugccuu

SEQ ID NO: 2530 - RNA, 19 nt, Artificial Sequence
  RNA Oligomer
gccaggauuugguuguuua

SEQ ID NO: 2531 - RNA, 19 nt, Artificial Sequence
  RNA Oligomer
ccugcuuaucugaaacuuc

SEQ ID NO: 2532 - RNA, 19 nt, Artificial Sequence
  RNA Oligomer
uggaacuccucaacuugcu

SEQ ID NO: 2533 - RNA, 19 nt, Artificial Sequence
  RNA Oligomer
cugcuuuacaggaucaugu

SEQ ID NO: 2534 - RNA, 19 nt, Artificial Sequence
  RNA Oligomer
uccugcuuuacaggaucau

SEQ ID NO: 2535 - RNA, 19 nt, Artificial Sequence
  RNA Oligomer
gaauccugcuuuacaggau

SEQ ID NO: 2536 - RNA, 19 nt, Artificial Sequence
  RNA Oligomer
gccaccaaaucugucuaga

SEQ ID NO: 2537 - RNA, 19 nt, Artificial Sequence
  RNA Oligomer
ucaucaccuuggaaaugag

SEQ ID NO: 2538 - RNA, 19 nt, Artificial Sequence
  RNA Oligomer
caguugaagagccugacaa

SEQ ID NO: 2539 - RNA, 19 nt, Artificial Sequence
  RNA Oligomer
cagccuugguuggaccuau

SEQ ID NO: 2540 - RNA, 19 nt, Artificial Sequence
  RNA Oligomer
gccuuugaucuucaggaug

SEQ ID NO: 2541 - RNA, 19 nt, Artificial Sequence
  RNA Oligomer
ccgguaaagaaaaguugcc

SEQ ID NO: 2542 - RNA, 19 nt, Artificial Sequence
  RNA Oligomer
acaguuaccugcacaccga

SEQ ID NO: 2543 - RNA, 19 nt, Artificial Sequence
  RNA Oligomer
gggcuaugacguccauguu

SEQ ID NO: 2544 - RNA, 19 nt, Artificial Sequence
  RNA Oligomer
acaguacucuagucacccu

SEQ ID NO: 2545 - RNA, 19 nt, Artificial Sequence
  RNA Oligomer
agaacuggaauuucgcucu

SEQ ID NO: 2546 - RNA, 19 nt, Artificial Sequence
  RNA Oligomer
cccacugccaggauuuugu

SEQ ID NO: 2547 - RNA, 19 nt, Artificial Sequence
  RNA Oligomer
agagagagaaccuuuccac

SEQ ID NO: 2548 - RNA, 19 nt, Artificial Sequence
  RNA Oligomer
cuagcaaaaugcuaggccu

SEQ ID NO: 2549 - RNA, 19 nt, Artificial Sequence
  RNA Oligomer
caauccuaccuuuugauaa

SEQ ID NO: 2550 - RNA, 19 nt, Artificial Sequence
  RNA Oligomer
gcaagccaaccuuagcuac

SEQ ID NO: 2551 - RNA, 19 nt, Artificial Sequence
  RNA Oligomer
gagcagucuacuucugugu

SEQ ID NO: 2552 - RNA, 19 nt, Artificial Sequence
  RNA Oligomer
uccucaagucuugacaauu

SEQ ID NO: 2553 - RNA, 19 nt, Artificial Sequence
  RNA Oligomer
agcuuuugaugccuucugu

SEQ ID NO: 2554 - RNA, 19 nt, Artificial Sequence
  RNA Oligomer
ucaccuugguuuaugagaa

SEQ ID NO: 2555 - RNA, 19 nt, Artificial Sequence
  RNA Oligomer
agaacccuucugcuuucua

SEQ ID NO: 2556 - RNA, 19 nt, Artificial Sequence
  RNA Oligomer
ucccugcuuaucugaaacu

SEQ ID NO: 2557 - RNA, 19 nt, Artificial Sequence
  RNA Oligomer
ccugcuuucucuuucagua

SEQ ID NO: 2558 - RNA, 19 nt, Artificial Sequence
  RNA Oligomer
cuagaauccugcuuuacag

SEQ ID NO: 2559 - RNA, 19 nt, Artificial Sequence
  RNA Oligomer
ccagcuuuuguagauggca

SEQ ID NO: 2560 - RNA, 19 nt, Artificial Sequence
  RNA Oligomer
aguuccagcuuuuguagau

SEQ ID NO: 2561 - RNA, 19 nt, Artificial Sequence
  RNA Oligomer
cugcagaauuuugcacagu

SEQ ID NO: 2562 - RNA, 19 nt, Artificial Sequence
  RNA Oligomer
ugcauccucaucaucagga

SEQ ID NO: 2563 - RNA, 19 nt, Artificial Sequence
  RNA Oligomer
cugccuuugggucgacaua

SEQ ID NO: 2564 - RNA, 19 nt, Artificial Sequence
  RNA Oligomer
cccauggucccuagcaaaa

SEQ ID NO: 2565 - RNA, 19 nt, Artificial Sequence
  RNA Oligomer
ucccauggucccuagcaaa

SEQ ID NO: 2566 - RNA, 19 nt, Artificial Sequence
  RNA Oligomer
cuggcauuuuuagcuccuu

SEQ ID NO: 2567 - RNA, 19 nt, Artificial Sequence
  RNA Oligomer
ccucauugcauuuauugca

SEQ ID NO: 2568 - RNA, 19 nt, Artificial Sequence
  RNA Oligomer
ugugcucuuuccugcccuu

SEQ ID NO: 2569 - RNA, 19 nt, Artificial Sequence
  RNA Oligomer
agcuucuaauuuugugcuc

SEQ ID NO: 2570 - RNA, 19 nt, Artificial Sequence
  RNA Oligomer
ccaggauuugguuguuuaa

SEQ ID NO: 2571 - RNA, 19 nt, Artificial Sequence
  RNA Oligomer
auaaaagcaaaacacaugg

SEQ ID NO: 2572 - RNA, 19 nt, Artificial Sequence
  RNA Oligomer
auaagguacaaaugcaagg

SEQ ID NO: 2573 - RNA, 19 nt, Artificial Sequence
  RNA Oligomer
aauaaaagauaggagaugg

SEQ ID NO: 2574 - RNA, 19 nt, Artificial Sequence
  RNA Oligomer
uuugguuuguucuguaggc

SEQ ID NO: 2575 - RNA, 19 nt, Artificial Sequence
  RNA Oligomer
uacaggccuagcauuuugc

SEQ ID NO: 2576 - RNA, 19 nt, Artificial Sequence
  RNA Oligomer
aaacaaacaagguuucugc

SEQ ID NO: 2577 - RNA, 19 nt, Artificial Sequence
  RNA Oligomer
aaaucaccauuuaaugagg

SEQ ID NO: 2578 - RNA, 19 nt, Artificial Sequence
  RNA Oligomer
aucaauaagguacaaaugc

SEQ ID NO: 2579 - RNA, 19 nt, Artificial Sequence
  RNA Oligomer
auacuuccauacuaugucg

SEQ ID NO: 2580 - RNA, 19 nt, Artificial Sequence
  RNA Oligomer
aaacauuuaaugaaggccc

SEQ ID NO: 2581 - RNA, 19 nt, Artificial Sequence
  RNA Oligomer
augaacaaguaaaaguagc

SEQ ID NO: 2582 - RNA, 19 nt, Artificial Sequence
  RNA Oligomer
auuuaaugagguucaaggg

SEQ ID NO: 2583 - RNA, 19 nt, Artificial Sequence
  RNA Oligomer
uuaggcagcaaguugagga

SEQ ID NO: 2584 - RNA, 19 nt, Artificial Sequence
  RNA Oligomer
uugagcauuuacaugaucc

SEQ ID NO: 2585 - RNA, 19 nt, Artificial Sequence
  RNA Oligomer
aagauguucuaacaauucg

SEQ ID NO: 2586 - RNA, 19 nt, Artificial Sequence
  RNA Oligomer
augugaaggaaguuaucuc

SEQ ID NO: 2587 - RNA, 19 nt, Artificial Sequence
  RNA Oligomer
ugugaaggaaguuaucuca

SEQ ID NO: 2588 - RNA, 19 nt, Artificial Sequence
  RNA Oligomer
uaaaagcaaaacacaugga

SEQ ID NO: 2589 - RNA, 19 nt, Artificial Sequence
  RNA Oligomer
gaaaucaccauuuaaugag

SEQ ID NO: 2590 - RNA, 19 nt, Artificial Sequence
  RNA Oligomer
guaauagaaagcagaaggg

SEQ ID NO: 2591 - RNA, 19 nt, Artificial Sequence
  RNA Oligomer
uaggcagcaaguugaggag

SEQ ID NO: 2592 - RNA, 19 nt, Artificial Sequence
  RNA Oligomer
ucuaggacaaaaagggcgg

SEQ ID NO: 2593 - RNA, 19 nt, Artificial Sequence
  RNA Oligomer
auaaaauucaggagugcaa

SEQ ID NO: 2594 - RNA, 19 nt, Artificial Sequence
  RNA Oligomer
uuccauacuaugucgaccc

SEQ ID NO: 2595 - RNA, 19 nt, Artificial Sequence
  RNA Oligomer
uucaaggagcuaaaaaugc

SEQ ID NO: 2596 - RNA, 19 nt, Artificial Sequence
  RNA Oligomer
acauggaaaaacaaaguac

SEQ ID NO: 2597 - RNA, 19 nt, Artificial Sequence
  RNA Oligomer
acaaacauuuaaugaaggc

SEQ ID NO: 2598 - RNA, 19 nt, Artificial Sequence
  RNA Oligomer
aaaauuagaagcugagagg

SEQ ID NO: 2599 - RNA, 19 nt, Artificial Sequence
  RNA Oligomer
agccacauaauaucaaagg

SEQ ID NO: 2600 - RNA, 19 nt, Artificial Sequence
  RNA Oligomer
aaucuagauaugaagugca

SEQ ID NO: 2601 - RNA, 19 nt, Artificial Sequence
  RNA Oligomer
uugauugaaugaaaguggg

SEQ ID NO: 2602 - RNA, 19 nt, Artificial Sequence
  RNA Oligomer
ucaauaagguacaaaugca

SEQ ID NO: 2603 - RNA, 19 nt, Artificial Sequence
  RNA Oligomer
aauaagguacaaaugcaag

SEQ ID NO: 2604 - RNA, 19 nt, Artificial Sequence
  RNA Oligomer
auaaaagauaggagauggu

SEQ ID NO: 2605 - RNA, 19 nt, Artificial Sequence
  RNA Oligomer
aacacauggaaaaacaaag

SEQ ID NO: 2606 - RNA, 19 nt, Artificial Sequence
  RNA Oligomer
caaacauuuaaugaaggcc

SEQ ID NO: 2607 - RNA, 19 nt, Artificial Sequence
  RNA Oligomer
gugaauaaaacaaacaagg

SEQ ID NO: 2608 - RNA, 19 nt, Artificial Sequence
  RNA Oligomer
auaaagguuucuagguuga

SEQ ID NO: 2609 - RNA, 19 nt, Artificial Sequence
  RNA Oligomer
gaaaucuagauaugaagug

SEQ ID NO: 2610 - RNA, 19 nt, Artificial Sequence
  RNA Oligomer
aucuagauaugaagugcag

SEQ ID NO: 2611 - RNA, 19 nt, Artificial Sequence
  RNA Oligomer
guugauugaaugaaagugg

SEQ ID NO: 2612 - RNA, 19 nt, Artificial Sequence
  RNA Oligomer
aaagugggaauaguaaggg

SEQ ID NO: 2613 - RNA, 19 nt, Artificial Sequence
  RNA Oligomer
uuuacaacuucacuuguca

SEQ ID NO: 2614 - RNA, 19 nt, Artificial Sequence
  RNA Oligomer
uuuugguuuguucuguagg

SEQ ID NO: 2615 - RNA, 19 nt, Artificial Sequence
  RNA Oligomer
aaaagcaaaacacauggaa

SEQ ID NO: 2616 - RNA, 19 nt, Artificial Sequence
  RNA Oligomer
ugaacaaguaaaaguagca

SEQ ID NO: 2617 - RNA, 19 nt, Artificial Sequence
  RNA Oligomer
uugaggaagaaggacacca

SEQ ID NO: 2618 - RNA, 19 nt, Artificial Sequence
  RNA Oligomer
auagaaagcagaaggguuc

SEQ ID NO: 2619 - RNA, 19 nt, Artificial Sequence
  RNA Oligomer
auguauggcacugaaauaa

SEQ ID NO: 2620 - RNA, 19 nt, Artificial Sequence
  RNA Oligomer
ugguuacagagucuaggga

SEQ ID NO: 2621 - RNA, 19 nt, Artificial Sequence
  RNA Oligomer
aaagaucuuugagacuucc

SEQ ID NO: 2622 - RNA, 19 nt, Artificial Sequence
  RNA Oligomer
caauaagguacaaaugcaa

SEQ ID NO: 2623 - RNA, 19 nt, Artificial Sequence
  RNA Oligomer
uaggacaaaaagggcggag

SEQ ID NO: 2624 - RNA, 19 nt, Artificial Sequence
  RNA Oligomer
uacaacuucacuugucagg

SEQ ID NO: 2625 - RNA, 19 nt, Artificial Sequence
  RNA Oligomer
caaaggcagagaugauggg

SEQ ID NO: 2626 - RNA, 19 nt, Artificial Sequence
  RNA Oligomer
cacacucccaauauccugc

SEQ ID NO: 2627 - RNA, 19 nt, Artificial Sequence
  RNA Oligomer
aaaauucugcaguuucucu

SEQ ID NO: 2628 - RNA, 19 nt, Artificial Sequence
  RNA Oligomer
acacucccaauauccugcg

SEQ ID NO: 2629 - RNA, 19 nt, Artificial Sequence
  RNA Oligomer
aaaauucaggagugcaagg

SEQ ID NO: 2630 - RNA, 19 nt, Artificial Sequence
  RNA Oligomer
aauucaggagugcaaggcu

SEQ ID NO: 2631 - RNA, 19 nt, Artificial Sequence
  RNA Oligomer
uggcaauacaaaauccugg

SEQ ID NO: 2632 - RNA, 19 nt, Artificial Sequence
  RNA Oligomer
aauacuuccauacuauguc

SEQ ID NO: 2633 - RNA, 19 nt, Artificial Sequence
  RNA Oligomer
uacuuccauacuaugucga

SEQ ID NO: 2634 - RNA, 19 nt, Artificial Sequence
  RNA Oligomer
aaugccaguggauaaaagc

SEQ ID NO: 2635 - RNA, 19 nt, Artificial Sequence
  RNA Oligomer
acacauggaaaaacaaagu

SEQ ID NO: 2636 - RNA, 19 nt, Artificial Sequence
  RNA Oligomer
ucaaaagguaggauuguag

SEQ ID NO: 2637 - RNA, 19 nt, Artificial Sequence
  RNA Oligomer
aaaacaaacaagguuucug

SEQ ID NO: 2638 - RNA, 19 nt, Artificial Sequence
  RNA Oligomer
cauuuaaugagguucaagg

SEQ ID NO: 2639 - RNA, 19 nt, Artificial Sequence
  RNA Oligomer
uaauagaaagcagaagggu

SEQ ID NO: 2640 - RNA, 19 nt, Artificial Sequence
  RNA Oligomer
gauaaagguuucuagguug

SEQ ID NO: 2641 - RNA, 19 nt, Artificial Sequence
  RNA Oligomer
aagccacauaauaucaaag

SEQ ID NO: 2642 - RNA, 19 nt, Artificial Sequence
  RNA Oligomer
gugguuacagagucuaggg

SEQ ID NO: 2643 - RNA, 19 nt, Artificial Sequence
  RNA Oligomer
ucaaaggcagagaugaugg

SEQ ID NO: 2644 - RNA, 19 nt, Artificial Sequence
  RNA Oligomer
agauguucuaacaauucgc

SEQ ID NO: 2645 - RNA, 19 nt, Artificial Sequence
  RNA Oligomer
uugcaccgguggaauucug

SEQ ID NO: 2646 - RNA, 19 nt, Artificial Sequence
  RNA Oligomer
uucaccuuaaccagcaugu

SEQ ID NO: 2647 - RNA, 19 nt, Artificial Sequence
  RNA Oligomer
accuuaaccagcaugucgg

SEQ ID NO: 2648 - RNA, 19 nt, Artificial Sequence
  RNA Oligomer
aucagucucaucuccacgg

SEQ ID NO: 2649 - RNA, 19 nt, Artificial Sequence
  RNA Oligomer
cuggucacauagaacaugg

SEQ ID NO: 2650 - RNA, 19 nt, Artificial Sequence
  RNA Oligomer
cucucucucaaauacuucc

SEQ ID NO: 2651 - RNA, 19 nt, Artificial Sequence
  RNA Oligomer
cuacaggccuagcauuuug

SEQ ID NO: 2652 - RNA, 19 nt, Artificial Sequence
  RNA Oligomer
aaaugccaguggauaaaag

SEQ ID NO: 2653 - RNA, 19 nt, Artificial Sequence
  RNA Oligomer
augccaguggauaaaagca

SEQ ID NO: 2654 - RNA, 19 nt, Artificial Sequence
  RNA Oligomer
guggauaaaagcaaaacac

SEQ ID NO: 2655 - RNA, 19 nt, Artificial Sequence
  RNA Oligomer
gauaaaagcaaaacacaug

SEQ ID NO: 2656 - RNA, 19 nt, Artificial Sequence
  RNA Oligomer
gaacaaguaaaaguagcau

SEQ ID NO: 2657 - RNA, 19 nt, Artificial Sequence
  RNA Oligomer
gaauugucaagacuugagg

SEQ ID NO: 2658 - RNA, 19 nt, Artificial Sequence
  RNA Oligomer
agcuuagcaagaaaucacc

SEQ ID NO: 2659 - RNA, 19 nt, Artificial Sequence
  RNA Oligomer
uuugagcauuuacaugauc

SEQ ID NO: 2660 - RNA, 19 nt, Artificial Sequence
  RNA Oligomer
gauaugaagugcagguuga

SEQ ID NO: 2661 - RNA, 19 nt, Artificial Sequence
  RNA Oligomer
auuucaguaacaaagcuca

SEQ ID NO: 2662 - RNA, 19 nt, Artificial Sequence
  RNA Oligomer
ugggcaaagaucaauaagg

SEQ ID NO: 2663 - RNA, 19 nt, Artificial Sequence
  RNA Oligomer
aacuucacuugucaggcuc

SEQ ID NO: 2664 - RNA, 19 nt, Artificial Sequence
  RNA Oligomer
aagggcuucacagaaaagg

SEQ ID NO: 2665 - RNA, 19 nt, Artificial Sequence
  RNA Oligomer
gcaguauucagacaucucc

SEQ ID NO: 2666 - RNA, 19 nt, Artificial Sequence
  RNA Oligomer
cauuuccugugcagucugg

SEQ ID NO: 2667 - RNA, 19 nt, Artificial Sequence
  RNA Oligomer
uagaguuuccugaugauga

SEQ ID NO: 2668 - RNA, 19 nt, Artificial Sequence
  RNA Oligomer
caauacaaaauccuggcag

SEQ ID NO: 2669 - RNA, 19 nt, Artificial Sequence
  RNA Oligomer
uacaaaauccuggcagugg

SEQ ID NO: 2670 - RNA, 19 nt, Artificial Sequence
  RNA Oligomer
uugacuacuacaggccuag

SEQ ID NO: 2671 - RNA, 19 nt, Artificial Sequence
  RNA Oligomer
caaaacacauggaaaaaca

SEQ ID NO: 2672 - RNA, 19 nt, Artificial Sequence
  RNA Oligomer
cacauggaaaaacaaagua

SEQ ID NO: 2673 - RNA, 19 nt, Artificial Sequence
  RNA Oligomer
aaagguaggauuguagcua

SEQ ID NO: 2674 - RNA, 19 nt, Artificial Sequence
  RNA Oligomer
aagguaggauuguagcuaa

SEQ ID NO: 2675 - RNA, 19 nt, Artificial Sequence
  RNA Oligomer
aacauuuaaugaaggccca

SEQ ID NO: 2676 - RNA, 19 nt, Artificial Sequence
  RNA Oligomer
ugaggaagaaggacaccac

SEQ ID NO: 2677 - RNA, 19 nt, Artificial Sequence
  RNA Oligomer
uagcaagaaaucaccauuu

SEQ ID NO: 2678 - RNA, 19 nt, Artificial Sequence
  RNA Oligomer
uacauuacaucuuugagca

SEQ ID NO: 2679 - RNA, 19 nt, Artificial Sequence
  RNA Oligomer
aaagcaggauucuagacag

SEQ ID NO: 2680 - RNA, 19 nt, Artificial Sequence
  RNA Oligomer
ugcagcugaaacauuccug

SEQ ID NO: 2681 - RNA, 19 nt, Artificial Sequence
  RNA Oligomer
gcagcugaaacauuccugg

SEQ ID NO: 2682 - RNA, 19 nt, Artificial Sequence
  RNA Oligomer
aaggcucuaucacaccucc

SEQ ID NO: 2683 - RNA, 19 nt, Artificial Sequence
  RNA Oligomer
caacuuuucuuuaccggca

SEQ ID NO: 2684 - RNA, 19 nt, Artificial Sequence
  RNA Oligomer
cuuuucuuuaccggcauca

SEQ ID NO: 2685 - RNA, 19 nt, Artificial Sequence
  RNA Oligomer
gaugaagaacauuuuuggu

SEQ ID NO: 2686 - RNA, 19 nt, Artificial Sequence
  RNA Oligomer
ucuuuuuuagaguuuccug

SEQ ID NO: 2687 - RNA, 19 nt, Artificial Sequence
  RNA Oligomer
agaguuuccugaugaugag

SEQ ID NO: 2688 - RNA, 19 nt, Artificial Sequence
  RNA Oligomer
auuuugcuagggaccaugg

SEQ ID NO: 2689 - RNA, 19 nt, Artificial Sequence
  RNA Oligomer
aucaaaagguaggauugua

SEQ ID NO: 2690 - RNA, 19 nt, Artificial Sequence
  RNA Oligomer
aaaagguaggauuguagcu

SEQ ID NO: 2691 - RNA, 19 nt, Artificial Sequence
  RNA Oligomer
agcacuugguacaugaugg

SEQ ID NO: 2692 - RNA, 19 nt, Artificial Sequence
  RNA Oligomer
caagacuugaggaagaagg

SEQ ID NO: 2693 - RNA, 19 nt, Artificial Sequence
  RNA Oligomer
aagagcacaaaauuagaag

SEQ ID NO: 2694 - RNA, 19 nt, Artificial Sequence
  RNA Oligomer
gagcuuagcaagaaaucac

SEQ ID NO: 2695 - RNA, 19 nt, Artificial Sequence
  RNA Oligomer
aaccaguucucauaaacca

SEQ ID NO: 2696 - RNA, 19 nt, Artificial Sequence
  RNA Oligomer
aaacaauaacauguauggc

SEQ ID NO: 2697 - RNA, 19 nt, Artificial Sequence
  RNA Oligomer
aucuuugagcauuuacaug

SEQ ID NO: 2698 - RNA, 19 nt, Artificial Sequence
  RNA Oligomer
agcauuuacaugauccugu

SEQ ID NO: 2699 - RNA, 19 nt, Artificial Sequence
  RNA Oligomer
cgucucuagucauguuugc

SEQ ID NO: 2700 - RNA, 19 nt, Artificial Sequence
  RNA Oligomer
agucauguuugcuucuuca

SEQ ID NO: 2701 - RNA, 19 nt, Artificial Sequence
  RNA Oligomer
auuuccaaggugaugaugu

SEQ ID NO: 2702 - RNA, 19 nt, Artificial Sequence
  RNA Oligomer
agagccaaaagauaauguc

SEQ ID NO: 2703 - RNA, 19 nt, Artificial Sequence
  RNA Oligomer
cuaggacaaaaagggcgga

SEQ ID NO: 2704 - RNA, 19 nt, Artificial Sequence
  RNA Oligomer
ucucagacaucuuaacuaa

SEQ ID NO: 2705 - RNA, 19 nt, Artificial Sequence
  RNA Oligomer
aaagugccaucuacaaaag

SEQ ID NO: 2706 - RNA, 19 nt, Artificial Sequence
  RNA Oligomer
acacuguguuuacaacuuc

SEQ ID NO: 2707 - RNA, 19 nt, Artificial Sequence
  RNA Oligomer
acuguguuuacaacuucac

SEQ ID NO: 2708 - RNA, 19 nt, Artificial Sequence
  RNA Oligomer
auaaccuucccgauccuug

SEQ ID NO: 2709 - RNA, 19 nt, Artificial Sequence
  RNA Oligomer
aacuuuucuuuaccggcau

SEQ ID NO: 2710 - RNA, 19 nt, Artificial Sequence
  RNA Oligomer
uuuuugguuuguucuguag

SEQ ID NO: 2711 - RNA, 19 nt, Artificial Sequence
  RNA Oligomer
cuagaguacugugguccac

SEQ ID NO: 2712 - RNA, 19 nt, Artificial Sequence
  RNA Oligomer
ggcaauacaaaauccuggc

SEQ ID NO: 2713 - RNA, 19 nt, Artificial Sequence
  RNA Oligomer
ucucucucaaauacuucca

SEQ ID NO: 2714 - RNA, 19 nt, Artificial Sequence
  RNA Oligomer
cuuccauacuaugucgacc

SEQ ID NO: 2715 - RNA, 19 nt, Artificial Sequence
  RNA Oligomer
ucacacaugauaugucuuc

SEQ ID NO: 2716 - RNA, 19 nt, Artificial Sequence
  RNA Oligomer
acuugguacaugaugguga

SEQ ID NO: 2717 - RNA, 19 nt, Artificial Sequence
  RNA Oligomer
uuucugcccucauuuacag

SEQ ID NO: 2718 - RNA, 19 nt, Artificial Sequence
  RNA Oligomer
ucugcccucauuuacagcc

SEQ ID NO: 2719 - RNA, 19 nt, Artificial Sequence
  RNA Oligomer
cucauuuacagccugguag

SEQ ID NO: 2720 - RNA, 19 nt, Artificial Sequence
  RNA Oligomer
aaagacaagauguggugac

SEQ ID NO: 2721 - RNA, 19 nt, Artificial Sequence
  RNA Oligomer
caaaauuagaagcugagag

SEQ ID NO: 2722 - RNA, 19 nt, Artificial Sequence
  RNA Oligomer
accaaggugaagaguuuac

SEQ ID NO: 2723 - RNA, 19 nt, Artificial Sequence
  RNA Oligomer
gguaauagaaagcagaagg

SEQ ID NO: 2724 - RNA, 19 nt, Artificial Sequence
  RNA Oligomer
aagcagaaggguucuaagc

SEQ ID NO: 2725 - RNA, 19 nt, Artificial Sequence
  RNA Oligomer
cagcaaguugaggaguucc

SEQ ID NO: 2726 - RNA, 19 nt, Artificial Sequence
  RNA Oligomer
ugagcauuuacaugauccu

SEQ ID NO: 2727 - RNA, 19 nt, Artificial Sequence
  RNA Oligomer
cuagauaugaagugcaggu

SEQ ID NO: 2728 - RNA, 19 nt, Artificial Sequence
  RNA Oligomer
aagugggaauaguaaggga

SEQ ID NO: 2729 - RNA, 19 nt, Artificial Sequence
  RNA Oligomer
uaacaaagcucagagaaac

SEQ ID NO: 2730 - RNA, 19 nt, Artificial Sequence
  RNA Oligomer
gaaagaucuuugagacuuc

SEQ ID NO: 2731 - RNA, 19 nt, Artificial Sequence
  RNA Oligomer
cagagccaaaagauaaugu

SEQ ID NO: 2732 - RNA, 19 nt, Artificial Sequence
  RNA Oligomer
auaaccacacuguguuuac

SEQ ID NO: 2733 - RNA, 19 nt, Artificial Sequence
  RNA Oligomer
cacuguguuuacaacuuca

SEQ ID NO: 2734 - RNA, 19 nt, Artificial Sequence
  RNA Oligomer
acaacuucacuugucaggc

SEQ ID NO: 2735 - RNA, 19 nt, Artificial Sequence
  RNA Oligomer
cugcagcugaaacauuccu

SEQ ID NO: 2736 - RNA, 19 nt, Artificial Sequence
  RNA Oligomer
aaaccgugcauccugaaga

SEQ ID NO: 2737 - RNA, 19 nt, Artificial Sequence
  RNA Oligomer
aucaaaggcucuaucacac

SEQ ID NO: 2738 - RNA, 19 nt, Artificial Sequence
  RNA Oligomer
cugcaguauucagacaucu

SEQ ID NO: 2739 - RNA, 19 nt, Artificial Sequence
  RNA Oligomer
caccuuaaccagcaugucg

SEQ ID NO: 2740 - RNA, 19 nt, Artificial Sequence
  RNA Oligomer
acaauucgcucaacaacag

SEQ ID NO: 2741 - RNA, 19 nt, Artificial Sequence
  RNA Oligomer
uuuucuuuaccggcaucac

SEQ ID NO: 2742 - RNA, 19 nt, Artificial Sequence
  RNA Oligomer
cgauggcaauacaaaaucc

SEQ ID NO: 2743 - RNA, 19 nt, Artificial Sequence
  RNA Oligomer
aauacaaaauccuggcagu

SEQ ID NO: 2744 - RNA, 19 nt, Artificial Sequence
  RNA Oligomer
uacuaugucgacccaaagg

SEQ ID NO: 2745 - RNA, 19 nt, Artificial Sequence
  RNA Oligomer
agcaccuugacuacuacag

SEQ ID NO: 2746 - RNA, 19 nt, Artificial Sequence
  RNA Oligomer
gacuacuacaggccuagca

SEQ ID NO: 2747 - RNA, 19 nt, Artificial Sequence
  RNA Oligomer
gaaguuaucucacacauga

SEQ ID NO: 2748 - RNA, 19 nt, Artificial Sequence
  RNA Oligomer
caaaagguaggauuguagc

SEQ ID NO: 2749 - RNA, 19 nt, Artificial Sequence
  RNA Oligomer
augaaggcccacuaugugc

SEQ ID NO: 2750 - RNA, 19 nt, Artificial Sequence
  RNA Oligomer
gaaaagacaagauguggug

SEQ ID NO: 2751 - RNA, 19 nt, Artificial Sequence
  RNA Oligomer
agagcacaaaauuagaagc

SEQ ID NO: 2752 - RNA, 19 nt, Artificial Sequence
  RNA Oligomer
caguucucauaaaccaagg

SEQ ID NO: 2753 - RNA, 19 nt, Artificial Sequence
  RNA Oligomer
cauaaaccaaggugaagag

SEQ ID NO: 2754 - RNA, 19 nt, Artificial Sequence
  RNA Oligomer
cagaaggguucuaagcagg

SEQ ID NO: 2755 - RNA, 19 nt, Artificial Sequence
  RNA Oligomer
uagacagauuugguggcag

SEQ ID NO: 2756 - RNA, 19 nt, Artificial Sequence
  RNA Oligomer
ucaguaacaaagcucagag

SEQ ID NO: 2757 - RNA, 19 nt, Artificial Sequence
  RNA Oligomer
cucagagaaacaaccaacg

SEQ ID NO: 2758 - RNA, 19 nt, Artificial Sequence
  RNA Oligomer
aacgagccaagaguguccu

SEQ ID NO: 2759 - RNA, 19 nt, Artificial Sequence
  RNA Oligomer
caaggugcgucucuaguca

SEQ ID NO: 2760 - RNA, 19 nt, Artificial Sequence
  RNA Oligomer
aaaagggcggaggauauga

SEQ ID NO: 2761 - RNA, 19 nt, Artificial Sequence
  RNA Oligomer
aagugccaucuacaaaagc

SEQ ID NO: 2762 - RNA, 19 nt, Artificial Sequence
  RNA Oligomer
agugccaucuacaaaagcu

SEQ ID NO: 2763 - RNA, 19 nt, Artificial Sequence
  RNA Oligomer
gugccaucuacaaaagcug

SEQ ID NO: 2764 - RNA, 19 nt, Artificial Sequence
  RNA Oligomer
uuacaacuucacuugucag

SEQ ID NO: 2765 - RNA, 19 nt, Artificial Sequence
  RNA Oligomer
caacuucacuugucaggcu

SEQ ID NO: 2766 - RNA, 19 nt, Artificial Sequence
  RNA Oligomer
gauguucuaacaauucgcu

SEQ ID NO: 2767 - RNA, 19 nt, Artificial Sequence
  RNA Oligomer
cccgauccuugauaagugc

SEQ ID NO: 2768 - RNA, 19 nt, Artificial Sequence
  RNA Oligomer
caauucgcucaacaacagc

SEQ ID NO: 2769 - RNA, 19 nt, Artificial Sequence
  RNA Oligomer
aaaaaccucuuggagcugg

SEQ ID NO: 2770 - RNA, 19 nt, Artificial Sequence
  RNA Oligomer
auuuccugugcagucuggu

SEQ ID NO: 2771 - RNA, 19 nt, Artificial Sequence
  RNA Oligomer
uuuccugugcagucugguc

SEQ ID NO: 2772 - RNA, 19 nt, Artificial Sequence
  RNA Oligomer
ucacauagaacauggacgu

SEQ ID NO: 2773 - RNA, 19 nt, Artificial Sequence
  RNA Oligomer
uuccaguucuuucucucca

SEQ ID NO: 2774 - RNA, 19 nt, Artificial Sequence
  RNA Oligomer
cacucccaauauccugcgu

SEQ ID NO: 2775 - RNA, 19 nt, Artificial Sequence
  RNA Oligomer
gauggcaauacaaaauccu

SEQ ID NO: 2776 - RNA, 19 nt, Artificial Sequence
  RNA Oligomer
auggcaauacaaaauccug

SEQ ID NO: 2777 - RNA, 19 nt, Artificial Sequence
  RNA Oligomer
uccauacuaugucgaccca

SEQ ID NO: 2778 - RNA, 19 nt, Artificial Sequence
  RNA Oligomer
aaaccacccaaacaaauau

SEQ ID NO: 2779 - RNA, 19 nt, Artificial Sequence
  RNA Oligomer
uauugagcaccuugacuac

SEQ ID NO: 2780 - RNA, 19 nt, Artificial Sequence
  RNA Oligomer
ugagcaccuugacuacuac

SEQ ID NO: 2781 - RNA, 19 nt, Artificial Sequence
  RNA Oligomer
acucccaauauccugcguc

SEQ ID NO: 2782 - RNA, 19 nt, Artificial Sequence
  RNA Oligomer
cacacaugauaugucuuca

SEQ ID NO: 2783 - RNA, 19 nt, Artificial Sequence
  RNA Oligomer
ugauaugucuucaaggagc

SEQ ID NO: 2784 - RNA, 19 nt, Artificial Sequence
  RNA Oligomer
guaggauuguagcuaaggu

SEQ ID NO: 2785 - RNA, 19 nt, Artificial Sequence
  RNA Oligomer
uaggauuguagcuaagguu

SEQ ID NO: 2786 - RNA, 19 nt, Artificial Sequence
  RNA Oligomer
cagaaguagacugcucagg

SEQ ID NO: 2787 - RNA, 19 nt, Artificial Sequence
  RNA Oligomer
guucucauaaaccaaggug

SEQ ID NO: 2788 - RNA, 19 nt, Artificial Sequence
  RNA Oligomer
aaaccaaggugaagaguuu

SEQ ID NO: 2789 - RNA, 19 nt, Artificial Sequence
  RNA Oligomer
agaaggguucuaagcaggg

SEQ ID NO: 2790 - RNA, 19 nt, Artificial Sequence
  RNA Oligomer
auacugaaagagaaagcag

SEQ ID NO: 2791 - RNA, 19 nt, Artificial Sequence
  RNA Oligomer
aaagcaggaacaaagaacu

SEQ ID NO: 2792 - RNA, 19 nt, Artificial Sequence
  RNA Oligomer
agcaggaacaaagaacuac

SEQ ID NO: 2793 - RNA, 19 nt, Artificial Sequence
  RNA Oligomer
gaaagugggaauaguaagg

SEQ ID NO: 2794 - RNA, 19 nt, Artificial Sequence
  RNA Oligomer
uucaguaacaaagcucaga

SEQ ID NO: 2795 - RNA, 19 nt, Artificial Sequence
  RNA Oligomer
aagaucuuugagacuucca

SEQ ID NO: 2796 - RNA, 19 nt, Artificial Sequence
  RNA Oligomer
augauguccuucuccagaa

SEQ ID NO: 2797 - RNA, 19 nt, Artificial Sequence
  RNA Oligomer
uaaccacacuguguuuaca

SEQ ID NO: 2798 - RNA, 19 nt, Artificial Sequence
  RNA Oligomer
auguucuaacaauucgcuc

SEQ ID NO: 2799 - RNA, 19 nt, Artificial Sequence
  RNA Oligomer
ucccgauccuugauaagug

SEQ ID NO: 2800 - RNA, 19 nt, Artificial Sequence
  RNA Oligomer
aagagccucgauguaccag

SEQ ID NO: 2801 - RNA, 19 nt, Artificial Sequence
  RNA Oligomer
uuuguucuguaggcuuggg

SEQ ID NO: 2802 - RNA, 19 nt, Artificial Sequence
  RNA Oligomer
uggucacauagaacaugga

SEQ ID NO: 2803 - RNA, 19 nt, Artificial Sequence
  RNA Oligomer
uagaacauggacgucauag

SEQ ID NO: 2804 - RNA, 19 nt, Artificial Sequence
  RNA Oligomer
cgaaauuccaguucuuucu

SEQ ID NO: 2805 - RNA, 19 nt, Artificial Sequence
  RNA Oligomer
aguucuuucucuccaguga

SEQ ID NO: 2806 - RNA, 19 nt, Artificial Sequence
  RNA Oligomer
auaugagcauuuauuuggc

SEQ ID NO: 2807 - RNA, 19 nt, Artificial Sequence
  RNA Oligomer
uucucucucucaaauacuu

SEQ ID NO: 2808 - RNA, 19 nt, Artificial Sequence
  RNA Oligomer
ucucucucucaaauacuuc

SEQ ID NO: 2809 - RNA, 19 nt, Artificial Sequence
  RNA Oligomer
uuauugagcaccuugacua

SEQ ID NO: 2810 - RNA, 19 nt, Artificial Sequence
  RNA Oligomer
uugagcaccuugacuacua

SEQ ID NO: 2811 - RNA, 19 nt, Artificial Sequence
  RNA Oligomer
uucugcccucauuuacagc

SEQ ID NO: 2812 - RNA, 19 nt, Artificial Sequence
  RNA Oligomer
aaaagacaagaugugguga

SEQ ID NO: 2813 - RNA, 19 nt, Artificial Sequence
  RNA Oligomer
agaaguagacugcucaggg

SEQ ID NO: 2814 - RNA, 19 nt, Artificial Sequence
  RNA Oligomer
gaaguagacugcucaggga

SEQ ID NO: 2815 - RNA, 19 nt, Artificial Sequence
  RNA Oligomer
aaguagacugcucagggac

SEQ ID NO: 2816 - RNA, 19 nt, Artificial Sequence
  RNA Oligomer
ggaaagagcacaaaauuag

SEQ ID NO: 2817 - RNA, 19 nt, Artificial Sequence
  RNA Oligomer
cacaaaauuagaagcugag

SEQ ID NO: 2818 - RNA, 19 nt, Artificial Sequence
  RNA Oligomer
uagaagcugagaggagacc

SEQ ID NO: 2819 - RNA, 19 nt, Artificial Sequence
  RNA Oligomer
aguucucauaaaccaaggu

SEQ ID NO: 2820 - RNA, 19 nt, Artificial Sequence
  RNA Oligomer
aaguugggaaguuucagau

SEQ ID NO: 2821 - RNA, 19 nt, Artificial Sequence
  RNA Oligomer
ugggaaguuucagauaagc

SEQ ID NO: 2822 - RNA, 19 nt, Artificial Sequence
  RNA Oligomer
aaggagaguuuaauacuga

SEQ ID NO: 2823 - RNA, 19 nt, Artificial Sequence
  RNA Oligomer
gaacuacauuacaucuuug

SEQ ID NO: 2824 - RNA, 19 nt, Artificial Sequence
  RNA Oligomer
aagcaggauucuagacaga

SEQ ID NO: 2825 - RNA, 19 nt, Artificial Sequence
  RNA Oligomer
ucauuucaguaacaaagcu

SEQ ID NO: 2826 - RNA, 19 nt, Artificial Sequence
  RNA Oligomer
uuucaguaacaaagcucag

SEQ ID NO: 2827 - RNA, 19 nt, Artificial Sequence
  RNA Oligomer
ucagagccaaaagauaaug

SEQ ID NO: 2828 - RNA, 19 nt, Artificial Sequence
  RNA Oligomer
uucacuugucaggcucuuc

SEQ ID NO: 2829 - RNA, 19 nt, Artificial Sequence
  RNA Oligomer
gaacagaaaccgugcaucc

SEQ ID NO: 2830 - RNA, 19 nt, Artificial Sequence
  RNA Oligomer
uguucuaacaauucgcuca

SEQ ID NO: 2831 - RNA, 19 nt, Artificial Sequence
  RNA Oligomer
uuucccauccacaccauag

SEQ ID NO: 2832 - RNA, 19 nt, Artificial Sequence
  RNA Oligomer
cucucaaauacuuccauac

SEQ ID NO: 2833 - RNA, 19 nt, Artificial Sequence
  RNA Oligomer
uucuucccucuuuuauuca

SEQ ID NO: 2834 - RNA, 19 nt, Artificial Sequence
  RNA Oligomer
uucccucuuuuauucaaca

SEQ ID NO: 2835 - RNA, 19 nt, Artificial Sequence
  RNA Oligomer
auuuaaugaaggcccacua

SEQ ID NO: 2836 - RNA, 19 nt, Artificial Sequence
  RNA Oligomer
cugcccucauuuacagccu

SEQ ID NO: 2837 - RNA, 19 nt, Artificial Sequence
  RNA Oligomer
uugggaaguuucagauaag

SEQ ID NO: 2838 - RNA, 19 nt, Artificial Sequence
  RNA Oligomer
aaagggcggaggauaugaa

SEQ ID NO: 2839 - RNA, 19 nt, Artificial Sequence
  RNA Oligomer
uucuaacaauucgcucaac

SEQ ID NO: 2840 - RNA, 19 nt, Artificial Sequence
  RNA Oligomer
cauuuuugguuuguucugu

SEQ ID NO: 2841 - RNA, 19 nt, Artificial Sequence
  RNA Oligomer
caguuucccauccacacca

SEQ ID NO: 2842 - RNA, 19 nt, Artificial Sequence
  RNA Oligomer
uucccauccacaccauaga

SEQ ID NO: 2843 - RNA, 19 nt, Artificial Sequence
  RNA Oligomer
uucucuccagugaagugca

SEQ ID NO: 2844 - RNA, 19 nt, Artificial Sequence
  RNA Oligomer
uuuuagaguuuccugauga

SEQ ID NO: 2845 - RNA, 19 nt, Artificial Sequence
  RNA Oligomer
uagggaccaugggagaugu

SEQ ID NO: 2846 - RNA, 19 nt, Artificial Sequence
  RNA Oligomer
cuucuucccucuuuuauuc

SEQ ID NO: 2847 - RNA, 19 nt, Artificial Sequence
  RNA Oligomer
uuuaaacaaccaaauccug

SEQ ID NO: 2848 - RNA, 19 nt, Artificial Sequence
  RNA Oligomer
gaaagcaggaacaaagaac

SEQ ID NO: 2849 - RNA, 19 nt, Artificial Sequence
  RNA Oligomer
agugggaauaguaagggag

SEQ ID NO: 2850 - RNA, 19 nt, Artificial Sequence
  RNA Oligomer
uacauuaaauuuggacacc

SEQ ID NO: 2851 - RNA, 19 nt, Artificial Sequence
  RNA Oligomer
caauagguccaaccaaggc

SEQ ID NO: 2852 - RNA, 19 nt, Artificial Sequence
  RNA Oligomer
ucaaaggcucuaucacacc

SEQ ID NO: 2853 - RNA, 19 nt, Artificial Sequence
  RNA Oligomer
caaaggcucuaucacaccu

SEQ ID NO: 2854 - RNA, 19 nt, Artificial Sequence
  RNA Oligomer
uccaguucuuucucuccag

SEQ ID NO: 2855 - RNA, 19 nt, Artificial Sequence
  RNA Oligomer
guuugauaaaauucaggag

SEQ ID NO: 2856 - RNA, 19 nt, Artificial Sequence
  RNA Oligomer
uugauaaaauucaggagug

SEQ ID NO: 2857 - RNA, 19 nt, Artificial Sequence
  RNA Oligomer
ugauaaaauucaggagugc

SEQ ID NO: 2858 - RNA, 19 nt, Artificial Sequence
  RNA Oligomer
cugaaacugcccacuuugg

SEQ ID NO: 2859 - RNA, 19 nt, Artificial Sequence
  RNA Oligomer
cucauuucaguaacaaagc

SEQ ID NO: 2860 - RNA, 19 nt, Artificial Sequence
  RNA Oligomer
aagaguguccuuccacugg

SEQ ID NO: 2861 - RNA, 19 nt, Artificial Sequence
  RNA Oligomer
aacugcagcugaaacauuc

SEQ ID NO: 2862 - RNA, 19 nt, Artificial Sequence
  RNA Oligomer
uuucucuugcauuuccugu

SEQ ID NO: 2863 - RNA, 19 nt, Artificial Sequence
  RNA Oligomer
uaaugaaggcccacuaugu

SEQ ID NO: 2864 - RNA, 19 nt, Artificial Sequence
  RNA Oligomer
aaugaaggcccacuaugug

SEQ ID NO: 2865 - RNA, 19 nt, Artificial Sequence
  RNA Oligomer
gggaaaagacaagaugugg

SEQ ID NO: 2866 - RNA, 19 nt, Artificial Sequence
  RNA Oligomer
aauacugaaagagaaagca

SEQ ID NO: 2867 - RNA, 19 nt, Artificial Sequence
  RNA Oligomer
uuugagacuuccaugggca

SEQ ID NO: 2868 - RNA, 19 nt, Artificial Sequence
  RNA Oligomer
uuuuuagaguuuccugaug

SEQ ID NO: 2869 - RNA, 19 nt, Artificial Sequence
  RNA Oligomer
cuggaggaagaaagaaugg

SEQ ID NO: 2870 - RNA, 19 nt, Artificial Sequence
  RNA Oligomer
uggaggaagaaagaaugga

SEQ ID NO: 2871 - RNA, 19 nt, Artificial Sequence
  RNA Oligomer
aaguuucagauaagcaggg

SEQ ID NO: 2872 - RNA, 19 nt, Artificial Sequence
  RNA Oligomer
guuuacaacuucacuuguc

SEQ ID NO: 2873 - RNA, 19 nt, Artificial Sequence
  RNA Oligomer
auucugcaguuucucuugc

SEQ ID NO: 2874 - RNA, 19 nt, Artificial Sequence
  RNA Oligomer
accuugacuacuacaggcc

SEQ ID NO: 2875 - RNA, 19 nt, Artificial Sequence
  RNA Oligomer
aagcagggauaaagguuuc

SEQ ID NO: 2876 - RNA, 19 nt, Artificial Sequence
  RNA Oligomer
aaagcucagagaaacaacc

SEQ ID NO: 2877 - RNA, 19 nt, Artificial Sequence
  RNA Oligomer
cuacauuaaauuuggacac

SEQ ID NO: 2878 - RNA, 19 nt, Artificial Sequence
  RNA Oligomer
acugcagcugaaacauucc

SEQ ID NO: 2879 - RNA, 19 nt, Artificial Sequence
  RNA Oligomer
uuaaccagcaugucggcca

SEQ ID NO: 2880 - RNA, 19 nt, Artificial Sequence
  RNA Oligomer
auucgcucaacaacagcug

SEQ ID NO: 2881 - RNA, 19 nt, Artificial Sequence
  RNA Oligomer
agguaacugugcaaaauuc

SEQ ID NO: 2882 - RNA, 19 nt, Artificial Sequence
  RNA Oligomer
aagaaggacaccaccugag

SEQ ID NO: 2883 - RNA, 19 nt, Artificial Sequence
  RNA Oligomer
aaucacuaaagugccaucu

SEQ ID NO: 2884 - RNA, 19 nt, Artificial Sequence
  RNA Oligomer
auccugaagaucaaaggcu

SEQ ID NO: 2885 - RNA, 19 nt, Artificial Sequence
  RNA Oligomer
uucggcaacuuuucuuuac

SEQ ID NO: 2886 - RNA, 19 nt, Artificial Sequence
  RNA Oligomer
guucuuuuuuagaguuucc

SEQ ID NO: 2887 - RNA, 19 nt, Artificial Sequence
  RNA Oligomer
uuccugaugaugaggaugc

SEQ ID NO: 2888 - RNA, 19 nt, Artificial Sequence
  RNA Oligomer
uauuuauugagcaccuuga

SEQ ID NO: 2889 - RNA, 19 nt, Artificial Sequence
  RNA Oligomer
aaggaaguuaucucacaca

SEQ ID NO: 2890 - RNA, 19 nt, Artificial Sequence
  RNA Oligomer
uagggaaacacaccauucu

SEQ ID NO: 2891 - RNA, 19 nt, Artificial Sequence
  RNA Oligomer
cucuaggacaaaaagggcg

SEQ ID NO: 2892 - RNA, 19 nt, Artificial Sequence
  RNA Oligomer
gugaugauguccuucucca

SEQ ID NO: 2893 - RNA, 19 nt, Artificial Sequence
  RNA Oligomer
aagcaaucacuaaagugcc

SEQ ID NO: 2894 - RNA, 19 nt, Artificial Sequence
  RNA Oligomer
aauagguccaaccaaggcu

SEQ ID NO: 2895 - RNA, 19 nt, Artificial Sequence
  RNA Oligomer
uugguuuguucuguaggcu

SEQ ID NO: 2896 - RNA, 19 nt, Artificial Sequence
  RNA Oligomer
aagagggugacuagaguac

SEQ ID NO: 2897 - RNA, 19 nt, Artificial Sequence
  RNA Oligomer
gaaggaaguuaucucacac

SEQ ID NO: 2898 - RNA, 19 nt, Artificial Sequence
  RNA Oligomer
aaacaagguuucugcccuc

SEQ ID NO: 2899 - RNA, 19 nt, Artificial Sequence
  RNA Oligomer
gaaggcaucaaaagcuugg

SEQ ID NO: 2900 - RNA, 19 nt, Artificial Sequence
  RNA Oligomer
acauucuggcugaaacugc

SEQ ID NO: 2901 - RNA, 19 nt, Artificial Sequence
  RNA Oligomer
aagcucagagaaacaacca

SEQ ID NO: 2902 - RNA, 19 nt, Artificial Sequence
  RNA Oligomer
acauuaaauuuggacaccu

SEQ ID NO: 2903 - RNA, 19 nt, Artificial Sequence
  RNA Oligomer
cacucuaggacaaaaaggg

SEQ ID NO: 2904 - RNA, 19 nt, Artificial Sequence
  RNA Oligomer
aaagcaaucacuaaagugc

SEQ ID NO: 2905 - RNA, 19 nt, Artificial Sequence
  RNA Oligomer
aaacacuugagcaagagcc

SEQ ID NO: 2906 - RNA, 19 nt, Artificial Sequence
  RNA Oligomer
gaaccucguuugguguucc

SEQ ID NO: 2907 - RNA, 19 nt, Artificial Sequence
  RNA Oligomer
aaccucguuugguguuccg

SEQ ID NO: 2908 - RNA, 19 nt, Artificial Sequence
  RNA Oligomer
aguacugugguccacaucc

SEQ ID NO: 2909 - RNA, 19 nt, Artificial Sequence
  RNA Oligomer
uuauuuggcacccgauggc

SEQ ID NO: 2910 - RNA, 19 nt, Artificial Sequence
  RNA Oligomer
aacaagguuucugcccuca

SEQ ID NO: 2911 - RNA, 19 nt, Artificial Sequence
  RNA Oligomer
gaaaagggcaggaaagagc

SEQ ID NO: 2912 - RNA, 19 nt, Artificial Sequence
  RNA Oligomer
aauuagaagcugagaggag

SEQ ID NO: 2913 - RNA, 19 nt, Artificial Sequence
  RNA Oligomer
aaucaccauuuaaugaggu

SEQ ID NO: 2914 - RNA, 19 nt, Artificial Sequence
  RNA Oligomer
ucaccauuuaaugagguuc

SEQ ID NO: 2915 - RNA, 19 nt, Artificial Sequence
  RNA Oligomer
aaacaaccaaauccuggcc

SEQ ID NO: 2916 - RNA, 19 nt, Artificial Sequence
  RNA Oligomer
uaugugagaacagacugga

SEQ ID NO: 2917 - RNA, 19 nt, Artificial Sequence
  RNA Oligomer
uucuggcugaaacugccca

SEQ ID NO: 2918 - RNA, 19 nt, Artificial Sequence
  RNA Oligomer
cauuccuggcaauaggucc

SEQ ID NO: 2919 - RNA, 19 nt, Artificial Sequence
  RNA Oligomer
guaccaggaaccucguuug

SEQ ID NO: 2920 - RNA, 19 nt, Artificial Sequence
  RNA Oligomer
ggaugaagaacauuuuugg

SEQ ID NO: 2921 - RNA, 19 nt, Artificial Sequence
  RNA Oligomer
caacagcuguuuggcuagc

SEQ ID NO: 2922 - RNA, 19 nt, Artificial Sequence
  RNA Oligomer
aguuggcguugucaaagag

SEQ ID NO: 2923 - RNA, 19 nt, Artificial Sequence
  RNA Oligomer
cuuuuuuagaguuuccuga

SEQ ID NO: 2924 - RNA, 19 nt, Artificial Sequence
  RNA Oligomer
augagcauuuauuuggcac

SEQ ID NO: 2925 - RNA, 19 nt, Artificial Sequence
  RNA Oligomer
auauuuauugagcaccuug

SEQ ID NO: 2926 - RNA, 19 nt, Artificial Sequence
  RNA Oligomer
auuuauugagcaccuugac

SEQ ID NO: 2927 - RNA, 19 nt, Artificial Sequence
  RNA Oligomer
ucaaggagcuaaaaaugcc

SEQ ID NO: 2928 - RNA, 19 nt, Artificial Sequence
  RNA Oligomer
aacugcaauaaaugcaaug

SEQ ID NO: 2929 - RNA, 19 nt, Artificial Sequence
  RNA Oligomer
acugcaauaaaugcaauga

SEQ ID NO: 2930 - RNA, 19 nt, Artificial Sequence
  RNA Oligomer
gacagacacagaaguagac

SEQ ID NO: 2931 - RNA, 19 nt, Artificial Sequence
  RNA Oligomer
aaggacaccaccugaguca

SEQ ID NO: 2932 - RNA, 19 nt, Artificial Sequence
  RNA Oligomer
aaggcaucaaaagcuuggg

SEQ ID NO: 2933 - RNA, 19 nt, Artificial Sequence
  RNA Oligomer
agcagggauaaagguuucu

SEQ ID NO: 2934 - RNA, 19 nt, Artificial Sequence
  RNA Oligomer
gaggaguuccacauucugg

SEQ ID NO: 2935 - RNA, 19 nt, Artificial Sequence
  RNA Oligomer
aguuccacauucuggcuga

SEQ ID NO: 2936 - RNA, 19 nt, Artificial Sequence
  RNA Oligomer
acucuaggacaaaaagggc

SEQ ID NO: 2937 - RNA, 19 nt, Artificial Sequence
  RNA Oligomer
aaagauaggagauggucuc

SEQ ID NO: 2938 - RNA, 19 nt, Artificial Sequence
  RNA Oligomer
uaccaggaaccucguuugg

SEQ ID NO: 2939 - RNA, 19 nt, Artificial Sequence
  RNA Oligomer
ucggcaacuuuucuuuacc

SEQ ID NO: 2940 - RNA, 19 nt, Artificial Sequence
  RNA Oligomer
auagcccaaaagcuugaag

SEQ ID NO: 2941 - RNA, 19 nt, Artificial Sequence
  RNA Oligomer
guguuugauaaaauucagg

SEQ ID NO: 2942 - RNA, 19 nt, Artificial Sequence
  RNA Oligomer
acuaugucgacccaaaggc

SEQ ID NO: 2943 - RNA, 19 nt, Artificial Sequence
  RNA Oligomer
uaugucuucaaggagcuaa

SEQ ID NO: 2944 - RNA, 19 nt, Artificial Sequence
  RNA Oligomer
caaacaagguuucugcccu

SEQ ID NO: 2945 - RNA, 19 nt, Artificial Sequence
  RNA Oligomer
aagauguggugacagacac

SEQ ID NO: 2946 - RNA, 19 nt, Artificial Sequence
  RNA Oligomer
auuagaagcugagaggaga

SEQ ID NO: 2947 - RNA, 19 nt, Artificial Sequence
  RNA Oligomer
aaaacuacucuguuaugug

SEQ ID NO: 2948 - RNA, 19 nt, Artificial Sequence
  RNA Oligomer
cagggauaaagguuucuag

SEQ ID NO: 2949 - RNA, 19 nt, Artificial Sequence
  RNA Oligomer
guugaggaguuccacauuc

SEQ ID NO: 2950 - RNA, 19 nt, Artificial Sequence
  RNA Oligomer
uuuacaugauccuguaaag

SEQ ID NO: 2951 - RNA, 19 nt, Artificial Sequence
  RNA Oligomer
gaguuccacauucuggcug

SEQ ID NO: 2952 - RNA, 19 nt, Artificial Sequence
  RNA Oligomer
auaagcuaggaagcuuuuc

SEQ ID NO: 2953 - RNA, 19 nt, Artificial Sequence
  RNA Oligomer
aaacugcccacuuuggccu

SEQ ID NO: 2954 - RNA, 19 nt, Artificial Sequence
  RNA Oligomer
agucuagggaaacacacca

SEQ ID NO: 2955 - RNA, 19 nt, Artificial Sequence
  RNA Oligomer
agcaaucacuaaagugcca

SEQ ID NO: 2956 - RNA, 19 nt, Artificial Sequence
  RNA Oligomer
aauucgcucaacaacagcu

SEQ ID NO: 2957 - RNA, 19 nt, Artificial Sequence
  RNA Oligomer
uucgcucaacaacagcugu

SEQ ID NO: 2958 - RNA, 19 nt, Artificial Sequence
  RNA Oligomer
uggaugaagaacauuuuug

SEQ ID NO: 2959 - RNA, 19 nt, Artificial Sequence
  RNA Oligomer
ggugacuagaguacugugg

SEQ ID NO: 2960 - RNA, 19 nt, Artificial Sequence
  RNA Oligomer
uuuagaguuuccugaugau

SEQ ID NO: 2961 - RNA, 19 nt, Artificial Sequence
  RNA Oligomer
gagcauuuauuuggcaccc

SEQ ID NO: 2962 - RNA, 19 nt, Artificial Sequence
  RNA Oligomer
caccuugacuacuacaggc

SEQ ID NO: 2963 - RNA, 19 nt, Artificial Sequence
  RNA Oligomer
cauuuuaucaaaagguagg

SEQ ID NO: 2964 - RNA, 19 nt, Artificial Sequence
  RNA Oligomer
aacaaacaagguuucugcc

SEQ ID NO: 2965 - RNA, 19 nt, Artificial Sequence
  RNA Oligomer
cagacacagaaguagacug

SEQ ID NO: 2966 - RNA, 19 nt, Artificial Sequence
  RNA Oligomer
uacucuguuaugugagaac

SEQ ID NO: 2967 - RNA, 19 nt, Artificial Sequence
  RNA Oligomer
aggaguuccacauucuggc

SEQ ID NO: 2968 - RNA, 19 nt, Artificial Sequence
  RNA Oligomer
uuacaugauccuguaaagc

SEQ ID NO: 2969 - RNA, 19 nt, Artificial Sequence
  RNA Oligomer
auucuggcugaaacugccc

SEQ ID NO: 2970 - RNA, 19 nt, Artificial Sequence
  RNA Oligomer
caguacugaagggaacgca

SEQ ID NO: 2971 - RNA, 19 nt, Artificial Sequence
  RNA Oligomer
gucuacauuaaauuuggac

SEQ ID NO: 2972 - RNA, 19 nt, Artificial Sequence
  RNA Oligomer
uaaauuuggacaccuucca

SEQ ID NO: 2973 - RNA, 19 nt, Artificial Sequence
  RNA Oligomer
aaggugaugauguccuucu

SEQ ID NO: 2974 - RNA, 19 nt, Artificial Sequence
  RNA Oligomer
aaaagauaggagauggucu

SEQ ID NO: 2975 - RNA, 19 nt, Artificial Sequence
  RNA Oligomer
aagugcguucaccuuaacc

SEQ ID NO: 2976 - RNA, 19 nt, Artificial Sequence
  RNA Oligomer
aacacuugagcaagagccu

SEQ ID NO: 2977 - RNA, 19 nt, Artificial Sequence
  RNA Oligomer
gaagaacauuuuugguuug

SEQ ID NO: 2978 - RNA, 19 nt, Artificial Sequence
  RNA Oligomer
guuuguucuguaggcuugg

SEQ ID NO: 2979 - RNA, 19 nt, Artificial Sequence
  RNA Oligomer
aacagcuguuuggcuagca

SEQ ID NO: 2980 - RNA, 19 nt, Artificial Sequence
  RNA Oligomer
aacugugcaaaauucugca

SEQ ID NO: 2981 - RNA, 19 nt, Artificial Sequence
  RNA Oligomer
ucauagcccaaaagcuuga

SEQ ID NO: 2982 - RNA, 19 nt, Artificial Sequence
  RNA Oligomer
acucgguucuuuuuuagag

SEQ ID NO: 2983 - RNA, 19 nt, Artificial Sequence
  RNA Oligomer
cagagcgaaauuccaguuc

SEQ ID NO: 2984 - RNA, 19 nt, Artificial Sequence
  RNA Oligomer
auucaggagugcaaggcuu

SEQ ID NO: 2985 - RNA, 19 nt, Artificial Sequence
  RNA Oligomer
aguuuccugaugaugagga

SEQ ID NO: 2986 - RNA, 19 nt, Artificial Sequence
  RNA Oligomer
ugagcauuuauuuggcacc

SEQ ID NO: 2987 - RNA, 19 nt, Artificial Sequence
  RNA Oligomer
aaggcucacaaaccaccca

SEQ ID NO: 2988 - RNA, 19 nt, Artificial Sequence
  RNA Oligomer
cuaugugccaagcacuugg

SEQ ID NO: 2989 - RNA, 19 nt, Artificial Sequence
  RNA Oligomer
uaugugccaagcacuuggu

SEQ ID NO: 2990 - RNA, 19 nt, Artificial Sequence
  RNA Oligomer
agacacagaaguagacugc

SEQ ID NO: 2991 - RNA, 19 nt, Artificial Sequence
  RNA Oligomer
acuugaggaagaaggacac

SEQ ID NO: 2992 - RNA, 19 nt, Artificial Sequence
  RNA Oligomer
aaauuagaagcugagagga

SEQ ID NO: 2993 - RNA, 19 nt, Artificial Sequence
  RNA Oligomer
uuagaagcugagaggagac

SEQ ID NO: 2994 - RNA, 19 nt, Artificial Sequence
  RNA Oligomer
aacaaccaaauccuggcca

SEQ ID NO: 2995 - RNA, 19 nt, Artificial Sequence
  RNA Oligomer
aaacuacucuguuauguga

SEQ ID NO: 2996 - RNA, 19 nt, Artificial Sequence
  RNA Oligomer
uuaugugagaacagacugg

SEQ ID NO: 2997 - RNA, 19 nt, Artificial Sequence
  RNA Oligomer
gaguuuaauacugaaagag

SEQ ID NO: 2998 - RNA, 19 nt, Artificial Sequence
  RNA Oligomer
ugaaagagaaagcaggaac

SEQ ID NO: 2999 - RNA, 19 nt, Artificial Sequence
  RNA Oligomer
uugaggaguuccacauucu

SEQ ID NO: 3000 - RNA, 19 nt, Artificial Sequence
  RNA Oligomer
uacaugauccuguaaagca

SEQ ID NO: 3001 - RNA, 19 nt, Artificial Sequence
  RNA Oligomer
uaagcuaggaagcuuuucu

SEQ ID NO: 3002 - RNA, 19 nt, Artificial Sequence
  RNA Oligomer
cauucuggcugaaacugcc

SEQ ID NO: 3003 - RNA, 19 nt, Artificial Sequence
  RNA Oligomer
aagauaggagauggucucu

SEQ ID NO: 3004 - RNA, 19 nt, Artificial Sequence
  RNA Oligomer
cuucacagaaaaggagcug

SEQ ID NO: 3005 - RNA, 19 nt, Artificial Sequence
  RNA Oligomer
uugauaagugcguucaccu

SEQ ID NO: 3006 - RNA, 19 nt, Artificial Sequence
  RNA Oligomer
uaagugcguucaccuuaac

SEQ ID NO: 3007 - RNA, 19 nt, Artificial Sequence
  RNA Oligomer
augucggccacgugcauau

SEQ ID NO: 3008 - RNA, 19 nt, Artificial Sequence
  RNA Oligomer
cuuuccaucuuguugguca

SEQ ID NO: 3009 - RNA, 19 nt, Artificial Sequence
  RNA Oligomer
aacaacagcuguuuggcua

SEQ ID NO: 3010 - RNA, 19 nt, Artificial Sequence
  RNA Oligomer
gaacauuuuugguuuguuc

SEQ ID NO: 3011 - RNA, 19 nt, Artificial Sequence
  RNA Oligomer
uuggcguugucaaagagcu

SEQ ID NO: 3012 - RNA, 19 nt, Artificial Sequence
  RNA Oligomer
aaaaccucuuggagcugga

SEQ ID NO: 3013 - RNA, 19 nt, Artificial Sequence
  RNA Oligomer
ugacuagaguacugugguc

SEQ ID NO: 3014 - RNA, 19 nt, Artificial Sequence
  RNA Oligomer
aagugcacauugcucaaca

SEQ ID NO: 3015 - RNA, 19 nt, Artificial Sequence
  RNA Oligomer
uugcucaacaccagugcua

SEQ ID NO: 3016 - RNA, 19 nt, Artificial Sequence
  RNA Oligomer
uucaggagugcaaggcuuc

SEQ ID NO: 3017 - RNA, 19 nt, Artificial Sequence
  RNA Oligomer
uaugagcauuuauuuggca

SEQ ID NO: 3018 - RNA, 19 nt, Artificial Sequence
  RNA Oligomer
uuuauuuggcacccgaugg

SEQ ID NO: 3019 - RNA, 19 nt, Artificial Sequence
  RNA Oligomer
caugauaugucuucaagga

SEQ ID NO: 3020 - RNA, 19 nt, Artificial Sequence
  RNA Oligomer
uaucaaaagguaggauugu

SEQ ID NO: 3021 - RNA, 19 nt, Artificial Sequence
  RNA Oligomer
uagcuaagguuggcuugcc

SEQ ID NO: 3022 - RNA, 19 nt, Artificial Sequence
  RNA Oligomer
acaaacaagguuucugccc

SEQ ID NO: 3023 - RNA, 19 nt, Artificial Sequence
  RNA Oligomer
cauuuacagccugguaggg

SEQ ID NO: 3024 - RNA, 19 nt, Artificial Sequence
  RNA Oligomer
cacagaaguagacugcuca

SEQ ID NO: 3025 - RNA, 19 nt, Artificial Sequence
  RNA Oligomer
auugucaagacuugaggaa

SEQ ID NO: 3026 - RNA, 19 nt, Artificial Sequence
  RNA Oligomer
aagacuugaggaagaagga

SEQ ID NO: 3027 - RNA, 19 nt, Artificial Sequence
  RNA Oligomer
aucaccauuuaaugagguu

SEQ ID NO: 3028 - RNA, 19 nt, Artificial Sequence
  RNA Oligomer
caccauuuaaugagguuca

SEQ ID NO: 3029 - RNA, 19 nt, Artificial Sequence
  RNA Oligomer
aaggcaagaaccaguucuc

SEQ ID NO: 3030 - RNA, 19 nt, Artificial Sequence
  RNA Oligomer
uaaacaaccaaauccuggc

SEQ ID NO: 3031 - RNA, 19 nt, Artificial Sequence
  RNA Oligomer
gaaguuucagauaagcagg

SEQ ID NO: 3032 - RNA, 19 nt, Artificial Sequence
  RNA Oligomer
agcaaguugaggaguucca

SEQ ID NO: 3033 - RNA, 19 nt, Artificial Sequence
  RNA Oligomer
acaugauccuguaaagcag

SEQ ID NO: 3034 - RNA, 19 nt, Artificial Sequence
  RNA Oligomer
augauccuguaaagcagga

SEQ ID NO: 3035 - RNA, 19 nt, Artificial Sequence
  RNA Oligomer
auccuguaaagcaggauuc

SEQ ID NO: 3036 - RNA, 19 nt, Artificial Sequence
  RNA Oligomer
ucuagacagauuugguggc

SEQ ID NO: 3037 - RNA, 19 nt, Artificial Sequence
  RNA Oligomer
cucauuuccaaggugauga

SEQ ID NO: 3038 - RNA, 19 nt, Artificial Sequence
  RNA Oligomer
uugucaggcucuucaacug

SEQ ID NO: 3039 - RNA, 19 nt, Artificial Sequence
  RNA Oligomer
auagguccaaccaaggcug

SEQ ID NO: 3040 - RNA, 19 nt, Artificial Sequence
  RNA Oligomer
cauccugaagaucaaaggc

SEQ ID NO: 3041 - RNA, 19 nt, Artificial Sequence
  RNA Oligomer
ggcaacuuuucuuuaccgg

SEQ ID NO: 3042 - RNA, 19 nt, Artificial Sequence
  RNA Oligomer
ucggugugcagguaacugu

SEQ ID NO: 3043 - RNA, 19 nt, Artificial Sequence
  RNA Oligomer
aacauggacgucauagccc

SEQ ID NO: 3044 - RNA, 19 nt, Artificial Sequence
  RNA Oligomer
agggugacuagaguacugu

SEQ ID NO: 3045 - RNA, 19 nt, Artificial Sequence
  RNA Oligomer
agagcgaaauuccaguucu

SEQ ID NO: 3046 - RNA, 19 nt, Artificial Sequence
  RNA Oligomer
acaaaauccuggcaguggg

SEQ ID NO: 3047 - RNA, 19 nt, Artificial Sequence
  RNA Oligomer
guggaaagguucucucucu

SEQ ID NO: 3048 - RNA, 19 nt, Artificial Sequence
  RNA Oligomer
aggccuagcauuuugcuag

SEQ ID NO: 3049 - RNA, 19 nt, Artificial Sequence
  RNA Oligomer
uuaucaaaagguaggauug

SEQ ID NO: 3050 - RNA, 19 nt, Artificial Sequence
  RNA Oligomer
guagcuaagguuggcuugc

SEQ ID NO: 3051 - RNA, 19 nt, Artificial Sequence
  RNA Oligomer
acacagaaguagacugcuc

SEQ ID NO: 3052 - RNA, 19 nt, Artificial Sequence
  RNA Oligomer
aauugucaagacuugagga

SEQ ID NO: 3053 - RNA, 19 nt, Artificial Sequence
  RNA Oligomer
acagaaggcaucaaaagcu

SEQ ID NO: 3054 - RNA, 19 nt, Artificial Sequence
  RNA Oligomer
uucucauaaaccaagguga

SEQ ID NO: 3055 - RNA, 19 nt, Artificial Sequence
  RNA Oligomer
uagaaagcagaaggguucu

SEQ ID NO: 3056 - RNA, 19 nt, Artificial Sequence
  RNA Oligomer
aguuucagauaagcaggga

SEQ ID NO: 3057 - RNA, 19 nt, Artificial Sequence
  RNA Oligomer
uacugaaagagaaagcagg

SEQ ID NO: 3058 - RNA, 19 nt, Artificial Sequence
  RNA Oligomer
cuguaaagcaggauucuag

SEQ ID NO: 3059 - RNA, 19 nt, Artificial Sequence
  RNA Oligomer
ugccaucuacaaaagcugg

SEQ ID NO: 3060 - RNA, 19 nt, Artificial Sequence
  RNA Oligomer
aucuacaaaagcuggaacu

SEQ ID NO: 3061 - RNA, 19 nt, Artificial Sequence
  RNA Oligomer
acugugcaaaauucugcag

SEQ ID NO: 3062 - RNA, 19 nt, Artificial Sequence
  RNA Oligomer
uccugaugaugaggaugca

SEQ ID NO: 3063 - RNA, 19 nt, Artificial Sequence
  RNA Oligomer
uaugucgacccaaaggcag

SEQ ID NO: 3064 - RNA, 19 nt, Artificial Sequence
  RNA Oligomer
uuuugcuagggaccauggg

SEQ ID NO: 3065 - RNA, 19 nt, Artificial Sequence
  RNA Oligomer
uuugcuagggaccauggga

SEQ ID NO: 3066 - RNA, 19 nt, Artificial Sequence
  RNA Oligomer
aaggagcuaaaaaugccag

SEQ ID NO: 3067 - RNA, 19 nt, Artificial Sequence
  RNA Oligomer
ugcaauaaaugcaaugagg

SEQ ID NO: 3068 - RNA, 19 nt, Artificial Sequence
  RNA Oligomer
aagggcaggaaagagcaca

SEQ ID NO: 3069 - RNA, 19 nt, Artificial Sequence
  RNA Oligomer
gagcacaaaauuagaagcu

SEQ ID NO: 3070 - RNA, 19 nt, Artificial Sequence
  RNA Oligomer
uuaaacaaccaaauccugg

SEQ ID NO: 3071 - RNA, 19 nt, Artificial Sequence
  RNA Oligomer
ggaugaaaaucaggcucuu

SEQ ID NO: 3072 - RNA, 19 nt, Artificial Sequence
  RNA Oligomer
ggcugggaauaaauuuuua

SEQ ID NO: 3073 - RNA, 19 nt, Artificial Sequence
  RNA Oligomer
cgaggacacuucaaaagau

SEQ ID NO: 3074 - RNA, 19 nt, Artificial Sequence
  RNA Oligomer
ccaacuggaacaaugaguu

SEQ ID NO: 3075 - RNA, 19 nt, Artificial Sequence
  RNA Oligomer
ucaauuuucuggcaaggaa

SEQ ID NO: 3076 - RNA, 19 nt, Artificial Sequence
  RNA Oligomer
uggcugggaauaaauuuuu

SEQ ID NO: 3077 - RNA, 19 nt, Artificial Sequence
  RNA Oligomer
gggaugaaaaucaggcucu

SEQ ID NO: 3078 - RNA, 19 nt, Artificial Sequence
  RNA Oligomer
uggcuuuagucuugaucau

SEQ ID NO: 3079 - RNA, 19 nt, Artificial Sequence
  RNA Oligomer
ggaggcaauuagacaaaaa

SEQ ID NO: 3080 - RNA, 19 nt, Artificial Sequence
  RNA Oligomer
cgaguuauuuuggguucaa

SEQ ID NO: 3081 - RNA, 19 nt, Artificial Sequence
  RNA Oligomer
gccugaauuuuaacugcau

SEQ ID NO: 3082 - RNA, 19 nt, Artificial Sequence
  RNA Oligomer
cacuauaccauacuuccuu

SEQ ID NO: 3083 - RNA, 19 nt, Artificial Sequence
  RNA Oligomer
cacuuucugaguuaucaua

SEQ ID NO: 3084 - RNA, 19 nt, Artificial Sequence
  RNA Oligomer
gcaacaaguaucaugaugg

SEQ ID NO: 3085 - RNA, 19 nt, Artificial Sequence
  RNA Oligomer
uccuggaacuucacaugaa

SEQ ID NO: 3086 - RNA, 19 nt, Artificial Sequence
  RNA Oligomer
ucgucuucuuucucagccu

SEQ ID NO: 3087 - RNA, 19 nt, Artificial Sequence
  RNA Oligomer
auguuuucaucgucuucuu

SEQ ID NO: 3088 - RNA, 19 nt, Artificial Sequence
  RNA Oligomer
cucuggcuuuagucuugau

SEQ ID NO: 3089 - RNA, 19 nt, Artificial Sequence
  RNA Oligomer
ccacugaauugcuaaggac

SEQ ID NO: 3090 - RNA, 19 nt, Artificial Sequence
  RNA Oligomer
acaacaaggagagcuucua

SEQ ID NO: 3091 - RNA, 19 nt, Artificial Sequence
  RNA Oligomer
agguguucauuucuauuac

SEQ ID NO: 3092 - RNA, 19 nt, Artificial Sequence
  RNA Oligomer
cgcugcucuucugaaaucu

SEQ ID NO: 3093 - RNA, 19 nt, Artificial Sequence
  RNA Oligomer
gcccuuacuaacgacccaa

SEQ ID NO: 3094 - RNA, 19 nt, Artificial Sequence
  RNA Oligomer
ccauacuuccuuagcuuau

SEQ ID NO: 3095 - RNA, 19 nt, Artificial Sequence
  RNA Oligomer
cggcugggaugaaaaucag

SEQ ID NO: 3096 - RNA, 19 nt, Artificial Sequence
  RNA Oligomer
caagagcuuuugagugguu

SEQ ID NO: 3097 - RNA, 19 nt, Artificial Sequence
  RNA Oligomer
cugcucuucugaaaucuau

SEQ ID NO: 3098 - RNA, 19 nt, Artificial Sequence
  RNA Oligomer
cccugacagauguauuuca

SEQ ID NO: 3099 - RNA, 19 nt, Artificial Sequence
  RNA Oligomer
caacaaguaucaugauggg

SEQ ID NO: 3100 - RNA, 19 nt, Artificial Sequence
  RNA Oligomer
agcaacaaguaucaugaug

SEQ ID NO: 3101 - RNA, 19 nt, Artificial Sequence
  RNA Oligomer
gccgaagagcaacaaguau

SEQ ID NO: 3102 - RNA, 19 nt, Artificial Sequence
  RNA Oligomer
ucaucgucuucuuucucag

SEQ ID NO: 3103 - RNA, 19 nt, Artificial Sequence
  RNA Oligomer
ggcuuuagucuugaucaug

SEQ ID NO: 3104 - RNA, 19 nt, Artificial Sequence
  RNA Oligomer
gcacugugccugaauuuua

SEQ ID NO: 3105 - RNA, 19 nt, Artificial Sequence
  RNA Oligomer
cuauaccauacuuccuuag

SEQ ID NO: 3106 - RNA, 19 nt, Artificial Sequence
  RNA Oligomer
gcaguauuggcguguucuu

SEQ ID NO: 3107 - RNA, 19 nt, Artificial Sequence
  RNA Oligomer
caaugaguucaagcagauu

SEQ ID NO: 3108 - RNA, 19 nt, Artificial Sequence
  RNA Oligomer
gacgugauuacaggcuuaa

SEQ ID NO: 3109 - RNA, 19 nt, Artificial Sequence
  RNA Oligomer
cucuucacauagcuuuaca

SEQ ID NO: 3110 - RNA, 19 nt, Artificial Sequence
  RNA Oligomer
ugggaugaaaaucaggcuc

SEQ ID NO: 3111 - RNA, 19 nt, Artificial Sequence
  RNA Oligomer
ccggcugggaugaaaauca

SEQ ID NO: 3112 - RNA, 19 nt, Artificial Sequence
  RNA Oligomer
ucacuuucugaguuaucau

SEQ ID NO: 3113 - RNA, 19 nt, Artificial Sequence
  RNA Oligomer
cuauaugguacaaaugcag

SEQ ID NO: 3114 - RNA, 19 nt, Artificial Sequence
  RNA Oligomer
ccuucgcugcucuucugaa

SEQ ID NO: 3115 - RNA, 19 nt, Artificial Sequence
  RNA Oligomer
cccaggaagacuuuuucag

SEQ ID NO: 3116 - RNA, 19 nt, Artificial Sequence
  RNA Oligomer
agagcaacaaguaucauga

SEQ ID NO: 3117 - RNA, 19 nt, Artificial Sequence
  RNA Oligomer
ccgaagagcaacaaguauc

SEQ ID NO: 3118 - RNA, 19 nt, Artificial Sequence
  RNA Oligomer
cggcuuggaaauggauuuu

SEQ ID NO: 3119 - RNA, 19 nt, Artificial Sequence
  RNA Oligomer
acaaacacaaccacugaau

SEQ ID NO: 3120 - RNA, 19 nt, Artificial Sequence
  RNA Oligomer
gcauuucuucaaccuggaa

SEQ ID NO: 3121 - RNA, 19 nt, Artificial Sequence
  RNA Oligomer
accucagauuucacaaacu

SEQ ID NO: 3122 - RNA, 19 nt, Artificial Sequence
  RNA Oligomer
agacaaaaaccucagauuu

SEQ ID NO: 3123 - RNA, 19 nt, Artificial Sequence
  RNA Oligomer
ucauaagaggaacaaguau

SEQ ID NO: 3124 - RNA, 19 nt, Artificial Sequence
  RNA Oligomer
cugcaugcuaauucuaaua

SEQ ID NO: 3125 - RNA, 19 nt, Artificial Sequence
  RNA Oligomer
cccuuacuaacgacccaac

SEQ ID NO: 3126 - RNA, 19 nt, Artificial Sequence
  RNA Oligomer
acacgaguuauuuuggguu

SEQ ID NO: 3127 - RNA, 19 nt, Artificial Sequence
  RNA Oligomer
auggcugggaauaaauuuu

SEQ ID NO: 3128 - RNA, 19 nt, Artificial Sequence
  RNA Oligomer
ccaggcauuguguuuucaa

SEQ ID NO: 3129 - RNA, 19 nt, Artificial Sequence
  RNA Oligomer
agagguguucauuucuauu

SEQ ID NO: 3130 - RNA, 19 nt, Artificial Sequence
  RNA Oligomer
gaggacacuucaaaagaug

SEQ ID NO: 3131 - RNA, 19 nt, Artificial Sequence
  RNA Oligomer
cgugauuacaggcuuaaag

SEQ ID NO: 3132 - RNA, 19 nt, Artificial Sequence
  RNA Oligomer
cugggaugaaaaucaggcu

SEQ ID NO: 3133 - RNA, 19 nt, Artificial Sequence
  RNA Oligomer
gcaagagcuuuugaguggu

SEQ ID NO: 3134 - RNA, 19 nt, Artificial Sequence
  RNA Oligomer
ggauuuugaaugagggucu

SEQ ID NO: 3135 - RNA, 19 nt, Artificial Sequence
  RNA Oligomer
agcugagcaagguguauuu

SEQ ID NO: 3136 - RNA, 19 nt, Artificial Sequence
  RNA Oligomer
gcugcucuucugaaaucua

SEQ ID NO: 3137 - RNA, 19 nt, Artificial Sequence
  RNA Oligomer
ccugacagauguauuucac

SEQ ID NO: 3138 - RNA, 19 nt, Artificial Sequence
  RNA Oligomer
gaagagcaacaaguaucau

SEQ ID NO: 3139 - RNA, 19 nt, Artificial Sequence
  RNA Oligomer
cuggcgauuucaacaagaa

SEQ ID NO: 3140 - RNA, 19 nt, Artificial Sequence
  RNA Oligomer
ucggauuguucgaggccaa

SEQ ID NO: 3141 - RNA, 19 nt, Artificial Sequence
  RNA Oligomer
cgcauuucuucaaccugga

SEQ ID NO: 3142 - RNA, 19 nt, Artificial Sequence
  RNA Oligomer
aggaggcaauuagacaaaa

SEQ ID NO: 3143 - RNA, 19 nt, Artificial Sequence
  RNA Oligomer
gcaugcuaauucuaauacc

SEQ ID NO: 3144 - RNA, 19 nt, Artificial Sequence
  RNA Oligomer
cacugugccugaauuuuaa

SEQ ID NO: 3145 - RNA, 19 nt, Artificial Sequence
  RNA Oligomer
acguucuacugguaugaag

SEQ ID NO: 3146 - RNA, 19 nt, Artificial Sequence
  RNA Oligomer
cacguucuacugguaugaa

SEQ ID NO: 3147 - RNA, 19 nt, Artificial Sequence
  RNA Oligomer
gucauauacaacagaacaa

SEQ ID NO: 3148 - RNA, 19 nt, Artificial Sequence
  RNA Oligomer
ucauggcugggaauaaauu

SEQ ID NO: 3149 - RNA, 19 nt, Artificial Sequence
  RNA Oligomer
caggcauuguguuuucaau

SEQ ID NO: 3150 - RNA, 19 nt, Artificial Sequence
  RNA Oligomer
agagcuucuagacuuugga

SEQ ID NO: 3151 - RNA, 19 nt, Artificial Sequence
  RNA Oligomer
acgugauuacaggcuuaaa

SEQ ID NO: 3152 - RNA, 19 nt, Artificial Sequence
  RNA Oligomer
ggacgaaaauacugacgug

SEQ ID NO: 3153 - RNA, 19 nt, Artificial Sequence
  RNA Oligomer
cugaaaucuauaugguaca

SEQ ID NO: 3154 - RNA, 19 nt, Artificial Sequence
  RNA Oligomer
auaauuagguucuggcgau

SEQ ID NO: 3155 - RNA, 19 nt, Artificial Sequence
  RNA Oligomer
uuguaugcaugugaaagaa

SEQ ID NO: 3156 - RNA, 19 nt, Artificial Sequence
  RNA Oligomer
cccgugccucaauuuucug

SEQ ID NO: 3157 - RNA, 19 nt, Artificial Sequence
  RNA Oligomer
ugcacaacaucaccuucug

SEQ ID NO: 3158 - RNA, 19 nt, Artificial Sequence
  RNA Oligomer
cugcacaacaucaccuucu

SEQ ID NO: 3159 - RNA, 19 nt, Artificial Sequence
  RNA Oligomer
cucugcacaacaucaccuu

SEQ ID NO: 3160 - RNA, 19 nt, Artificial Sequence
  RNA Oligomer
gaaauuuccugacagccga

SEQ ID NO: 3161 - RNA, 19 nt, Artificial Sequence
  RNA Oligomer
gucucucucugcacaacau

SEQ ID NO: 3162 - RNA, 19 nt, Artificial Sequence
  RNA Oligomer
cacacaccauguuuucauc

SEQ ID NO: 3163 - RNA, 19 nt, Artificial Sequence
  RNA Oligomer
accacugaauugcuaagga

SEQ ID NO: 3164 - RNA, 19 nt, Artificial Sequence
  RNA Oligomer
ucguggcgcauuucuucaa

SEQ ID NO: 3165 - RNA, 19 nt, Artificial Sequence
  RNA Oligomer
gaggcaauuagacaaaaac

SEQ ID NO: 3166 - RNA, 19 nt, Artificial Sequence
  RNA Oligomer
cacgaguuauuuuggguuc

SEQ ID NO: 3167 - RNA, 19 nt, Artificial Sequence
  RNA Oligomer
cuacugguaugaagaggag

SEQ ID NO: 3168 - RNA, 19 nt, Artificial Sequence
  RNA Oligomer
acacguucuacugguauga

SEQ ID NO: 3169 - RNA, 19 nt, Artificial Sequence
  RNA Oligomer
cucauggcugggaauaaau

SEQ ID NO: 3170 - RNA, 19 nt, Artificial Sequence
  RNA Oligomer
ccacuuguauucaucagcu

SEQ ID NO: 3171 - RNA, 19 nt, Artificial Sequence
  RNA Oligomer
accauauuaguacucucau

SEQ ID NO: 3172 - RNA, 19 nt, Artificial Sequence
  RNA Oligomer
cugacgugauuacaggcuu

SEQ ID NO: 3173 - RNA, 19 nt, Artificial Sequence
  RNA Oligomer
cgggaugcaagagcuuuug

SEQ ID NO: 3174 - RNA, 19 nt, Artificial Sequence
  RNA Oligomer
cucuucugaaaucuauaug

SEQ ID NO: 3175 - RNA, 19 nt, Artificial Sequence
  RNA Oligomer
cuuguaugcaugugaaaga

SEQ ID NO: 3176 - RNA, 19 nt, Artificial Sequence
  RNA Oligomer
gucuuguaugcaugugaaa

SEQ ID NO: 3177 - RNA, 19 nt, Artificial Sequence
  RNA Oligomer
gaagaaauuuccugacagc

SEQ ID NO: 3178 - RNA, 19 nt, Artificial Sequence
  RNA Oligomer
uccuaugaguuguucuggu

SEQ ID NO: 3179 - RNA, 19 nt, Artificial Sequence
  RNA Oligomer
cucucuggcuuuagucuug

SEQ ID NO: 3180 - RNA, 19 nt, Artificial Sequence
  RNA Oligomer
ugaucucucuggcuuuagu

SEQ ID NO: 3181 - RNA, 19 nt, Artificial Sequence
  RNA Oligomer
cacaaacacaaccacugaa

SEQ ID NO: 3182 - RNA, 19 nt, Artificial Sequence
  RNA Oligomer
cccacaaacacaaccacug

SEQ ID NO: 3183 - RNA, 19 nt, Artificial Sequence
  RNA Oligomer
uagacaaaaaccucagauu

SEQ ID NO: 3184 - RNA, 19 nt, Artificial Sequence
  RNA Oligomer
uuagacaaaaaccucagau

SEQ ID NO: 3185 - RNA, 19 nt, Artificial Sequence
  RNA Oligomer
gucagucgaaaccuuauuu

SEQ ID NO: 3186 - RNA, 19 nt, Artificial Sequence
  RNA Oligomer
cuaauucuaauaccuguca

SEQ ID NO: 3187 - RNA, 19 nt, Artificial Sequence
  RNA Oligomer
ugcaugcuaauucuaauac

SEQ ID NO: 3188 - RNA, 19 nt, Artificial Sequence
  RNA Oligomer
ccugaauuuuaacugcaug

SEQ ID NO: 3189 - RNA, 19 nt, Artificial Sequence
  RNA Oligomer
acgaguuauuuuggguuca

SEQ ID NO: 3190 - RNA, 19 nt, Artificial Sequence
  RNA Oligomer
ugacacguucuacugguau

SEQ ID NO: 3191 - RNA, 19 nt, Artificial Sequence
  RNA Oligomer
cccagagguguucauuucu

SEQ ID NO: 3192 - RNA, 19 nt, Artificial Sequence
  RNA Oligomer
caccauauuaguacucuca

SEQ ID NO: 3193 - RNA, 19 nt, Artificial Sequence
  RNA Oligomer
gggacgaaaauacugacgu

SEQ ID NO: 3194 - RNA, 19 nt, Artificial Sequence
  RNA Oligomer
gguuugcugaucucuuacu

SEQ ID NO: 3195 - RNA, 19 nt, Artificial Sequence
  RNA Oligomer
ugcucuucugaaaucuaua

SEQ ID NO: 3196 - RNA, 19 nt, Artificial Sequence
  RNA Oligomer
gggugcuggauuuugaaug

SEQ ID NO: 3197 - RNA, 19 nt, Artificial Sequence
  RNA Oligomer
gcguggcuuuaaaauggcg

SEQ ID NO: 3198 - RNA, 19 nt, Artificial Sequence
  RNA Oligomer
ccuguggucuuguaugcau

SEQ ID NO: 3199 - RNA, 19 nt, Artificial Sequence
  RNA Oligomer
acaucaccuucuguagaga

SEQ ID NO: 3200 - RNA, 19 nt, Artificial Sequence
  RNA Oligomer
cuggugaucucucuggcuu

SEQ ID NO: 3201 - RNA, 19 nt, Artificial Sequence
  RNA Oligomer
gcgcauuucuucaaccugg

SEQ ID NO: 3202 - RNA, 19 nt, Artificial Sequence
  RNA Oligomer
cguggcgcauuucuucaac

SEQ ID NO: 3203 - RNA, 19 nt, Artificial Sequence
  RNA Oligomer
gcaauuagacaaaaaccuc

SEQ ID NO: 3204 - RNA, 19 nt, Artificial Sequence
  RNA Oligomer
acugcaugcuaauucuaau

SEQ ID NO: 3205 - RNA, 19 nt, Artificial Sequence
  RNA Oligomer
ugccugaauuuuaacugca

SEQ ID NO: 3206 - RNA, 19 nt, Artificial Sequence
  RNA Oligomer
gacacguucuacugguaug

SEQ ID NO: 3207 - RNA, 19 nt, Artificial Sequence
  RNA Oligomer
guccaggcauuguguuuuc

SEQ ID NO: 3208 - RNA, 19 nt, Artificial Sequence
  RNA Oligomer
ccuggaaacacggaugagu

SEQ ID NO: 3209 - RNA, 19 nt, Artificial Sequence
  RNA Oligomer
gcccugacagauguauuuc

SEQ ID NO: 3210 - RNA, 19 nt, Artificial Sequence
  RNA Oligomer
guucuggcgauuucaacaa

SEQ ID NO: 3211 - RNA, 19 nt, Artificial Sequence
  RNA Oligomer
uggucuuguaugcauguga

SEQ ID NO: 3212 - RNA, 19 nt, Artificial Sequence
  RNA Oligomer
ucggcuuggaaauggauuu

SEQ ID NO: 3213 - RNA, 19 nt, Artificial Sequence
  RNA Oligomer
caggugagggagaagaaau

SEQ ID NO: 3214 - RNA, 19 nt, Artificial Sequence
  RNA Oligomer
acaggugagggagaagaaa

SEQ ID NO: 3215 - RNA, 19 nt, Artificial Sequence
  RNA Oligomer
acaucguggcgcauuucuu

SEQ ID NO: 3216 - RNA, 19 nt, Artificial Sequence
  RNA Oligomer
caauuagacaaaaaccuca

SEQ ID NO: 3217 - RNA, 19 nt, Artificial Sequence
  RNA Oligomer
gcuaauucuaauaccuguc

SEQ ID NO: 3218 - RNA, 19 nt, Artificial Sequence
  RNA Oligomer
ugcuaauucuaauaccugu

SEQ ID NO: 3219 - RNA, 19 nt, Artificial Sequence
  RNA Oligomer
ugaauuuuaacugcaugcu

SEQ ID NO: 3220 - RNA, 19 nt, Artificial Sequence
  RNA Oligomer
gaguuauuuuggguucaac

SEQ ID NO: 3221 - RNA, 19 nt, Artificial Sequence
  RNA Oligomer
cacacgaguuauuuugggu

SEQ ID NO: 3222 - RNA, 19 nt, Artificial Sequence
  RNA Oligomer
guguucuucuguggaccua

SEQ ID NO: 3223 - RNA, 19 nt, Artificial Sequence
  RNA Oligomer
guauuggcguguucuucug

SEQ ID NO: 3224 - RNA, 19 nt, Artificial Sequence
  RNA Oligomer
acgaaaauacugacgugau

SEQ ID NO: 3225 - RNA, 19 nt, Artificial Sequence
  RNA Oligomer
cugaucucuuacucucccu

SEQ ID NO: 3226 - RNA, 19 nt, Artificial Sequence
  RNA Oligomer
gcuuuugagugguuugcug

SEQ ID NO: 3227 - RNA, 19 nt, Artificial Sequence
  RNA Oligomer
aagagcuuuugagugguuu

SEQ ID NO: 3228 - RNA, 19 nt, Artificial Sequence
  RNA Oligomer
gggaugcaagagcuuuuga

SEQ ID NO: 3229 - RNA, 19 nt, Artificial Sequence
  RNA Oligomer
cuacuggauuugccgggau

SEQ ID NO: 3230 - RNA, 19 nt, Artificial Sequence
  RNA Oligomer
uggugaucucucuggcuuu

SEQ ID NO: 3231 - RNA, 19 nt, Artificial Sequence
  RNA Oligomer
caaccacugaauugcuaag

SEQ ID NO: 3232 - RNA, 19 nt, Artificial Sequence
  RNA Oligomer
cacaggugagggagaagaa

SEQ ID NO: 3233 - RNA, 19 nt, Artificial Sequence
  RNA Oligomer
acacaggugagggagaaga

SEQ ID NO: 3234 - RNA, 19 nt, Artificial Sequence
  RNA Oligomer
caugcuaauucuaauaccu

SEQ ID NO: 3235 - RNA, 19 nt, Artificial Sequence
  RNA Oligomer
augaagaggaggagucuuu

SEQ ID NO: 3236 - RNA, 19 nt, Artificial Sequence
  RNA Oligomer
cugguaugaagaggaggag

SEQ ID NO: 3237 - RNA, 19 nt, Artificial Sequence
  RNA Oligomer
uugacacguucuacuggua

SEQ ID NO: 3238 - RNA, 19 nt, Artificial Sequence
  RNA Oligomer
uguuuauugacacguucua

SEQ ID NO: 3239 - RNA, 19 nt, Artificial Sequence
  RNA Oligomer
gacggccuguugauaugag

SEQ ID NO: 3240 - RNA, 19 nt, Artificial Sequence
  RNA Oligomer
uccaggcauuguguuuuca

SEQ ID NO: 3241 - RNA, 19 nt, Artificial Sequence
  RNA Oligomer
uucaaaagaugugccacuu

SEQ ID NO: 3242 - RNA, 19 nt, Artificial Sequence
  RNA Oligomer
agcuuuacacugggacgaa

SEQ ID NO: 3243 - RNA, 19 nt, Artificial Sequence
  RNA Oligomer
gcuuuaaaauggcgccagg

SEQ ID NO: 3244 - RNA, 19 nt, Artificial Sequence
  RNA Oligomer
caagaaguugucauuacca

SEQ ID NO: 3245 - RNA, 19 nt, Artificial Sequence
  RNA Oligomer
acaagaaguugucauuacc

SEQ ID NO: 3246 - RNA, 19 nt, Artificial Sequence
  RNA Oligomer
guggucuuguaugcaugug

SEQ ID NO: 3247 - RNA, 19 nt, Artificial Sequence
  RNA Oligomer
cgucuucuuucucagccug

SEQ ID NO: 3248 - RNA, 19 nt, Artificial Sequence
  RNA Oligomer
gguaugaagaggaggaguc

SEQ ID NO: 3249 - RNA, 19 nt, Artificial Sequence
  RNA Oligomer
cuguugauaugagcuccca

SEQ ID NO: 3250 - RNA, 19 nt, Artificial Sequence
  RNA Oligomer
gccuguugauaugagcucc

SEQ ID NO: 3251 - RNA, 19 nt, Artificial Sequence
  RNA Oligomer
aguccaggcauuguguuuu

SEQ ID NO: 3252 - RNA, 19 nt, Artificial Sequence
  RNA Oligomer
gacgaaaauacugacguga

SEQ ID NO: 3253 - RNA, 19 nt, Artificial Sequence
  RNA Oligomer
ugaucucuuacucucccug

SEQ ID NO: 3254 - RNA, 19 nt, Artificial Sequence
  RNA Oligomer
gaagcugagcaagguguau

SEQ ID NO: 3255 - RNA, 19 nt, Artificial Sequence
  RNA Oligomer
gugcuggauuuugaaugag

SEQ ID NO: 3256 - RNA, 19 nt, Artificial Sequence
  RNA Oligomer
ccucggcuuggaaauggau

SEQ ID NO: 3257 - RNA, 19 nt, Artificial Sequence
  RNA Oligomer
cuucuguagagaccgcuau

SEQ ID NO: 3258 - RNA, 19 nt, Artificial Sequence
  RNA Oligomer
ccuucuguagagaccgcua

SEQ ID NO: 3259 - RNA, 19 nt, Artificial Sequence
  RNA Oligomer
cagucucucucugcacaac

SEQ ID NO: 3260 - RNA, 19 nt, Artificial Sequence
  RNA Oligomer
cugugccugaauuuuaacu

SEQ ID NO: 3261 - RNA, 19 nt, Artificial Sequence
  RNA Oligomer
aucuguuuauugacacguu

SEQ ID NO: 3262 - RNA, 19 nt, Artificial Sequence
  RNA Oligomer
caaguccaggcauuguguu

SEQ ID NO: 3263 - RNA, 19 nt, Artificial Sequence
  RNA Oligomer
gucaaguccaggcauugug

SEQ ID NO: 3264 - RNA, 19 nt, Artificial Sequence
  RNA Oligomer
cacuuguauucaucagcug

SEQ ID NO: 3265 - RNA, 19 nt, Artificial Sequence
  RNA Oligomer
gccacuuguauucaucagc

SEQ ID NO: 3266 - RNA, 19 nt, Artificial Sequence
  RNA Oligomer
ugccacuuguauucaucag

SEQ ID NO: 3267 - RNA, 19 nt, Artificial Sequence
  RNA Oligomer
ucaaaagaugugccacuug

SEQ ID NO: 3268 - RNA, 19 nt, Artificial Sequence
  RNA Oligomer
ugaagcugagcaaggugua

SEQ ID NO: 3269 - RNA, 19 nt, Artificial Sequence
  RNA Oligomer
cuguggucuuguaugcaug

SEQ ID NO: 3270 - RNA, 19 nt, Artificial Sequence
  RNA Oligomer
ggcuuggaaauggauuuua

SEQ ID NO: 3271 - RNA, 19 nt, Artificial Sequence
  RNA Oligomer
caaguuauugauuccaaag

SEQ ID NO: 3272 - RNA, 19 nt, Artificial Sequence
  RNA Oligomer
gcauuguguuuucaaucaa

SEQ ID NO: 3273 - RNA, 19 nt, Artificial Sequence
  RNA Oligomer
augugccacuuguauucau

SEQ ID NO: 3274 - RNA, 19 nt, Artificial Sequence
  RNA Oligomer
aggcucuucacauagcuuu

SEQ ID NO: 3275 - RNA, 19 nt, Artificial Sequence
  RNA Oligomer
cacugaagcugagcaaggu

SEQ ID NO: 3276 - RNA, 19 nt, Artificial Sequence
  RNA Oligomer
cagggcaguacaucuuggu

SEQ ID NO: 3277 - RNA, 19 nt, Artificial Sequence
  RNA Oligomer
ggauuuuaggcccuguggu

SEQ ID NO: 3278 - RNA, 19 nt, Artificial Sequence
  RNA Oligomer
ccgggaugcaagagcuuuu

SEQ ID NO: 3279 - RNA, 19 nt, Artificial Sequence
  RNA Oligomer
gaaaaagcguggcuuuaaa

SEQ ID NO: 3280 - RNA, 19 nt, Artificial Sequence
  RNA Oligomer
uggaacuucacaugaaaaa

SEQ ID NO: 3281 - RNA, 19 nt, Artificial Sequence
  RNA Oligomer
cccuguggucuuguaugca

SEQ ID NO: 3282 - RNA, 19 nt, Artificial Sequence
  RNA Oligomer
uuccauuacacacgaguua

SEQ ID NO: 3283 - RNA, 19 nt, Artificial Sequence
  RNA Oligomer
ucuguuuauugacacguuc

SEQ ID NO: 3284 - RNA, 19 nt, Artificial Sequence
  RNA Oligomer
agaugugccacuuguauuc

SEQ ID NO: 3285 - RNA, 19 nt, Artificial Sequence
  RNA Oligomer
ggcccaacuggaacaauga

SEQ ID NO: 3286 - RNA, 19 nt, Artificial Sequence
  RNA Oligomer
acaggcuuaaagcagaaga

SEQ ID NO: 3287 - RNA, 19 nt, Artificial Sequence
  RNA Oligomer
gcgauuucaacaagaaguu

SEQ ID NO: 3288 - RNA, 19 nt, Artificial Sequence
  RNA Oligomer
gguacacacaccauguuuu

SEQ ID NO: 3289 - RNA, 19 nt, Artificial Sequence
  RNA Oligomer
acuggaacaaugaguucaa

SEQ ID NO: 3290 - RNA, 19 nt, Artificial Sequence
  RNA Oligomer
caggcuuaaagcagaagac

SEQ ID NO: 3291 - RNA, 19 nt, Artificial Sequence
  RNA Oligomer
caggcucuucacauagcuu

SEQ ID NO: 3292 - RNA, 19 nt, Artificial Sequence
  RNA Oligomer
ggaugcaagagcuuuugag

SEQ ID NO: 3293 - RNA, 19 nt, Artificial Sequence
  RNA Oligomer
gacagccgaagagcaacaa

SEQ ID NO: 3294 - RNA, 19 nt, Artificial Sequence
  RNA Oligomer
cuaugggauagcuguuaau

SEQ ID NO: 3295 - RNA, 19 nt, Artificial Sequence
  RNA Oligomer
ccuaugggauagcuguuaa

SEQ ID NO: 3296 - RNA, 19 nt, Artificial Sequence
  RNA Oligomer
gucgaaaccuuauuucauu

SEQ ID NO: 3297 - RNA, 19 nt, Artificial Sequence
  RNA Oligomer
ggcauuguguuuucaauca

SEQ ID NO: 3298 - RNA, 19 nt, Artificial Sequence
  RNA Oligomer
agguguauuucuacuggau

SEQ ID NO: 3299 - RNA, 19 nt, Artificial Sequence
  RNA Oligomer
gcaagguguauuucuacug

SEQ ID NO: 3300 - RNA, 19 nt, Artificial Sequence
  RNA Oligomer
ggaagacuuuuucagcgug

SEQ ID NO: 3301 - RNA, 19 nt, Artificial Sequence
  RNA Oligomer
gccucaauuuucuggcaag

SEQ ID NO: 3302 - RNA, 19 nt, Artificial Sequence
  RNA Oligomer
ggccuccuaugaguuguuc

SEQ ID NO: 3303 - RNA, 19 nt, Artificial Sequence
  RNA Oligomer
aggccuccuaugaguuguu

SEQ ID NO: 3304 - RNA, 19 nt, Artificial Sequence
  RNA Oligomer
gaauugcuaaggacaauag

SEQ ID NO: 3305 - RNA, 19 nt, Artificial Sequence
  RNA Oligomer
cccaacuggaacaaugagu

SEQ ID NO: 3306 - RNA, 19 nt, Artificial Sequence
  RNA Oligomer
uuacaggcuuaaagcagaa

SEQ ID NO: 3307 - RNA, 19 nt, Artificial Sequence
  RNA Oligomer
ggcucuucacauagcuuua

SEQ ID NO: 3308 - RNA, 19 nt, Artificial Sequence
  RNA Oligomer
ucaggcucuucacauagcu

SEQ ID NO: 3309 - RNA, 19 nt, Artificial Sequence
  RNA Oligomer
caaaugcagugaggcacag

SEQ ID NO: 3310 - RNA, 19 nt, Artificial Sequence
  RNA Oligomer
ggaacuucacaugaaaaag

SEQ ID NO: 3311 - RNA, 19 nt, Artificial Sequence
  RNA Oligomer
ccuggaacuucacaugaaa

SEQ ID NO: 3312 - RNA, 19 nt, Artificial Sequence
  RNA Oligomer
gcuuggaaauggauuuuag

SEQ ID NO: 3313 - RNA, 19 nt, Artificial Sequence
  RNA Oligomer
ugccucaauuuucuggcaa

SEQ ID NO: 3314 - RNA, 19 nt, Artificial Sequence
  RNA Oligomer
ucauucauaagaggaacaa

SEQ ID NO: 3315 - RNA, 19 nt, Artificial Sequence
  RNA Oligomer
ccgcacugugccugaauuu

SEQ ID NO: 3316 - RNA, 19 nt, Artificial Sequence
  RNA Oligomer
ggagucuuuccauuacaca

SEQ ID NO: 3317 - RNA, 19 nt, Artificial Sequence
  RNA Oligomer
guacacuauaccauacuuc

SEQ ID NO: 3318 - RNA, 19 nt, Artificial Sequence
  RNA Oligomer
aguacacuauaccauacuu

SEQ ID NO: 3319 - RNA, 19 nt, Artificial Sequence
  RNA Oligomer
caguacacuauaccauacu

SEQ ID NO: 3320 - RNA, 19 nt, Artificial Sequence
  RNA Oligomer
ucuagacuuuggaggucaa

SEQ ID NO: 3321 - RNA, 19 nt, Artificial Sequence
  RNA Oligomer
caagcagauugccuacaau

SEQ ID NO: 3322 - RNA, 19 nt, Artificial Sequence
  RNA Oligomer
gaggcccaacuggaacaau

SEQ ID NO: 3323 - RNA, 19 nt, Artificial Sequence
  RNA Oligomer
agggucucuccaccauauu

SEQ ID NO: 3324 - RNA, 19 nt, Artificial Sequence
  RNA Oligomer
agauguauuucacuaccca

SEQ ID NO: 3325 - RNA, 19 nt, Artificial Sequence
  RNA Oligomer
ugaaaaagcguggcuuuaa

SEQ ID NO: 3326 - RNA, 19 nt, Artificial Sequence
  RNA Oligomer
ggcgauuucaacaagaagu

SEQ ID NO: 3327 - RNA, 19 nt, Artificial Sequence
  RNA Oligomer
ugacagccgaagagcaaca

SEQ ID NO: 3328 - RNA, 19 nt, Artificial Sequence
  RNA Oligomer
accauguuuucaucgucuu

SEQ ID NO: 3329 - RNA, 19 nt, Artificial Sequence
  RNA Oligomer
acacacaccauguuuucau

SEQ ID NO: 3330 - RNA, 19 nt, Artificial Sequence
  RNA Oligomer
cugguacacacaccauguu

SEQ ID NO: 3331 - RNA, 19 nt, Artificial Sequence
  RNA Oligomer
cacuuuccaagcugggcaa

SEQ ID NO: 3332 - RNA, 19 nt, Artificial Sequence
  RNA Oligomer
uccgcacugugccugaauu

SEQ ID NO: 3333 - RNA, 19 nt, Artificial Sequence
  RNA Oligomer
gucuuuccauuacacacga

SEQ ID NO: 3334 - RNA, 19 nt, Artificial Sequence
  RNA Oligomer
ggacacuucaaaagaugug

SEQ ID NO: 3335 - RNA, 19 nt, Artificial Sequence
  RNA Oligomer
cucucgaggacacuucaaa

SEQ ID NO: 3336 - RNA, 19 nt, Artificial Sequence
  RNA Oligomer
gcagauugccuacaaucac

SEQ ID NO: 3337 - RNA, 19 nt, Artificial Sequence
  RNA Oligomer
uccaccauauuaguacucu

SEQ ID NO: 3338 - RNA, 19 nt, Artificial Sequence
  RNA Oligomer
ggaacaaugaguucaagca

SEQ ID NO: 3339 - RNA, 19 nt, Artificial Sequence
  RNA Oligomer
cuccaccauauuaguacuc

SEQ ID NO: 3340 - RNA, 19 nt, Artificial Sequence
  RNA Oligomer
gguguauuucuacuggauu

SEQ ID NO: 3341 - RNA, 19 nt, Artificial Sequence
  RNA Oligomer
cagccgaagagcaacaagu

SEQ ID NO: 3342 - RNA, 19 nt, Artificial Sequence
  RNA Oligomer
ccaaacccaagacagucuc

SEQ ID NO: 3343 - RNA, 19 nt, Artificial Sequence
  RNA Oligomer
ugaauugcuaaggacaaua

SEQ ID NO: 3344 - RNA, 19 nt, Artificial Sequence
  RNA Oligomer
cugaauugcuaaggacaau

SEQ ID NO: 3345 - RNA, 19 nt, Artificial Sequence
  RNA Oligomer
ggaacaaguauuugcugca

SEQ ID NO: 3346 - RNA, 19 nt, Artificial Sequence
  RNA Oligomer
aggagucuuuccauuacac

SEQ ID NO: 3347 - RNA, 19 nt, Artificial Sequence
  RNA Oligomer
agaggaggagucuuuccau

SEQ ID NO: 3348 - RNA, 19 nt, Artificial Sequence
  RNA Oligomer
ccaguugggaacuggugaa

SEQ ID NO: 3349 - RNA, 19 nt, Artificial Sequence
  RNA Oligomer
ccaccauauuaguacucuc

SEQ ID NO: 3350 - RNA, 19 nt, Artificial Sequence
  RNA Oligomer
gcccaacuggaacaaugag

SEQ ID NO: 3351 - RNA, 19 nt, Artificial Sequence
  RNA Oligomer
gcucuucacauagcuuuac

SEQ ID NO: 3352 - RNA, 19 nt, Artificial Sequence
  RNA Oligomer
cuagggaagcccuuacuaa

SEQ ID NO: 3353 - RNA, 19 nt, Artificial Sequence
  RNA Oligomer
cagauguauuucacuaccc

SEQ ID NO: 3354 - RNA, 19 nt, Artificial Sequence
  RNA Oligomer
aggaagacuuuuucagcgu

SEQ ID NO: 3355 - RNA, 19 nt, Artificial Sequence
  RNA Oligomer
ggaguccuggaacuucaca

SEQ ID NO: 3356 - RNA, 19 nt, Artificial Sequence
  RNA Oligomer
agagaccgcuaugcagaau

SEQ ID NO: 3357 - RNA, 19 nt, Artificial Sequence
  RNA Oligomer
acccaagacagucucucuc

SEQ ID NO: 3358 - RNA, 19 nt, Artificial Sequence
  RNA Oligomer
gccaaacccaagacagucu

SEQ ID NO: 3359 - RNA, 19 nt, Artificial Sequence
  RNA Oligomer
ccauguuuucaucgucuuc

SEQ ID NO: 3360 - RNA, 19 nt, Artificial Sequence
  RNA Oligomer
gccuccuaugaguuguucu

SEQ ID NO: 3361 - RNA, 19 nt, Artificial Sequence
  RNA Oligomer
accugucagucgaaaccuu

SEQ ID NO: 3362 - RNA, 19 nt, Artificial Sequence
  RNA Oligomer
uccauuacacacgaguuau

SEQ ID NO: 3363 - RNA, 19 nt, Artificial Sequence
  RNA Oligomer
cucgaggacacuucaaaag

SEQ ID NO: 3364 - RNA, 19 nt, Artificial Sequence
  RNA Oligomer
aggcccaacuggaacaaug

SEQ ID NO: 3365 - RNA, 19 nt, Artificial Sequence
  RNA Oligomer
uaaagcagaagaccuucua

SEQ ID NO: 3366 - RNA, 19 nt, Artificial Sequence
  RNA Oligomer
acauagcuuuacacuggga

SEQ ID NO: 3367 - RNA, 19 nt, Artificial Sequence
  RNA Oligomer
ucacauagcuuuacacugg

SEQ ID NO: 3368 - RNA, 19 nt, Artificial Sequence
  RNA Oligomer
gggaaaacucacuuucuga

SEQ ID NO: 3369 - RNA, 19 nt, Artificial Sequence
  RNA Oligomer
caagguguauuucuacugg

SEQ ID NO: 3370 - RNA, 19 nt, Artificial Sequence
  RNA Oligomer
guauuucacuacccagugu

SEQ ID NO: 3371 - RNA, 19 nt, Artificial Sequence
  RNA Oligomer
gacagauguauuucacuac

SEQ ID NO: 3372 - RNA, 19 nt, Artificial Sequence
  RNA Oligomer
gaacccucggcuuggaaau

SEQ ID NO: 3373 - RNA, 19 nt, Artificial Sequence
  RNA Oligomer
gugccucaauuuucuggca

SEQ ID NO: 3374 - RNA, 19 nt, Artificial Sequence
  RNA Oligomer
caccauguuuucaucgucu

SEQ ID NO: 3375 - RNA, 19 nt, Artificial Sequence
  RNA Oligomer
acaccauguuuucaucguc

SEQ ID NO: 3376 - RNA, 19 nt, Artificial Sequence
  RNA Oligomer
gaguuguucugguacacac

SEQ ID NO: 3377 - RNA, 19 nt, Artificial Sequence
  RNA Oligomer
caacugaguucaucagaca

SEQ ID NO: 3378 - RNA, 19 nt, Artificial Sequence
  RNA Oligomer
ugaccucgucaacugaguu

SEQ ID NO: 3379 - RNA, 19 nt, Artificial Sequence
  RNA Oligomer
uccacaucguggcgcauuu

SEQ ID NO: 3380 - RNA, 19 nt, Artificial Sequence
  RNA Oligomer
gggauagcuguuaaugcaa

SEQ ID NO: 3381 - RNA, 19 nt, Artificial Sequence
  RNA Oligomer
ggcaauuagacaaaaaccu

SEQ ID NO: 3382 - RNA, 19 nt, Artificial Sequence
  RNA Oligomer
cuggaacaaugaguucaag

SEQ ID NO: 3383 - RNA, 19 nt, Artificial Sequence
  RNA Oligomer
ggcuuaaagcagaagaccu

SEQ ID NO: 3384 - RNA, 19 nt, Artificial Sequence
  RNA Oligomer
cucuuacucucccuggaaa

SEQ ID NO: 3385 - RNA, 19 nt, Artificial Sequence
  RNA Oligomer
gaagacuuuuucagcgugc

SEQ ID NO: 3386 - RNA, 19 nt, Artificial Sequence
  RNA Oligomer
gccauaucuucgcuggagu

SEQ ID NO: 3387 - RNA, 19 nt, Artificial Sequence
  RNA Oligomer
ggcuuuaaaauggcgccag

SEQ ID NO: 3388 - RNA, 19 nt, Artificial Sequence
  RNA Oligomer
cuggaacuucacaugaaaa

SEQ ID NO: 3389 - RNA, 19 nt, Artificial Sequence
  RNA Oligomer
ccaagacagucucucucug

SEQ ID NO: 3390 - RNA, 19 nt, Artificial Sequence
  RNA Oligomer
cggauuguucgaggccaaa

SEQ ID NO: 3391 - RNA, 19 nt, Artificial Sequence
  RNA Oligomer
cacaccauguuuucaucgu

SEQ ID NO: 3392 - RNA, 19 nt, Artificial Sequence
  RNA Oligomer
gaccucgucaacugaguuc

SEQ ID NO: 3393 - RNA, 19 nt, Artificial Sequence
  RNA Oligomer
uugaucaugaccucgucaa

SEQ ID NO: 3394 - RNA, 19 nt, Artificial Sequence
  RNA Oligomer
gucuugaucaugaccucgu

SEQ ID NO: 3395 - RNA, 19 nt, Artificial Sequence
  RNA Oligomer
cuaacgagagcuaccucaa

SEQ ID NO: 3396 - RNA, 19 nt, Artificial Sequence
  RNA Oligomer
acaaaaaccucagauuuca

SEQ ID NO: 3397 - RNA, 19 nt, Artificial Sequence
  RNA Oligomer
cuaauaccugucagucgaa

SEQ ID NO: 3398 - RNA, 19 nt, Artificial Sequence
  RNA Oligomer
ggaagcccuuacuaacgac

SEQ ID NO: 3399 - RNA, 19 nt, Artificial Sequence
  RNA Oligomer
cuaaagcucucucgaggac

SEQ ID NO: 3400 - RNA, 19 nt, Artificial Sequence
  RNA Oligomer
cagaagaccuucuauggga

SEQ ID NO: 3401 - RNA, 19 nt, Artificial Sequence
  RNA Oligomer
ggucucuccaccauauuag

SEQ ID NO: 3402 - RNA, 19 nt, Artificial Sequence
  RNA Oligomer
cucacuuucugaguuauca

SEQ ID NO: 3403 - RNA, 19 nt, Artificial Sequence
  RNA Oligomer
aaacucacuuucugaguua

SEQ ID NO: 3404 - RNA, 19 nt, Artificial Sequence
  RNA Oligomer
ggaaaacucacuuucugag

SEQ ID NO: 3405 - RNA, 19 nt, Artificial Sequence
  RNA Oligomer
acagauguauuucacuacc

SEQ ID NO: 3406 - RNA, 19 nt, Artificial Sequence
  RNA Oligomer
ugcccugacagauguauuu

SEQ ID NO: 3407 - RNA, 19 nt, Artificial Sequence
  RNA Oligomer
acaugaaaaagcguggcuu

SEQ ID NO: 3408 - RNA, 19 nt, Artificial Sequence
  RNA Oligomer
agccgaagagcaacaagua

SEQ ID NO: 3409 - RNA, 19 nt, Artificial Sequence
  RNA Oligomer
ccucaauuuucuggcaagg

SEQ ID NO: 3410 - RNA, 19 nt, Artificial Sequence
  RNA Oligomer
ugguacacacaccauguuu

SEQ ID NO: 3411 - RNA, 19 nt, Artificial Sequence
  RNA Oligomer
gggagaagaaauuuccuga

SEQ ID NO: 3412 - RNA, 19 nt, Artificial Sequence
  RNA Oligomer
ucaacugaguucaucagac

SEQ ID NO: 3413 - RNA, 19 nt, Artificial Sequence
  RNA Oligomer
ucagauuucacaaacuggu

SEQ ID NO: 3414 - RNA, 19 nt, Artificial Sequence
  RNA Oligomer
acaugucauauacaacaga

SEQ ID NO: 3415 - RNA, 19 nt, Artificial Sequence
  RNA Oligomer
auaccauacuuccuuagcu

SEQ ID NO: 3416 - RNA, 19 nt, Artificial Sequence
  RNA Oligomer
ugugaacaguacacuauac

SEQ ID NO: 3417 - RNA, 19 nt, Artificial Sequence
  RNA Oligomer
guacucucauggcugggaa

SEQ ID NO: 3418 - RNA, 19 nt, Artificial Sequence
  RNA Oligomer
agaagaccuucuaugggag

SEQ ID NO: 3419 - RNA, 19 nt, Artificial Sequence
  RNA Oligomer
ugagggucucuccaccaua

SEQ ID NO: 3420 - RNA, 19 nt, Artificial Sequence
  RNA Oligomer
ugagugguuugcugaucuc

SEQ ID NO: 3421 - RNA, 19 nt, Artificial Sequence
  RNA Oligomer
gaacuucacaugaaaaagc

SEQ ID NO: 3422 - RNA, 19 nt, Artificial Sequence
  RNA Oligomer
gaguccuggaacuucacau

SEQ ID NO: 3423 - RNA, 19 nt, Artificial Sequence
  RNA Oligomer
ucauuaccaaggugguaag

SEQ ID NO: 3424 - RNA, 19 nt, Artificial Sequence
  RNA Oligomer
gucauuaccaaggugguaa

SEQ ID NO: 3425 - RNA, 19 nt, Artificial Sequence
  RNA Oligomer
gagaccgcuaugcagaaug

SEQ ID NO: 3426 - RNA, 19 nt, Artificial Sequence
  RNA Oligomer
cccaagacagucucucucu

SEQ ID NO: 3427 - RNA, 19 nt, Artificial Sequence
  RNA Oligomer
ggauuguucgaggccaaac

SEQ ID NO: 3428 - RNA, 19 nt, Artificial Sequence
  RNA Oligomer
ggagaagaaauuuccugac

SEQ ID NO: 3429 - RNA, 19 nt, Artificial Sequence
  RNA Oligomer
ccuccuaugaguuguucug

SEQ ID NO: 3430 - RNA, 19 nt, Artificial Sequence
  RNA Oligomer
ccucgucaacugaguucau

SEQ ID NO: 3431 - RNA, 19 nt, Artificial Sequence
  RNA Oligomer
ggauagcuguuaaugcaac

SEQ ID NO: 3432 - RNA, 19 nt, Artificial Sequence
  RNA Oligomer
cugucagucgaaaccuuau

SEQ ID NO: 3433 - RNA, 19 nt, Artificial Sequence
  RNA Oligomer
gaauuuuaacugcaugcua

SEQ ID NO: 3434 - RNA, 19 nt, Artificial Sequence
  RNA Oligomer
cgcacugugccugaauuuu

SEQ ID NO: 3435 - RNA, 19 nt, Artificial Sequence
  RNA Oligomer
agcccuuacuaacgaccca

SEQ ID NO: 3436 - RNA, 19 nt, Artificial Sequence
  RNA Oligomer
accauacuuccuuagcuua

SEQ ID NO: 3437 - RNA, 19 nt, Artificial Sequence
  RNA Oligomer
caguugggaacuggugaau

SEQ ID NO: 3438 - RNA, 19 nt, Artificial Sequence
  RNA Oligomer
cucucauggcugggaauaa

SEQ ID NO: 3439 - RNA, 19 nt, Artificial Sequence
  RNA Oligomer
agacuuuggaggucaaguc

SEQ ID NO: 3440 - RNA, 19 nt, Artificial Sequence
  RNA Oligomer
cacuucaaaagaugugcca

SEQ ID NO: 3441 - RNA, 19 nt, Artificial Sequence
  RNA Oligomer
cucuccaccauauuaguac

SEQ ID NO: 3442 - RNA, 19 nt, Artificial Sequence
  RNA Oligomer
agccauaucuucgcuggag

SEQ ID NO: 3443 - RNA, 19 nt, Artificial Sequence
  RNA Oligomer
caguacaucuuggugcagu

SEQ ID NO: 3444 - RNA, 19 nt, Artificial Sequence
  RNA Oligomer
cacaugaaaaagcguggcu

SEQ ID NO: 3445 - RNA, 19 nt, Artificial Sequence
  RNA Oligomer
cuggaguccuggaacuuca

SEQ ID NO: 3446 - RNA, 19 nt, Artificial Sequence
  RNA Oligomer
cuaugcagaauggcagaca

SEQ ID NO: 3447 - RNA, 19 nt, Artificial Sequence
  RNA Oligomer
cgcuaugcagaauggcaga

SEQ ID NO: 3448 - RNA, 19 nt, Artificial Sequence
  RNA Oligomer
ucuucaaccuggaacgcua

SEQ ID NO: 3449 - RNA, 19 nt, Artificial Sequence
  RNA Oligomer
agcuguuaaugcaaccauc

SEQ ID NO: 3450 - RNA, 19 nt, Artificial Sequence
  RNA Oligomer
ucacaaacuggucgccuau

SEQ ID NO: 3451 - RNA, 19 nt, Artificial Sequence
  RNA Oligomer
gacaaaaaccucagauuuc

SEQ ID NO: 3452 - RNA, 19 nt, Artificial Sequence
  RNA Oligomer
cuauugugaacaguacacu

SEQ ID NO: 3453 - RNA, 19 nt, Artificial Sequence
  RNA Oligomer
guggaccuaaagcucucuc

SEQ ID NO: 3454 - RNA, 19 nt, Artificial Sequence
  RNA Oligomer
aacucacuuucugaguuau

SEQ ID NO: 3455 - RNA, 19 nt, Artificial Sequence
  RNA Oligomer
aaaacucacuuucugaguu

SEQ ID NO: 3456 - RNA, 19 nt, Artificial Sequence
  RNA Oligomer
ucccuggaaacacggauga

SEQ ID NO: 3457 - RNA, 19 nt, Artificial Sequence
  RNA Oligomer
agcaagguguauuucuacu

SEQ ID NO: 3458 - RNA, 19 nt, Artificial Sequence
  RNA Oligomer
gacuuuuucagcgugcaca

SEQ ID NO: 3459 - RNA, 19 nt, Artificial Sequence
  RNA Oligomer
ccauaucuucgcuggagug

SEQ ID NO: 3460 - RNA, 19 nt, Artificial Sequence
  RNA Oligomer
ggcaguacaucuuggugca

SEQ ID NO: 3461 - RNA, 19 nt, Artificial Sequence
  RNA Oligomer
uggcuuuaaaauggcgcca

SEQ ID NO: 3462 - RNA, 19 nt, Artificial Sequence
  RNA Oligomer
cucgucaacugaguucauc

SEQ ID NO: 3463 - RNA, 19 nt, Artificial Sequence
  RNA Oligomer
ggcgcauuucuucaaccug

SEQ ID NO: 3464 - RNA, 19 nt, Artificial Sequence
  RNA Oligomer
uggcgcauuucuucaaccu

SEQ ID NO: 3465 - RNA, 19 nt, Artificial Sequence
  RNA Oligomer
uagcuguuaaugcaaccau

SEQ ID NO: 3466 - RNA, 19 nt, Artificial Sequence
  RNA Oligomer
cgccuaugggauagcuguu

SEQ ID NO: 3467 - RNA, 19 nt, Artificial Sequence
  RNA Oligomer
uucacaaacuggucgccua

SEQ ID NO: 3468 - RNA, 19 nt, Artificial Sequence
  RNA Oligomer
accguggaggaggcaauua

SEQ ID NO: 3469 - RNA, 19 nt, Artificial Sequence
  RNA Oligomer
acaaguauuugcugcagag

SEQ ID NO: 3470 - RNA, 19 nt, Artificial Sequence
  RNA Oligomer
gaacaaguauuugcugcag

SEQ ID NO: 3471 - RNA, 19 nt, Artificial Sequence
  RNA Oligomer
aacaagaaguugucauuac

SEQ ID NO: 3472 - RNA, 19 nt, Artificial Sequence
  RNA Oligomer
cgauuucaacaagaaguug

SEQ ID NO: 3473 - RNA, 19 nt, Artificial Sequence
  RNA Oligomer
ggaaauggauuuuaggccc

SEQ ID NO: 3474 - RNA, 19 nt, Artificial Sequence
  RNA Oligomer
ucaucagacaggccuccua

SEQ ID NO: 3475 - RNA, 19 nt, Artificial Sequence
  RNA Oligomer
cgucaacugaguucaucag

SEQ ID NO: 3476 - RNA, 19 nt, Artificial Sequence
  RNA Oligomer
agagcuaccucaacccugu

SEQ ID NO: 3477 - RNA, 19 nt, Artificial Sequence
  RNA Oligomer
ucagucgaaaccuuauuuc

SEQ ID NO: 3478 - RNA, 19 nt, Artificial Sequence
  RNA Oligomer
ugucagucgaaaccuuauu

SEQ ID NO: 3479 - RNA, 19 nt, Artificial Sequence
  RNA Oligomer
cggccuguugauaugagcu

SEQ ID NO: 3480 - RNA, 19 nt, Artificial Sequence
  RNA Oligomer
cauuguguuuucaaucaag

SEQ ID NO: 3481 - RNA, 19 nt, Artificial Sequence
  RNA Oligomer
ggaccuaaagcucucucga

SEQ ID NO: 3482 - RNA, 19 nt, Artificial Sequence
  RNA Oligomer
gcuuaaagcagaagaccuu

SEQ ID NO: 3483 - RNA, 19 nt, Artificial Sequence
  RNA Oligomer
gaaauggauuuuaggcccu

SEQ ID NO: 3484 - RNA, 19 nt, Artificial Sequence
  RNA Oligomer
acagucucucucugcacaa

SEQ ID NO: 3485 - RNA, 19 nt, Artificial Sequence
  RNA Oligomer
ccuaacgagagcuaccuca

SEQ ID NO: 3486 - RNA, 19 nt, Artificial Sequence
  RNA Oligomer
cgaaaccuuauuucauuca

SEQ ID NO: 3487 - RNA, 19 nt, Artificial Sequence
  RNA Oligomer
cugcccugacagauguauu

SEQ ID NO: 3488 - RNA, 19 nt, Artificial Sequence
  RNA Oligomer
gcaguacaucuuggugcag

SEQ ID NO: 3489 - RNA, 19 nt, Artificial Sequence
  RNA Oligomer
acaaccacugaauugcuaa

SEQ ID NO: 3490 - RNA, 19 nt, Artificial Sequence
  RNA Oligomer
caaucaaguuauugauucc

SEQ ID NO: 3491 - RNA, 19 nt, Artificial Sequence
  RNA Oligomer
gacagucucucucugcaca

SEQ ID NO: 3492 - RNA, 19 nt, Artificial Sequence
  RNA Oligomer
ucaacaagaaguugucauu

SEQ ID NO: 3493 - RNA, 19 nt, Artificial Sequence
  Chemically synthesized
aggcccuguggucuuguau

SEQ ID NO: 3494 - RNA, 19 nt, Artificial Sequence
  Chemically synthesized
uaggcccuguggucuugua

SEQ ID NO: 3495 - RNA, 19 nt, Artificial Sequence
  Chemically synthesized
agaagaaauuuccugacag

SEQ ID NO: 3496 - RNA, 19 nt, Artificial Sequence
  Chemically synthesized
gccuaugggauagcuguua

SEQ ID NO: 3497 - RNA, 19 nt, Artificial Sequence
  Chemically synthesized
uucaacaagaaguugucau

SEQ ID NO: 3498 - RNA, 19 nt, Artificial Sequence
  Chemically synthesized
caacaagaaguugucauua

SEQ ID NO: 3499 - RNA, 19 nt, Artificial Sequence
  Chemically synthesized
ucgaaaccuuauuucauuc

SEQ ID NO: 3500 - RNA, 19 nt, Artificial Sequence
  Chemically synthesized
ccaacauccagacacaggu

SEQ ID NO: 3501 - RNA, 19 nt, Artificial Sequence
  Chemically synthesized
agaggaacaaguauuugcu

SEQ ID NO: 3502 - RNA, 19 nt, Artificial Sequence
  RNA Oligomer
ucuggcgauuucaacaaga

SEQ ID NO: 3503 - RNA, 19 nt, Artificial Sequence
  RNA Oligomer
aagagccugauuuucaucc

SEQ ID NO: 3504 - RNA, 19 nt, Artificial Sequence
  RNA Oligomer
uaaaaauuuauucccagcc

SEQ ID NO: 3505 - RNA, 19 nt, Artificial Sequence
  RNA Oligomer
aucuuuugaaguguccucg

SEQ ID NO: 3506 - RNA, 19 nt, Artificial Sequence
  RNA Oligomer
aacucauuguuccaguugg

SEQ ID NO: 3507 - RNA, 19 nt, Artificial Sequence
  RNA Oligomer
uuccuugccagaaaauuga

SEQ ID NO: 3508 - RNA, 19 nt, Artificial Sequence
  RNA Oligomer
aaaaauuuauucccagcca

SEQ ID NO: 3509 - RNA, 19 nt, Artificial Sequence
  RNA Oligomer
agagccugauuuucauccc

SEQ ID NO: 3510 - RNA, 19 nt, Artificial Sequence
  RNA Oligomer
augaucaagacuaaagcca

SEQ ID NO: 3511 - RNA, 19 nt, Artificial Sequence
  RNA Oligomer
uuuuugucuaauugccucc

SEQ ID NO: 3512 - RNA, 19 nt, Artificial Sequence
  RNA Oligomer
uugaacccaaaauaacucg

SEQ ID NO: 3513 - RNA, 19 nt, Artificial Sequence
  RNA Oligomer
augcaguuaaaauucaggc

SEQ ID NO: 3514 - RNA, 19 nt, Artificial Sequence
  RNA Oligomer
aaggaaguaugguauagug

SEQ ID NO: 3515 - RNA, 19 nt, Artificial Sequence
  RNA Oligomer
uaugauaacucagaaagug

SEQ ID NO: 3516 - RNA, 19 nt, Artificial Sequence
  RNA Oligomer
ccaucaugauacuuguugc

SEQ ID NO: 3517 - RNA, 19 nt, Artificial Sequence
  RNA Oligomer
uucaugugaaguuccagga

SEQ ID NO: 3518 - RNA, 19 nt, Artificial Sequence
  RNA Oligomer
aggcugagaaagaagacga

SEQ ID NO: 3519 - RNA, 19 nt, Artificial Sequence
  RNA Oligomer
aagaagacgaugaaaacau

SEQ ID NO: 3520 - RNA, 19 nt, Artificial Sequence
  RNA Oligomer
aucaagacuaaagccagag

SEQ ID NO: 3521 - RNA, 19 nt, Artificial Sequence
  RNA Oligomer
guccuuagcaauucagugg

SEQ ID NO: 3522 - RNA, 19 nt, Artificial Sequence
  RNA Oligomer
uagaagcucuccuuguugu

SEQ ID NO: 3523 - RNA, 19 nt, Artificial Sequence
  RNA Oligomer
guaauagaaaugaacaccu

SEQ ID NO: 3524 - RNA, 19 nt, Artificial Sequence
  RNA Oligomer
agauuucagaagagcagcg

SEQ ID NO: 3525 - RNA, 19 nt, Artificial Sequence
  RNA Oligomer
uugggucguuaguaagggc

SEQ ID NO: 3526 - RNA, 19 nt, Artificial Sequence
  RNA Oligomer
auaagcuaaggaaguaugg

SEQ ID NO: 3527 - RNA, 19 nt, Artificial Sequence
  RNA Oligomer
cugauuuucaucccagccg

SEQ ID NO: 3528 - RNA, 19 nt, Artificial Sequence
  RNA Oligomer
aaccacucaaaagcucuug

SEQ ID NO: 3529 - RNA, 19 nt, Artificial Sequence
  RNA Oligomer
auagauuucagaagagcag

SEQ ID NO: 3530 - RNA, 19 nt, Artificial Sequence
  RNA Oligomer
ugaaauacaucugucaggg

SEQ ID NO: 3531 - RNA, 19 nt, Artificial Sequence
  RNA Oligomer
cccaucaugauacuuguug

SEQ ID NO: 3532 - RNA, 19 nt, Artificial Sequence
  RNA Oligomer
caucaugauacuuguugcu

SEQ ID NO: 3533 - RNA, 19 nt, Artificial Sequence
  RNA Oligomer
auacuuguugcucuucggc

SEQ ID NO: 3534 - RNA, 19 nt, Artificial Sequence
  RNA Oligomer
cugagaaagaagacgauga

SEQ ID NO: 3535 - RNA, 19 nt, Artificial Sequence
  RNA Oligomer
caugaucaagacuaaagcc

SEQ ID NO: 3536 - RNA, 19 nt, Artificial Sequence
  RNA Oligomer
uaaaauucaggcacagugc

SEQ ID NO: 3537 - RNA, 19 nt, Artificial Sequence
  RNA Oligomer
cuaaggaaguaugguauag

SEQ ID NO: 3538 - RNA, 19 nt, Artificial Sequence
  RNA Oligomer
aagaacacgccaauacugc

SEQ ID NO: 3539 - RNA, 19 nt, Artificial Sequence
  RNA Oligomer
aaucugcuugaacucauug

SEQ ID NO: 3540 - RNA, 19 nt, Artificial Sequence
  RNA Oligomer
uuaagccuguaaucacguc

SEQ ID NO: 3541 - RNA, 19 nt, Artificial Sequence
  RNA Oligomer
uguaaagcuaugugaagag

SEQ ID NO: 3542 - RNA, 19 nt, Artificial Sequence
  RNA Oligomer
gagccugauuuucauccca

SEQ ID NO: 3543 - RNA, 19 nt, Artificial Sequence
  RNA Oligomer
ugauuuucaucccagccgg

SEQ ID NO: 3544 - RNA, 19 nt, Artificial Sequence
  RNA Oligomer
augauaacucagaaaguga

SEQ ID NO: 3545 - RNA, 19 nt, Artificial Sequence
  RNA Oligomer
cugcauuuguaccauauag

SEQ ID NO: 3546 - RNA, 19 nt, Artificial Sequence
  RNA Oligomer
uucagaagagcagcgaagg

SEQ ID NO: 3547 - RNA, 19 nt, Artificial Sequence
  RNA Oligomer
cugaaaaagucuuccuggg

SEQ ID NO: 3548 - RNA, 19 nt, Artificial Sequence
  RNA Oligomer
ucaugauacuuguugcucu

SEQ ID NO: 3549 - RNA, 19 nt, Artificial Sequence
  RNA Oligomer
gauacuuguugcucuucgg

SEQ ID NO: 3550 - RNA, 19 nt, Artificial Sequence
  RNA Oligomer
aaaauccauuuccaagccg

SEQ ID NO: 3551 - RNA, 19 nt, Artificial Sequence
  RNA Oligomer
auucagugguuguguuugu

SEQ ID NO: 3552 - RNA, 19 nt, Artificial Sequence
  RNA Oligomer
uuccagguugaagaaaugc

SEQ ID NO: 3553 - RNA, 19 nt, Artificial Sequence
  RNA Oligomer
aguuugugaaaucugaggu

SEQ ID NO: 3554 - RNA, 19 nt, Artificial Sequence
  RNA Oligomer
aaaucugagguuuuugucu

SEQ ID NO: 3555 - RNA, 19 nt, Artificial Sequence
  RNA Oligomer
auacuuguuccucuuauga

SEQ ID NO: 3556 - RNA, 19 nt, Artificial Sequence
  RNA Oligomer
uauuagaauuagcaugcag

SEQ ID NO: 3557 - RNA, 19 nt, Artificial Sequence
  RNA Oligomer
guugggucguuaguaaggg

SEQ ID NO: 3558 - RNA, 19 nt, Artificial Sequence
  RNA Oligomer
aacccaaaauaacucgugu

SEQ ID NO: 3559 - RNA, 19 nt, Artificial Sequence
  RNA Oligomer
aaaauuuauucccagccau

SEQ ID NO: 3560 - RNA, 19 nt, Artificial Sequence
  RNA Oligomer
uugaaaacacaaugccugg

SEQ ID NO: 3561 - RNA, 19 nt, Artificial Sequence
  RNA Oligomer
aauagaaaugaacaccucu

SEQ ID NO: 3562 - RNA, 19 nt, Artificial Sequence
  RNA Oligomer
caucuuuugaaguguccuc

SEQ ID NO: 3563 - RNA, 19 nt, Artificial Sequence
  RNA Oligomer
cuuuaagccuguaaucacg

SEQ ID NO: 3564 - RNA, 19 nt, Artificial Sequence
  RNA Oligomer
agccugauuuucaucccag

SEQ ID NO: 3565 - RNA, 19 nt, Artificial Sequence
  RNA Oligomer
accacucaaaagcucuugc

SEQ ID NO: 3566 - RNA, 19 nt, Artificial Sequence
  RNA Oligomer
agacccucauucaaaaucc

SEQ ID NO: 3567 - RNA, 19 nt, Artificial Sequence
  RNA Oligomer
aaauacaccuugcucagcu

SEQ ID NO: 3568 - RNA, 19 nt, Artificial Sequence
  RNA Oligomer
uagauuucagaagagcagc

SEQ ID NO: 3569 - RNA, 19 nt, Artificial Sequence
  RNA Oligomer
gugaaauacaucugucagg

SEQ ID NO: 3570 - RNA, 19 nt, Artificial Sequence
  RNA Oligomer
augauacuuguugcucuuc

SEQ ID NO: 3571 - RNA, 19 nt, Artificial Sequence
  RNA Oligomer
uucuuguugaaaucgccag

SEQ ID NO: 3572 - RNA, 19 nt, Artificial Sequence
  RNA Oligomer
uuggccucgaacaauccga

SEQ ID NO: 3573 - RNA, 19 nt, Artificial Sequence
  RNA Oligomer
uccagguugaagaaaugcg

SEQ ID NO: 3574 - RNA, 19 nt, Artificial Sequence
  RNA Oligomer
uuuugucuaauugccuccu

SEQ ID NO: 3575 - RNA, 19 nt, Artificial Sequence
  RNA Oligomer
gguauuagaauuagcaugc

SEQ ID NO: 3576 - RNA, 19 nt, Artificial Sequence
  RNA Oligomer
uuaaaauucaggcacagug

SEQ ID NO: 3577 - RNA, 19 nt, Artificial Sequence
  RNA Oligomer
cuucauaccaguagaacgu

SEQ ID NO: 3578 - RNA, 19 nt, Artificial Sequence
  RNA Oligomer
uucauaccaguagaacgug

SEQ ID NO: 3579 - RNA, 19 nt, Artificial Sequence
  RNA Oligomer
uuguucuguuguauaugac

SEQ ID NO: 3580 - RNA, 19 nt, Artificial Sequence
  RNA Oligomer
aauuuauucccagccauga

SEQ ID NO: 3581 - RNA, 19 nt, Artificial Sequence
  RNA Oligomer
auugaaaacacaaugccug

SEQ ID NO: 3582 - RNA, 19 nt, Artificial Sequence
  RNA Oligomer
uccaaagucuagaagcucu

SEQ ID NO: 3583 - RNA, 19 nt, Artificial Sequence
  RNA Oligomer
uuuaagccuguaaucacgu

SEQ ID NO: 3584 - RNA, 19 nt, Artificial Sequence
  RNA Oligomer
cacgucaguauuuucgucc

SEQ ID NO: 3585 - RNA, 19 nt, Artificial Sequence
  RNA Oligomer
uguaccauauagauuucag

SEQ ID NO: 3586 - RNA, 19 nt, Artificial Sequence
  RNA Oligomer
aucgccagaaccuaauuau

SEQ ID NO: 3587 - RNA, 19 nt, Artificial Sequence
  RNA Oligomer
uucuuucacaugcauacaa

SEQ ID NO: 3588 - RNA, 19 nt, Artificial Sequence
  RNA Oligomer
cagaaaauugaggcacggg

SEQ ID NO: 3589 - RNA, 19 nt, Artificial Sequence
  RNA Oligomer
cagaaggugauguugugca

SEQ ID NO: 3590 - RNA, 19 nt, Artificial Sequence
  RNA Oligomer
agaaggugauguugugcag

SEQ ID NO: 3591 - RNA, 19 nt, Artificial Sequence
  RNA Oligomer
aaggugauguugugcagag

SEQ ID NO: 3592 - RNA, 19 nt, Artificial Sequence
  RNA Oligomer
ucggcugucaggaaauuuc

SEQ ID NO: 3593 - RNA, 19 nt, Artificial Sequence
  RNA Oligomer
auguugugcagagagagac

SEQ ID NO: 3594 - RNA, 19 nt, Artificial Sequence
  RNA Oligomer
gaugaaaacauggugugug

SEQ ID NO: 3595 - RNA, 19 nt, Artificial Sequence
  RNA Oligomer
uccuuagcaauucaguggu

SEQ ID NO: 3596 - RNA, 19 nt, Artificial Sequence
  RNA Oligomer
uugaagaaaugcgccacga

SEQ ID NO: 3597 - RNA, 19 nt, Artificial Sequence
  RNA Oligomer
guuuuugucuaauugccuc

SEQ ID NO: 3598 - RNA, 19 nt, Artificial Sequence
  RNA Oligomer
gaacccaaaauaacucgug

SEQ ID NO: 3599 - RNA, 19 nt, Artificial Sequence
  RNA Oligomer
cuccucuucauaccaguag

SEQ ID NO: 3600 - RNA, 19 nt, Artificial Sequence
  RNA Oligomer
ucauaccaguagaacgugu

SEQ ID NO: 3601 - RNA, 19 nt, Artificial Sequence
  RNA Oligomer
auuuauucccagccaugag

SEQ ID NO: 3602 - RNA, 19 nt, Artificial Sequence
  RNA Oligomer
agcugaugaauacaagugg

SEQ ID NO: 3603 - RNA, 19 nt, Artificial Sequence
  RNA Oligomer
augagaguacuaauauggu

SEQ ID NO: 3604 - RNA, 19 nt, Artificial Sequence
  RNA Oligomer
aagccuguaaucacgucag

SEQ ID NO: 3605 - RNA, 19 nt, Artificial Sequence
  RNA Oligomer
caaaagcucuugcaucccg

SEQ ID NO: 3606 - RNA, 19 nt, Artificial Sequence
  RNA Oligomer
cauauagauuucagaagag

SEQ ID NO: 3607 - RNA, 19 nt, Artificial Sequence
  RNA Oligomer
ucuuucacaugcauacaag

SEQ ID NO: 3608 - RNA, 19 nt, Artificial Sequence
  RNA Oligomer
uuucacaugcauacaagac

SEQ ID NO: 3609 - RNA, 19 nt, Artificial Sequence
  RNA Oligomer
gcugucaggaaauuucuuc

SEQ ID NO: 3610 - RNA, 19 nt, Artificial Sequence
  RNA Oligomer
accagaacaacucauagga

SEQ ID NO: 3611 - RNA, 19 nt, Artificial Sequence
  RNA Oligomer
caagacuaaagccagagag

SEQ ID NO: 3612 - RNA, 19 nt, Artificial Sequence
  RNA Oligomer
acuaaagccagagagauca

SEQ ID NO: 3613 - RNA, 19 nt, Artificial Sequence
  RNA Oligomer
uucagugguuguguuugug

SEQ ID NO: 3614 - RNA, 19 nt, Artificial Sequence
  RNA Oligomer
cagugguuguguuuguggg

SEQ ID NO: 3615 - RNA, 19 nt, Artificial Sequence
  RNA Oligomer
aaucugagguuuuugucua

SEQ ID NO: 3616 - RNA, 19 nt, Artificial Sequence
  RNA Oligomer
aucugagguuuuugucuaa

SEQ ID NO: 3617 - RNA, 19 nt, Artificial Sequence
  RNA Oligomer
aaauaagguuucgacugac

SEQ ID NO: 3618 - RNA, 19 nt, Artificial Sequence
  RNA Oligomer
ugacagguauuagaauuag

SEQ ID NO: 3619 - RNA, 19 nt, Artificial Sequence
  RNA Oligomer
guauuagaauuagcaugca

SEQ ID NO: 3620 - RNA, 19 nt, Artificial Sequence
  RNA Oligomer
caugcaguuaaaauucagg

SEQ ID NO: 3621 - RNA, 19 nt, Artificial Sequence
  RNA Oligomer
ugaacccaaaauaacucgu

SEQ ID NO: 3622 - RNA, 19 nt, Artificial Sequence
  RNA Oligomer
auaccaguagaacguguca

SEQ ID NO: 3623 - RNA, 19 nt, Artificial Sequence
  RNA Oligomer
agaaaugaacaccucuggg

SEQ ID NO: 3624 - RNA, 19 nt, Artificial Sequence
  RNA Oligomer
ugagaguacuaauauggug

SEQ ID NO: 3625 - RNA, 19 nt, Artificial Sequence
  RNA Oligomer
acgucaguauuuucguccc

SEQ ID NO: 3626 - RNA, 19 nt, Artificial Sequence
  RNA Oligomer
aguaagagaucagcaaacc

SEQ ID NO: 3627 - RNA, 19 nt, Artificial Sequence
  RNA Oligomer
uauagauuucagaagagca

SEQ ID NO: 3628 - RNA, 19 nt, Artificial Sequence
  RNA Oligomer
cauucaaaauccagcaccc

SEQ ID NO: 3629 - RNA, 19 nt, Artificial Sequence
  RNA Oligomer
cgccauuuuaaagccacgc

SEQ ID NO: 3630 - RNA, 19 nt, Artificial Sequence
  RNA Oligomer
augcauacaagaccacagg

SEQ ID NO: 3631 - RNA, 19 nt, Artificial Sequence
  RNA Oligomer
ucucuacagaaggugaugu

SEQ ID NO: 3632 - RNA, 19 nt, Artificial Sequence
  RNA Oligomer
aagccagagagaucaccag

SEQ ID NO: 3633 - RNA, 19 nt, Artificial Sequence
  RNA Oligomer
ccagguugaagaaaugcgc

SEQ ID NO: 3634 - RNA, 19 nt, Artificial Sequence
  RNA Oligomer
guugaagaaaugcgccacg

SEQ ID NO: 3635 - RNA, 19 nt, Artificial Sequence
  RNA Oligomer
gagguuuuugucuaauugc

SEQ ID NO: 3636 - RNA, 19 nt, Artificial Sequence
  RNA Oligomer
auuagaauuagcaugcagu

SEQ ID NO: 3637 - RNA, 19 nt, Artificial Sequence
  RNA Oligomer
ugcaguuaaaauucaggca

SEQ ID NO: 3638 - RNA, 19 nt, Artificial Sequence
  RNA Oligomer
cauaccaguagaacguguc

SEQ ID NO: 3639 - RNA, 19 nt, Artificial Sequence
  RNA Oligomer
gaaaacacaaugccuggac

SEQ ID NO: 3640 - RNA, 19 nt, Artificial Sequence
  RNA Oligomer
acucauccguguuuccagg

SEQ ID NO: 3641 - RNA, 19 nt, Artificial Sequence
  RNA Oligomer
gaaauacaucugucagggc

SEQ ID NO: 3642 - RNA, 19 nt, Artificial Sequence
  RNA Oligomer
uuguugaaaucgccagaac

SEQ ID NO: 3643 - RNA, 19 nt, Artificial Sequence
  RNA Oligomer
ucacaugcauacaagacca

SEQ ID NO: 3644 - RNA, 19 nt, Artificial Sequence
  RNA Oligomer
aaauccauuuccaagccga

SEQ ID NO: 3645 - RNA, 19 nt, Artificial Sequence
  RNA Oligomer
auuucuucucccucaccug

SEQ ID NO: 3646 - RNA, 19 nt, Artificial Sequence
  RNA Oligomer
uuucuucucccucaccugu

SEQ ID NO: 3647 - RNA, 19 nt, Artificial Sequence
  RNA Oligomer
aagaaaugcgccacgaugu

SEQ ID NO: 3648 - RNA, 19 nt, Artificial Sequence
  RNA Oligomer
ugagguuuuugucuaauug

SEQ ID NO: 3649 - RNA, 19 nt, Artificial Sequence
  RNA Oligomer
gacagguauuagaauuagc

SEQ ID NO: 3650 - RNA, 19 nt, Artificial Sequence
  RNA Oligomer
acagguauuagaauuagca

SEQ ID NO: 3651 - RNA, 19 nt, Artificial Sequence
  RNA Oligomer
agcaugcaguuaaaauuca

SEQ ID NO: 3652 - RNA, 19 nt, Artificial Sequence
  RNA Oligomer
guugaacccaaaauaacuc

SEQ ID NO: 3653 - RNA, 19 nt, Artificial Sequence
  RNA Oligomer
acccaaaauaacucgugug

SEQ ID NO: 3654 - RNA, 19 nt, Artificial Sequence
  RNA Oligomer
uagguccacagaagaacac

SEQ ID NO: 3655 - RNA, 19 nt, Artificial Sequence
  RNA Oligomer
cagaagaacacgccaauac

SEQ ID NO: 3656 - RNA, 19 nt, Artificial Sequence
  RNA Oligomer
aucacgucaguauuuucgu

SEQ ID NO: 3657 - RNA, 19 nt, Artificial Sequence
  RNA Oligomer
agggagaguaagagaucag

SEQ ID NO: 3658 - RNA, 19 nt, Artificial Sequence
  RNA Oligomer
cagcaaaccacucaaaagc

SEQ ID NO: 3659 - RNA, 19 nt, Artificial Sequence
  RNA Oligomer
aaaccacucaaaagcucuu

SEQ ID NO: 3660 - RNA, 19 nt, Artificial Sequence
  RNA Oligomer
ucaaaagcucuugcauccc

SEQ ID NO: 3661 - RNA, 19 nt, Artificial Sequence
  RNA Oligomer
aucccggcaaauccaguag

SEQ ID NO: 3662 - RNA, 19 nt, Artificial Sequence
  RNA Oligomer
aaagccagagagaucacca

SEQ ID NO: 3663 - RNA, 19 nt, Artificial Sequence
  RNA Oligomer
cuuagcaauucagugguug

SEQ ID NO: 3664 - RNA, 19 nt, Artificial Sequence
  RNA Oligomer
uucuucucccucaccugug

SEQ ID NO: 3665 - RNA, 19 nt, Artificial Sequence
  RNA Oligomer
ucuucucccucaccugugu

SEQ ID NO: 3666 - RNA, 19 nt, Artificial Sequence
  RNA Oligomer
agguauuagaauuagcaug

SEQ ID NO: 3667 - RNA, 19 nt, Artificial Sequence
  RNA Oligomer
aaagacuccuccucuucau

SEQ ID NO: 3668 - RNA, 19 nt, Artificial Sequence
  RNA Oligomer
cuccuccucuucauaccag

SEQ ID NO: 3669 - RNA, 19 nt, Artificial Sequence
  RNA Oligomer
uaccaguagaacgugucaa

SEQ ID NO: 3670 - RNA, 19 nt, Artificial Sequence
  RNA Oligomer
uagaacgugucaauaaaca

SEQ ID NO: 3671 - RNA, 19 nt, Artificial Sequence
  RNA Oligomer
cucauaucaacaggccguc

SEQ ID NO: 3672 - RNA, 19 nt, Artificial Sequence
  RNA Oligomer
ugaaaacacaaugccugga

SEQ ID NO: 3673 - RNA, 19 nt, Artificial Sequence
  RNA Oligomer
aaguggcacaucuuuugaa

SEQ ID NO: 3674 - RNA, 19 nt, Artificial Sequence
  RNA Oligomer
uucgucccaguguaaagcu

SEQ ID NO: 3675 - RNA, 19 nt, Artificial Sequence
  RNA Oligomer
ccuggcgccauuuuaaagc

SEQ ID NO: 3676 - RNA, 19 nt, Artificial Sequence
  RNA Oligomer
ugguaaugacaacuucuug

SEQ ID NO: 3677 - RNA, 19 nt, Artificial Sequence
  RNA Oligomer
gguaaugacaacuucuugu

SEQ ID NO: 3678 - RNA, 19 nt, Artificial Sequence
  RNA Oligomer
cacaugcauacaagaccac

SEQ ID NO: 3679 - RNA, 19 nt, Artificial Sequence
  RNA Oligomer
caggcugagaaagaagacg

SEQ ID NO: 3680 - RNA, 19 nt, Artificial Sequence
  RNA Oligomer
gacuccuccucuucauacc

SEQ ID NO: 3681 - RNA, 19 nt, Artificial Sequence
  RNA Oligomer
ugggagcucauaucaacag

SEQ ID NO: 3682 - RNA, 19 nt, Artificial Sequence
  RNA Oligomer
ggagcucauaucaacaggc

SEQ ID NO: 3683 - RNA, 19 nt, Artificial Sequence
  RNA Oligomer
aaaacacaaugccuggacu

SEQ ID NO: 3684 - RNA, 19 nt, Artificial Sequence
  RNA Oligomer
ucacgucaguauuuucguc

SEQ ID NO: 3685 - RNA, 19 nt, Artificial Sequence
  RNA Oligomer
cagggagaguaagagauca

SEQ ID NO: 3686 - RNA, 19 nt, Artificial Sequence
  RNA Oligomer
auacaccuugcucagcuuc

SEQ ID NO: 3687 - RNA, 19 nt, Artificial Sequence
  RNA Oligomer
cucauucaaaauccagcac

SEQ ID NO: 3688 - RNA, 19 nt, Artificial Sequence
  RNA Oligomer
auccauuuccaagccgagg

SEQ ID NO: 3689 - RNA, 19 nt, Artificial Sequence
  RNA Oligomer
auagcggucucuacagaag

SEQ ID NO: 3690 - RNA, 19 nt, Artificial Sequence
  RNA Oligomer
uagcggucucuacagaagg

SEQ ID NO: 3691 - RNA, 19 nt, Artificial Sequence
  RNA Oligomer
guugugcagagagagacug

SEQ ID NO: 3692 - RNA, 19 nt, Artificial Sequence
  RNA Oligomer
aguuaaaauucaggcacag

SEQ ID NO: 3693 - RNA, 19 nt, Artificial Sequence
  RNA Oligomer
aacgugucaauaaacagau

SEQ ID NO: 3694 - RNA, 19 nt, Artificial Sequence
  RNA Oligomer
aacacaaugccuggacuug

SEQ ID NO: 3695 - RNA, 19 nt, Artificial Sequence
  RNA Oligomer
cacaaugccuggacuugac

SEQ ID NO: 3696 - RNA, 19 nt, Artificial Sequence
  RNA Oligomer
cagcugaugaauacaagug

SEQ ID NO: 3697 - RNA, 19 nt, Artificial Sequence
  RNA Oligomer
gcugaugaauacaaguggc

SEQ ID NO: 3698 - RNA, 19 nt, Artificial Sequence
  RNA Oligomer
cugaugaauacaaguggca

SEQ ID NO: 3699 - RNA, 19 nt, Artificial Sequence
  RNA Oligomer
caaguggcacaucuuuuga

SEQ ID NO: 3700 - RNA, 19 nt, Artificial Sequence
  RNA Oligomer
uacaccuugcucagcuuca

SEQ ID NO: 3701 - RNA, 19 nt, Artificial Sequence
  RNA Oligomer
caugcauacaagaccacag

SEQ ID NO: 3702 - RNA, 19 nt, Artificial Sequence
  RNA Oligomer
uaaaauccauuuccaagcc

SEQ ID NO: 3703 - RNA, 19 nt, Artificial Sequence
  RNA Oligomer
cuuuggaaucaauaacuug

SEQ ID NO: 3704 - RNA, 19 nt, Artificial Sequence
  RNA Oligomer
uugauugaaaacacaaugc

SEQ ID NO: 3705 - RNA, 19 nt, Artificial Sequence
  RNA Oligomer
augaauacaaguggcacau

SEQ ID NO: 3706 - RNA, 19 nt, Artificial Sequence
  RNA Oligomer
aaagcuaugugaagagccu

SEQ ID NO: 3707 - RNA, 19 nt, Artificial Sequence
  RNA Oligomer
accuugcucagcuucagug

SEQ ID NO: 3708 - RNA, 19 nt, Artificial Sequence
  RNA Oligomer
accaagauguacugcccug

SEQ ID NO: 3709 - RNA, 19 nt, Artificial Sequence
  RNA Oligomer
accacagggccuaaaaucc

SEQ ID NO: 3710 - RNA, 19 nt, Artificial Sequence
  RNA Oligomer
aaaagcucuugcaucccgg

SEQ ID NO: 3711 - RNA, 19 nt, Artificial Sequence
  RNA Oligomer
uuuaaagccacgcuuuuuc

SEQ ID NO: 3712 - RNA, 19 nt, Artificial Sequence
  RNA Oligomer
uuuuucaugugaaguucca

SEQ ID NO: 3713 - RNA, 19 nt, Artificial Sequence
  RNA Oligomer
ugcauacaagaccacaggg

SEQ ID NO: 3714 - RNA, 19 nt, Artificial Sequence
  RNA Oligomer
uaacucguguguaauggaa

SEQ ID NO: 3715 - RNA, 19 nt, Artificial Sequence
  RNA Oligomer
gaacgugucaauaaacaga

SEQ ID NO: 3716 - RNA, 19 nt, Artificial Sequence
  RNA Oligomer
gaauacaaguggcacaucu

SEQ ID NO: 3717 - RNA, 19 nt, Artificial Sequence
  RNA Oligomer
ucauuguuccaguugggcc

SEQ ID NO: 3718 - RNA, 19 nt, Artificial Sequence
  RNA Oligomer
ucuucugcuuuaagccugu

SEQ ID NO: 3719 - RNA, 19 nt, Artificial Sequence
  RNA Oligomer
aacuucuuguugaaaucgc

SEQ ID NO: 3720 - RNA, 19 nt, Artificial Sequence
  RNA Oligomer
aaaacaugguguguguacc

SEQ ID NO: 3721 - RNA, 19 nt, Artificial Sequence
  RNA Oligomer
uugaacucauuguuccagu

SEQ ID NO: 3722 - RNA, 19 nt, Artificial Sequence
  RNA Oligomer
gucuucugcuuuaagccug

SEQ ID NO: 3723 - RNA, 19 nt, Artificial Sequence
  RNA Oligomer
aagcuaugugaagagccug

SEQ ID NO: 3724 - RNA, 19 nt, Artificial Sequence
  RNA Oligomer
cucaaaagcucuugcaucc

SEQ ID NO: 3725 - RNA, 19 nt, Artificial Sequence
  RNA Oligomer
uuguugcucuucggcuguc

SEQ ID NO: 3726 - RNA, 19 nt, Artificial Sequence
  RNA Oligomer
auuaacagcuaucccauag

SEQ ID NO: 3727 - RNA, 19 nt, Artificial Sequence
  RNA Oligomer
uuaacagcuaucccauagg

SEQ ID NO: 3728 - RNA, 19 nt, Artificial Sequence
  RNA Oligomer
aaugaaauaagguuucgac

SEQ ID NO: 3729 - RNA, 19 nt, Artificial Sequence
  RNA Oligomer
ugauugaaaacacaaugcc

SEQ ID NO: 3730 - RNA, 19 nt, Artificial Sequence
  RNA Oligomer
auccaguagaaauacaccu

SEQ ID NO: 3731 - RNA, 19 nt, Artificial Sequence
  RNA Oligomer
caguagaaauacaccuugc

SEQ ID NO: 3732 - RNA, 19 nt, Artificial Sequence
  RNA Oligomer
cacgcugaaaaagucuucc

SEQ ID NO: 3733 - RNA, 19 nt, Artificial Sequence
  RNA Oligomer
cuugccagaaaauugaggc

SEQ ID NO: 3734 - RNA, 19 nt, Artificial Sequence
  RNA Oligomer
gaacaacucauaggaggcc

SEQ ID NO: 3735 - RNA, 19 nt, Artificial Sequence
  RNA Oligomer
aacaacucauaggaggccu

SEQ ID NO: 3736 - RNA, 19 nt, Artificial Sequence
  RNA Oligomer
cuauuguccuuagcaauuc

SEQ ID NO: 3737 - RNA, 19 nt, Artificial Sequence
  RNA Oligomer
acucauuguuccaguuggg

SEQ ID NO: 3738 - RNA, 19 nt, Artificial Sequence
  RNA Oligomer
uucugcuuuaagccuguaa

SEQ ID NO: 3739 - RNA, 19 nt, Artificial Sequence
  RNA Oligomer
uaaagcuaugugaagagcc

SEQ ID NO: 3740 - RNA, 19 nt, Artificial Sequence
  RNA Oligomer
agcuaugugaagagccuga

SEQ ID NO: 3741 - RNA, 19 nt, Artificial Sequence
  RNA Oligomer
cugugccucacugcauuug

SEQ ID NO: 3742 - RNA, 19 nt, Artificial Sequence
  RNA Oligomer
cuuuuucaugugaaguucc

SEQ ID NO: 3743 - RNA, 19 nt, Artificial Sequence
  RNA Oligomer
uuucaugugaaguuccagg

SEQ ID NO: 3744 - RNA, 19 nt, Artificial Sequence
  RNA Oligomer
cuaaaauccauuuccaagc

SEQ ID NO: 3745 - RNA, 19 nt, Artificial Sequence
  RNA Oligomer
uugccagaaaauugaggca

SEQ ID NO: 3746 - RNA, 19 nt, Artificial Sequence
  RNA Oligomer
uuguuccucuuaugaauga

SEQ ID NO: 3747 - RNA, 19 nt, Artificial Sequence
  RNA Oligomer
aaauucaggcacagugcgg

SEQ ID NO: 3748 - RNA, 19 nt, Artificial Sequence
  RNA Oligomer
uguguaauggaaagacucc

SEQ ID NO: 3749 - RNA, 19 nt, Artificial Sequence
  RNA Oligomer
gaaguaugguauaguguac

SEQ ID NO: 3750 - RNA, 19 nt, Artificial Sequence
  RNA Oligomer
aaguaugguauaguguacu

SEQ ID NO: 3751 - RNA, 19 nt, Artificial Sequence
  RNA Oligomer
aguaugguauaguguacug

SEQ ID NO: 3752 - RNA, 19 nt, Artificial Sequence
  RNA Oligomer
uugaccuccaaagucuaga

SEQ ID NO: 3753 - RNA, 19 nt, Artificial Sequence
  RNA Oligomer
auuguaggcaaucugcuug

SEQ ID NO: 3754 - RNA, 19 nt, Artificial Sequence
  RNA Oligomer
auuguuccaguugggccuc

SEQ ID NO: 3755 - RNA, 19 nt, Artificial Sequence
  RNA Oligomer
aauaugguggagagacccu

SEQ ID NO: 3756 - RNA, 19 nt, Artificial Sequence
  RNA Oligomer
uggguagugaaauacaucu

SEQ ID NO: 3757 - RNA, 19 nt, Artificial Sequence
  RNA Oligomer
uuaaagccacgcuuuuuca

SEQ ID NO: 3758 - RNA, 19 nt, Artificial Sequence
  RNA Oligomer
acuucuuguugaaaucgcc

SEQ ID NO: 3759 - RNA, 19 nt, Artificial Sequence
  RNA Oligomer
uguugcucuucggcuguca

SEQ ID NO: 3760 - RNA, 19 nt, Artificial Sequence
  RNA Oligomer
aagacgaugaaaacauggu

SEQ ID NO: 3761 - RNA, 19 nt, Artificial Sequence
  RNA Oligomer
augaaaacauggugugugu

SEQ ID NO: 3762 - RNA, 19 nt, Artificial Sequence
  RNA Oligomer
aacaugguguguguaccag

SEQ ID NO: 3763 - RNA, 19 nt, Artificial Sequence
  RNA Oligomer
uugcccagcuuggaaagug

SEQ ID NO: 3764 - RNA, 19 nt, Artificial Sequence
  RNA Oligomer
aauucaggcacagugcgga

SEQ ID NO: 3765 - RNA, 19 nt, Artificial Sequence
  RNA Oligomer
ucguguguaauggaaagac

SEQ ID NO: 3766 - RNA, 19 nt, Artificial Sequence
  RNA Oligomer
cacaucuuuugaagugucc

SEQ ID NO: 3767 - RNA, 19 nt, Artificial Sequence
  RNA Oligomer
uuugaaguguccucgagag

SEQ ID NO: 3768 - RNA, 19 nt, Artificial Sequence
  RNA Oligomer
gugauuguaggcaaucugc

SEQ ID NO: 3769 - RNA, 19 nt, Artificial Sequence
  RNA Oligomer
agaguacuaauauggugga

SEQ ID NO: 3770 - RNA, 19 nt, Artificial Sequence
  RNA Oligomer
ugcuugaacucauuguucc

SEQ ID NO: 3771 - RNA, 19 nt, Artificial Sequence
  RNA Oligomer
gaguacuaauaugguggag

SEQ ID NO: 3772 - RNA, 19 nt, Artificial Sequence
  RNA Oligomer
aauccaguagaaauacacc

SEQ ID NO: 3773 - RNA, 19 nt, Artificial Sequence
  RNA Oligomer
acuuguugcucuucggcug

SEQ ID NO: 3774 - RNA, 19 nt, Artificial Sequence
  RNA Oligomer
gagacugucuuggguuugg

SEQ ID NO: 3775 - RNA, 19 nt, Artificial Sequence
  RNA Oligomer
uauuguccuuagcaauuca

SEQ ID NO: 3776 - RNA, 19 nt, Artificial Sequence
  RNA Oligomer
auuguccuuagcaauucag

SEQ ID NO: 3777 - RNA, 19 nt, Artificial Sequence
  RNA Oligomer
ugcagcaaauacuuguucc

SEQ ID NO: 3778 - RNA, 19 nt, Artificial Sequence
  RNA Oligomer
guguaauggaaagacuccu

SEQ ID NO: 3779 - RNA, 19 nt, Artificial Sequence
  RNA Oligomer
auggaaagacuccuccucu

SEQ ID NO: 3780 - RNA, 19 nt, Artificial Sequence
  RNA Oligomer
uucaccaguucccaacugg

SEQ ID NO: 3781 - RNA, 19 nt, Artificial Sequence
  RNA Oligomer
gagaguacuaauauggugg

SEQ ID NO: 3782 - RNA, 19 nt, Artificial Sequence
  RNA Oligomer
cucauuguuccaguugggc

SEQ ID NO: 3783 - RNA, 19 nt, Artificial Sequence
  RNA Oligomer
guaaagcuaugugaagagc

SEQ ID NO: 3784 - RNA, 19 nt, Artificial Sequence
  RNA Oligomer
uuaguaagggcuucccuag

SEQ ID NO: 3785 - RNA, 19 nt, Artificial Sequence
  RNA Oligomer
ggguagugaaauacaucug

SEQ ID NO: 3786 - RNA, 19 nt, Artificial Sequence
  RNA Oligomer
acgcugaaaaagucuuccu

SEQ ID NO: 3787 - RNA, 19 nt, Artificial Sequence
  RNA Oligomer
ugugaaguuccaggacucc

SEQ ID NO: 3788 - RNA, 19 nt, Artificial Sequence
  RNA Oligomer
auucugcauagcggucucu

SEQ ID NO: 3789 - RNA, 19 nt, Artificial Sequence
  RNA Oligomer
gagagagacugucuugggu

SEQ ID NO: 3790 - RNA, 19 nt, Artificial Sequence
  RNA Oligomer
agacugucuuggguuuggc

SEQ ID NO: 3791 - RNA, 19 nt, Artificial Sequence
  RNA Oligomer
gaagacgaugaaaacaugg

SEQ ID NO: 3792 - RNA, 19 nt, Artificial Sequence
  RNA Oligomer
agaacaacucauaggaggc

SEQ ID NO: 3793 - RNA, 19 nt, Artificial Sequence
  RNA Oligomer
aagguuucgacugacaggu

SEQ ID NO: 3794 - RNA, 19 nt, Artificial Sequence
  RNA Oligomer
auaacucguguguaaugga

SEQ ID NO: 3795 - RNA, 19 nt, Artificial Sequence
  RNA Oligomer
cuuuugaaguguccucgag

SEQ ID NO: 3796 - RNA, 19 nt, Artificial Sequence
  RNA Oligomer
cauuguuccaguugggccu

SEQ ID NO: 3797 - RNA, 19 nt, Artificial Sequence
  RNA Oligomer
uagaaggucuucugcuuua

SEQ ID NO: 3798 - RNA, 19 nt, Artificial Sequence
  RNA Oligomer
ucccaguguaaagcuaugu

SEQ ID NO: 3799 - RNA, 19 nt, Artificial Sequence
  RNA Oligomer
ccaguguaaagcuauguga

SEQ ID NO: 3800 - RNA, 19 nt, Artificial Sequence
  RNA Oligomer
ucagaaagugaguuuuccc

SEQ ID NO: 3801 - RNA, 19 nt, Artificial Sequence
  RNA Oligomer
ccaguagaaauacaccuug

SEQ ID NO: 3802 - RNA, 19 nt, Artificial Sequence
  RNA Oligomer
acacuggguagugaaauac

SEQ ID NO: 3803 - RNA, 19 nt, Artificial Sequence
  RNA Oligomer
guagugaaauacaucuguc

SEQ ID NO: 3804 - RNA, 19 nt, Artificial Sequence
  RNA Oligomer
auuuccaagccgaggguuc

SEQ ID NO: 3805 - RNA, 19 nt, Artificial Sequence
  RNA Oligomer
ugccagaaaauugaggcac

SEQ ID NO: 3806 - RNA, 19 nt, Artificial Sequence
  RNA Oligomer
agacgaugaaaacauggug

SEQ ID NO: 3807 - RNA, 19 nt, Artificial Sequence
  RNA Oligomer
gacgaugaaaacauggugu

SEQ ID NO: 3808 - RNA, 19 nt, Artificial Sequence
  RNA Oligomer
guguguaccagaacaacuc

SEQ ID NO: 3809 - RNA, 19 nt, Artificial Sequence
  RNA Oligomer
ugucugaugaacucaguug

SEQ ID NO: 3810 - RNA, 19 nt, Artificial Sequence
  RNA Oligomer
aacucaguugacgagguca

SEQ ID NO: 3811 - RNA, 19 nt, Artificial Sequence
  RNA Oligomer
aaaugcgccacgaugugga

SEQ ID NO: 3812 - RNA, 19 nt, Artificial Sequence
  RNA Oligomer
uugcauuaacagcuauccc

SEQ ID NO: 3813 - RNA, 19 nt, Artificial Sequence
  RNA Oligomer
agguuuuugucuaauugcc

SEQ ID NO: 3814 - RNA, 19 nt, Artificial Sequence
  RNA Oligomer
cuugaacucauuguuccag

SEQ ID NO: 3815 - RNA, 19 nt, Artificial Sequence
  RNA Oligomer
aggucuucugcuuuaagcc

SEQ ID NO: 3816 - RNA, 19 nt, Artificial Sequence
  RNA Oligomer
uuuccagggagaguaagag

SEQ ID NO: 3817 - RNA, 19 nt, Artificial Sequence
  RNA Oligomer
gcacgcugaaaaagucuuc

SEQ ID NO: 3818 - RNA, 19 nt, Artificial Sequence
  RNA Oligomer
acuccagcgaagauauggc

SEQ ID NO: 3819 - RNA, 19 nt, Artificial Sequence
  RNA Oligomer
cuggcgccauuuuaaagcc

SEQ ID NO: 3820 - RNA, 19 nt, Artificial Sequence
  RNA Oligomer
uuuucaugugaaguuccag

SEQ ID NO: 3821 - RNA, 19 nt, Artificial Sequence
  RNA Oligomer
cagagagagacugucuugg

SEQ ID NO: 3822 - RNA, 19 nt, Artificial Sequence
  RNA Oligomer
uuuggccucgaacaauccg

SEQ ID NO: 3823 - RNA, 19 nt, Artificial Sequence
  RNA Oligomer
acgaugaaaacauggugug

SEQ ID NO: 3824 - RNA, 19 nt, Artificial Sequence
  RNA Oligomer
gaacucaguugacgagguc

SEQ ID NO: 3825 - RNA, 19 nt, Artificial Sequence
  RNA Oligomer
uugacgaggucaugaucaa

SEQ ID NO: 3826 - RNA, 19 nt, Artificial Sequence
  RNA Oligomer
acgaggucaugaucaagac

SEQ ID NO: 3827 - RNA, 19 nt, Artificial Sequence
  RNA Oligomer
uugagguagcucucguuag

SEQ ID NO: 3828 - RNA, 19 nt, Artificial Sequence
  RNA Oligomer
ugaaaucugagguuuuugu

SEQ ID NO: 3829 - RNA, 19 nt, Artificial Sequence
  RNA Oligomer
uucgacugacagguauuag

SEQ ID NO: 3830 - RNA, 19 nt, Artificial Sequence
  RNA Oligomer
gucguuaguaagggcuucc

SEQ ID NO: 3831 - RNA, 19 nt, Artificial Sequence
  RNA Oligomer
guccucgagagagcuuuag

SEQ ID NO: 3832 - RNA, 19 nt, Artificial Sequence
  RNA Oligomer
ucccauagaaggucuucug

SEQ ID NO: 3833 - RNA, 19 nt, Artificial Sequence
  RNA Oligomer
cuaauaugguggagagacc

SEQ ID NO: 3834 - RNA, 19 nt, Artificial Sequence
  RNA Oligomer
ugauaacucagaaagugag

SEQ ID NO: 3835 - RNA, 19 nt, Artificial Sequence
  RNA Oligomer
uaacucagaaagugaguuu

SEQ ID NO: 3836 - RNA, 19 nt, Artificial Sequence
  RNA Oligomer
cucagaaagugaguuuucc

SEQ ID NO: 3837 - RNA, 19 nt, Artificial Sequence
  RNA Oligomer
gguagugaaauacaucugu

SEQ ID NO: 3838 - RNA, 19 nt, Artificial Sequence
  RNA Oligomer
aaauacaucugucagggca

SEQ ID NO: 3839 - RNA, 19 nt, Artificial Sequence
  RNA Oligomer
aagccacgcuuuuucaugu

SEQ ID NO: 3840 - RNA, 19 nt, Artificial Sequence
  RNA Oligomer
uacuuguugcucuucggcu

SEQ ID NO: 3841 - RNA, 19 nt, Artificial Sequence
  RNA Oligomer
ccuugccagaaaauugagg

SEQ ID NO: 3842 - RNA, 19 nt, Artificial Sequence
  RNA Oligomer
aaacaugguguguguacca

SEQ ID NO: 3843 - RNA, 19 nt, Artificial Sequence
  RNA Oligomer
ucaggaaauuucuucuccc

SEQ ID NO: 3844 - RNA, 19 nt, Artificial Sequence
  RNA Oligomer
gucugaugaacucaguuga

SEQ ID NO: 3845 - RNA, 19 nt, Artificial Sequence
  RNA Oligomer
accaguuugugaaaucuga

SEQ ID NO: 3846 - RNA, 19 nt, Artificial Sequence
  RNA Oligomer
ucuguuguauaugacaugu

SEQ ID NO: 3847 - RNA, 19 nt, Artificial Sequence
  RNA Oligomer
agcuaaggaaguaugguau

SEQ ID NO: 3848 - RNA, 19 nt, Artificial Sequence
  RNA Oligomer
guauaguguacuguucaca

SEQ ID NO: 3849 - RNA, 19 nt, Artificial Sequence
  RNA Oligomer
uucccagccaugagaguac

SEQ ID NO: 3850 - RNA, 19 nt, Artificial Sequence
  RNA Oligomer
cucccauagaaggucuucu

SEQ ID NO: 3851 - RNA, 19 nt, Artificial Sequence
  RNA Oligomer
uaugguggagagacccuca

SEQ ID NO: 3852 - RNA, 19 nt, Artificial Sequence
  RNA Oligomer
gagaucagcaaaccacuca

SEQ ID NO: 3853 - RNA, 19 nt, Artificial Sequence
  RNA Oligomer
gcuuuuucaugugaaguuc

SEQ ID NO: 3854 - RNA, 19 nt, Artificial Sequence
  RNA Oligomer
augugaaguuccaggacuc

SEQ ID NO: 3855 - RNA, 19 nt, Artificial Sequence
  RNA Oligomer
cuuaccaccuugguaauga

SEQ ID NO: 3856 - RNA, 19 nt, Artificial Sequence
  RNA Oligomer
uuaccaccuugguaaugac

SEQ ID NO: 3857 - RNA, 19 nt, Artificial Sequence
  RNA Oligomer
cauucugcauagcggucuc

SEQ ID NO: 3858 - RNA, 19 nt, Artificial Sequence
  RNA Oligomer
agagagagacugucuuggg

SEQ ID NO: 3859 - RNA, 19 nt, Artificial Sequence
  RNA Oligomer
guuuggccucgaacaaucc

SEQ ID NO: 3860 - RNA, 19 nt, Artificial Sequence
  RNA Oligomer
gucaggaaauuucuucucc

SEQ ID NO: 3861 - RNA, 19 nt, Artificial Sequence
  RNA Oligomer
cagaacaacucauaggagg

SEQ ID NO: 3862 - RNA, 19 nt, Artificial Sequence
  RNA Oligomer
augaacucaguugacgagg

SEQ ID NO: 3863 - RNA, 19 nt, Artificial Sequence
  RNA Oligomer
guugcauuaacagcuaucc

SEQ ID NO: 3864 - RNA, 19 nt, Artificial Sequence
  RNA Oligomer
auaagguuucgacugacag

SEQ ID NO: 3865 - RNA, 19 nt, Artificial Sequence
  RNA Oligomer
uagcaugcaguuaaaauuc

SEQ ID NO: 3866 - RNA, 19 nt, Artificial Sequence
  RNA Oligomer
aaaauucaggcacagugcg

SEQ ID NO: 3867 - RNA, 19 nt, Artificial Sequence
  RNA Oligomer
ugggucguuaguaagggcu

SEQ ID NO: 3868 - RNA, 19 nt, Artificial Sequence
  RNA Oligomer
uaagcuaaggaaguauggu

SEQ ID NO: 3869 - RNA, 19 nt, Artificial Sequence
  RNA Oligomer
auucaccaguucccaacug

SEQ ID NO: 3870 - RNA, 19 nt, Artificial Sequence
  RNA Oligomer
uuauucccagccaugagag

SEQ ID NO: 3871 - RNA, 19 nt, Artificial Sequence
  RNA Oligomer
gacuugaccuccaaagucu

SEQ ID NO: 3872 - RNA, 19 nt, Artificial Sequence
  RNA Oligomer
uggcacaucuuuugaagug

SEQ ID NO: 3873 - RNA, 19 nt, Artificial Sequence
  RNA Oligomer
guacuaauaugguggagag

SEQ ID NO: 3874 - RNA, 19 nt, Artificial Sequence
  RNA Oligomer
cuccagcgaagauauggcu

SEQ ID NO: 3875 - RNA, 19 nt, Artificial Sequence
  RNA Oligomer
acugcaccaagauguacug

SEQ ID NO: 3876 - RNA, 19 nt, Artificial Sequence
  RNA Oligomer
agccacgcuuuuucaugug

SEQ ID NO: 3877 - RNA, 19 nt, Artificial Sequence
  RNA Oligomer
ugaaguuccaggacuccag

SEQ ID NO: 3878 - RNA, 19 nt, Artificial Sequence
  RNA Oligomer
ugucugccauucugcauag

SEQ ID NO: 3879 - RNA, 19 nt, Artificial Sequence
  RNA Oligomer
ucugccauucugcauagcg

SEQ ID NO: 3880 - RNA, 19 nt, Artificial Sequence
  RNA Oligomer
uagcguuccagguugaaga

SEQ ID NO: 3881 - RNA, 19 nt, Artificial Sequence
  RNA Oligomer
gaugguugcauuaacagcu

SEQ ID NO: 3882 - RNA, 19 nt, Artificial Sequence
  RNA Oligomer
auaggcgaccaguuuguga

SEQ ID NO: 3883 - RNA, 19 nt, Artificial Sequence
  RNA Oligomer
gaaaucugagguuuuuguc

SEQ ID NO: 3884 - RNA, 19 nt, Artificial Sequence
  RNA Oligomer
aguguacuguucacaauag

SEQ ID NO: 3885 - RNA, 19 nt, Artificial Sequence
  RNA Oligomer
gagagagcuuuagguccac

SEQ ID NO: 3886 - RNA, 19 nt, Artificial Sequence
  RNA Oligomer
auaacucagaaagugaguu

SEQ ID NO: 3887 - RNA, 19 nt, Artificial Sequence
  RNA Oligomer
aacucagaaagugaguuuu

SEQ ID NO: 3888 - RNA, 19 nt, Artificial Sequence
  RNA Oligomer
ucauccguguuuccaggga

SEQ ID NO: 3889 - RNA, 19 nt, Artificial Sequence
  RNA Oligomer
aguagaaauacaccuugcu

SEQ ID NO: 3890 - RNA, 19 nt, Artificial Sequence
  RNA Oligomer
ugugcacgcugaaaaaguc

SEQ ID NO: 3891 - RNA, 19 nt, Artificial Sequence
  RNA Oligomer
cacuccagcgaagauaugg

SEQ ID NO: 3892 - RNA, 19 nt, Artificial Sequence
  RNA Oligomer
ugcaccaagauguacugcc

SEQ ID NO: 3893 - RNA, 19 nt, Artificial Sequence
  RNA Oligomer
uggcgccauuuuaaagcca

SEQ ID NO: 3894 - RNA, 19 nt, Artificial Sequence
  RNA Oligomer
gaugaacucaguugacgag

SEQ ID NO: 3895 - RNA, 19 nt, Artificial Sequence
  RNA Oligomer
cagguugaagaaaugcgcc

SEQ ID NO: 3896 - RNA, 19 nt, Artificial Sequence
  RNA Oligomer
agguugaagaaaugcgcca

SEQ ID NO: 3897 - RNA, 19 nt, Artificial Sequence
  RNA Oligomer
augguugcauuaacagcua

SEQ ID NO: 3898 - RNA, 19 nt, Artificial Sequence
  RNA Oligomer
aacagcuaucccauaggcg

SEQ ID NO: 3899 - RNA, 19 nt, Artificial Sequence
  RNA Oligomer
uaggcgaccaguuugugaa

SEQ ID NO: 3900 - RNA, 19 nt, Artificial Sequence
  RNA Oligomer
uaauugccuccuccacggu

SEQ ID NO: 3901 - RNA, 19 nt, Artificial Sequence
  RNA Oligomer
cucugcagcaaauacuugu

SEQ ID NO: 3902 - RNA, 19 nt, Artificial Sequence
  RNA Oligomer
cugcagcaaauacuuguuc

SEQ ID NO: 3903 - RNA, 19 nt, Artificial Sequence
  RNA Oligomer
guaaugacaacuucuuguu

SEQ ID NO: 3904 - RNA, 19 nt, Artificial Sequence
  RNA Oligomer
caacuucuuguugaaaucg

SEQ ID NO: 3905 - RNA, 19 nt, Artificial Sequence
  RNA Oligomer
gggccuaaaauccauuucc

SEQ ID NO: 3906 - RNA, 19 nt, Artificial Sequence
  RNA Oligomer
uaggaggccugucugauga

SEQ ID NO: 3907 - RNA, 19 nt, Artificial Sequence
  RNA Oligomer
cugaugaacucaguugacg

SEQ ID NO: 3908 - RNA, 19 nt, Artificial Sequence
  RNA Oligomer
acaggguugagguagcucu

SEQ ID NO: 3909 - RNA, 19 nt, Artificial Sequence
  RNA Oligomer
gaaauaagguuucgacuga

SEQ ID NO: 3910 - RNA, 19 nt, Artificial Sequence
  RNA Oligomer
aauaagguuucgacugaca

SEQ ID NO: 3911 - RNA, 19 nt, Artificial Sequence
  RNA Oligomer
agcucauaucaacaggccg

SEQ ID NO: 3912 - RNA, 19 nt, Artificial Sequence
  RNA Oligomer
cuugauugaaaacacaaug

SEQ ID NO: 3913 - RNA, 19 nt, Artificial Sequence
  RNA Oligomer
ucgagagagcuuuaggucc

SEQ ID NO: 3914 - RNA, 19 nt, Artificial Sequence
  RNA Oligomer
aaggucuucugcuuuaagc

SEQ ID NO: 3915 - RNA, 19 nt, Artificial Sequence
  RNA Oligomer
agggccuaaaauccauuuc

SEQ ID NO: 3916 - RNA, 19 nt, Artificial Sequence
  RNA Oligomer
uugugcagagagagacugu

SEQ ID NO: 3917 - RNA, 19 nt, Artificial Sequence
  RNA Oligomer
ugagguagcucucguuagg

SEQ ID NO: 3918 - RNA, 19 nt, Artificial Sequence
  RNA Oligomer
ugaaugaaauaagguuucg

SEQ ID NO: 3919 - RNA, 19 nt, Artificial Sequence
  RNA Oligomer
aauacaucugucagggcag

SEQ ID NO: 3920 - RNA, 19 nt, Artificial Sequence
  RNA Oligomer
cugcaccaagauguacugc

SEQ ID NO: 3921 - RNA, 19 nt, Artificial Sequence
  RNA Oligomer
uuagcaauucagugguugu

SEQ ID NO: 3922 - RNA, 19 nt, Artificial Sequence
  RNA Oligomer
ggaaucaauaacuugauug

SEQ ID NO: 3923 - RNA, 19 nt, Artificial Sequence
  RNA Oligomer
ugugcagagagagacuguc

SEQ ID NO: 3924 - RNA, 19 nt, Artificial Sequence
  RNA Oligomer
aaugacaacuucuuguuga

SEQ ID NO: 3925 - RNA, 19 nt, Artificial Sequence
  RNA Oligomer
auacaagaccacagggccu

SEQ ID NO: 3926 - RNA, 19 nt, Artificial Sequence
  RNA Oligomer
uacaagaccacagggccua

SEQ ID NO: 3927 - RNA, 19 nt, Artificial Sequence
  RNA Oligomer
cugucaggaaauuucuucu

SEQ ID NO: 3928 - RNA, 19 nt, Artificial Sequence
  RNA Oligomer
uaacagcuaucccauaggc

SEQ ID NO: 3929 - RNA, 19 nt, Artificial Sequence
  RNA Oligomer
augacaacuucuuguugaa

SEQ ID NO: 3930 - RNA, 19 nt, Artificial Sequence
  RNA Oligomer
uaaugacaacuucuuguug

SEQ ID NO: 3931 - RNA, 19 nt, Artificial Sequence
  RNA Oligomer
gaaugaaauaagguuucga

SEQ ID NO: 3932 - RNA, 19 nt, Artificial Sequence
  RNA Oligomer
accugugucuggauguugg

SEQ ID NO: 3933 - RNA, 19 nt, Artificial Sequence
  RNA Oligomer
agcaaauacuuguuccucu

SEQ ID NO: 3934 - RNA, 19 nt, Artificial Sequence
  RNA Oligomer
ucuuguugaaaucgccaga

SEQ ID NO: 3935 - RNA, 19 nt, Artificial Sequence
  RNA Oligomer
gcaacagguuggugaaaac

SEQ ID NO: 3936 - RNA, 19 nt, Artificial Sequence
  RNA Oligomer
agcaacagguuggugaaaa

SEQ ID NO: 3937 - RNA, 19 nt, Artificial Sequence
  RNA Oligomer
aggcggaacuuguaggaac

SEQ ID NO: 3938 - RNA, 19 nt, Artificial Sequence
  RNA Oligomer
ccuggagcgaucguagaaa

SEQ ID NO: 3939 - RNA, 19 nt, Artificial Sequence
  RNA Oligomer
cccuguguccuuggagaaa

SEQ ID NO: 3940 - RNA, 19 nt, Artificial Sequence
  RNA Oligomer
cuggagcgaucguagaaac

SEQ ID NO: 3941 - RNA, 19 nt, Artificial Sequence
  RNA Oligomer
ccuguguccuuggagaaag

SEQ ID NO: 3942 - RNA, 19 nt, Artificial Sequence
  RNA Oligomer
uccuuggagaaagcugguu

SEQ ID NO: 3943 - RNA, 19 nt, Artificial Sequence
  RNA Oligomer
cccaaugcuauuuacauac

SEQ ID NO: 3944 - RNA, 19 nt, Artificial Sequence
  RNA Oligomer
ccuuggagaaagcugguuc

SEQ ID NO: 3945 - RNA, 19 nt, Artificial Sequence
  RNA Oligomer
caaugcuauuuacauacag

SEQ ID NO: 3946 - RNA, 19 nt, Artificial Sequence
  RNA Oligomer
cccuuuggaaauccagcug

SEQ ID NO: 3947 - RNA, 19 nt, Artificial Sequence
  RNA Oligomer
gcccuuuggaaauccagcu

SEQ ID NO: 3948 - RNA, 19 nt, Artificial Sequence
  RNA Oligomer
uggaaauccagcugcagaa

SEQ ID NO: 3949 - RNA, 19 nt, Artificial Sequence
  RNA Oligomer
gaagcccuuuggaaaucca

SEQ ID NO: 3950 - RNA, 19 nt, Artificial Sequence
  RNA Oligomer
ggaagcccuuuggaaaucc

SEQ ID NO: 3951 - RNA, 19 nt, Artificial Sequence
  RNA Oligomer
gguuggugaaaacccugug

SEQ ID NO: 3952 - RNA, 19 nt, Artificial Sequence
  RNA Oligomer
agcgaucguagaaacacag

SEQ ID NO: 3953 - RNA, 19 nt, Artificial Sequence
  RNA Oligomer
ggagcgaucguagaaacac

SEQ ID NO: 3954 - RNA, 19 nt, Artificial Sequence
  RNA Oligomer
agaguaaagacagcgccug

SEQ ID NO: 3955 - RNA, 19 nt, Artificial Sequence
  RNA Oligomer
acagguuggugaaaacccu

SEQ ID NO: 3956 - RNA, 19 nt, Artificial Sequence
  RNA Oligomer
ccagcugcagaaacagaca

SEQ ID NO: 3957 - RNA, 19 nt, Artificial Sequence
  RNA Oligomer
acccuguguccuuggagaa

SEQ ID NO: 3958 - RNA, 19 nt, Artificial Sequence
  RNA Oligomer
augcuauuuacauacagcu

SEQ ID NO: 3959 - RNA, 19 nt, Artificial Sequence
  RNA Oligomer
guuuucaccaaccuguugc

SEQ ID NO: 3960 - RNA, 19 nt, Artificial Sequence
  RNA Oligomer
uuuucaccaaccuguugcu

SEQ ID NO: 3961 - RNA, 19 nt, Artificial Sequence
  RNA Oligomer
guuccuacaaguuccgccu

SEQ ID NO: 3962 - RNA, 19 nt, Artificial Sequence
  RNA Oligomer
uuucuacgaucgcuccagg

SEQ ID NO: 3963 - RNA, 19 nt, Artificial Sequence
  RNA Oligomer
uuucuccaaggacacaggg

SEQ ID NO: 3964 - RNA, 19 nt, Artificial Sequence
  RNA Oligomer
guuucuacgaucgcuccag

SEQ ID NO: 3965 - RNA, 19 nt, Artificial Sequence
  RNA Oligomer
cuuucuccaaggacacagg

SEQ ID NO: 3966 - RNA, 19 nt, Artificial Sequence
  RNA Oligomer
aaccagcuuucuccaagga

SEQ ID NO: 3967 - RNA, 19 nt, Artificial Sequence
  RNA Oligomer
guauguaaauagcauuggg

SEQ ID NO: 3968 - RNA, 19 nt, Artificial Sequence
  RNA Oligomer
gaaccagcuuucuccaagg

SEQ ID NO: 3969 - RNA, 19 nt, Artificial Sequence
  RNA Oligomer
cuguauguaaauagcauug

SEQ ID NO: 3970 - RNA, 19 nt, Artificial Sequence
  RNA Oligomer
cagcuggauuuccaaaggg

SEQ ID NO: 3971 - RNA, 19 nt, Artificial Sequence
  RNA Oligomer
agcuggauuuccaaagggc

SEQ ID NO: 3972 - RNA, 19 nt, Artificial Sequence
  RNA Oligomer
uucugcagcuggauuucca

SEQ ID NO: 3973 - RNA, 19 nt, Artificial Sequence
  RNA Oligomer
uggauuuccaaagggcuuc

SEQ ID NO: 3974 - RNA, 19 nt, Artificial Sequence
  RNA Oligomer
ggauuuccaaagggcuucc

SEQ ID NO: 3975 - RNA, 19 nt, Artificial Sequence
  RNA Oligomer
cacaggguuuucaccaacc

SEQ ID NO: 3976 - RNA, 19 nt, Artificial Sequence
  RNA Oligomer
cuguguuucuacgaucgcu

SEQ ID NO: 3977 - RNA, 19 nt, Artificial Sequence
  RNA Oligomer
guguuucuacgaucgcucc

SEQ ID NO: 3978 - RNA, 19 nt, Artificial Sequence
  RNA Oligomer
caggcgcugucuuuacucu

SEQ ID NO: 3979 - RNA, 19 nt, Artificial Sequence
  RNA Oligomer
aggguuuucaccaaccugu

SEQ ID NO: 3980 - RNA, 19 nt, Artificial Sequence
  RNA Oligomer
ugucuguuucugcagcugg

SEQ ID NO: 3981 - RNA, 19 nt, Artificial Sequence
  RNA Oligomer
uucuccaaggacacagggu

SEQ ID NO: 3982 - RNA, 19 nt, Artificial Sequence
  RNA Oligomer
agcuguauguaaauagcau

SEQ ID NO: 3983 - RNA, 19 nt, Artificial Sequence
  RNA Oligomer
ggaguacauuacuuuucuu

SEQ ID NO: 3984 - RNA, 19 nt, Artificial Sequence
  RNA Oligomer
agacaaagcuuuuguugau

SEQ ID NO: 3985 - RNA, 19 nt, Artificial Sequence
  RNA Oligomer
ccuuauaugaccaccuaau

SEQ ID NO: 3986 - RNA, 19 nt, Artificial Sequence
  RNA Oligomer
cggagacaaagcuuuuguu

SEQ ID NO: 3987 - RNA, 19 nt, Artificial Sequence
  RNA Oligomer
ugggacagaagcgaaauua

SEQ ID NO: 3988 - RNA, 19 nt, Artificial Sequence
  RNA Oligomer
gaaugggacagaagcgaaa

SEQ ID NO: 3989 - RNA, 19 nt, Artificial Sequence
  RNA Oligomer
ggacaacacuuuugcagau

SEQ ID NO: 3990 - RNA, 19 nt, Artificial Sequence
  RNA Oligomer
ggauacuaauuauacacuc

SEQ ID NO: 3991 - RNA, 19 nt, Artificial Sequence
  RNA Oligomer
ggaggaaagaaaaauucag

SEQ ID NO: 3992 - RNA, 19 nt, Artificial Sequence
  RNA Oligomer
cgagucugaauggaaggau

SEQ ID NO: 3993 - RNA, 19 nt, Artificial Sequence
  RNA Oligomer
gacaaagcuuuuguugauu

SEQ ID NO: 3994 - RNA, 19 nt, Artificial Sequence
  RNA Oligomer
gggaaaaaaucacggucac

SEQ ID NO: 3995 - RNA, 19 nt, Artificial Sequence
  RNA Oligomer
caccaggaguacauuacuu

SEQ ID NO: 3996 - RNA, 19 nt, Artificial Sequence
  RNA Oligomer
cugaauggaaggauacuaa

SEQ ID NO: 3997 - RNA, 19 nt, Artificial Sequence
  RNA Oligomer
ccgacggagacaaagcuuu

SEQ ID NO: 3998 - RNA, 19 nt, Artificial Sequence
  RNA Oligomer
cgaaauuagugcggaaagu

SEQ ID NO: 3999 - RNA, 19 nt, Artificial Sequence
  RNA Oligomer
augggacagaagcgaaauu

SEQ ID NO: 4000 - RNA, 19 nt, Artificial Sequence
  RNA Oligomer
ucaagaguuuugucaagag

SEQ ID NO: 4001 - RNA, 19 nt, Artificial Sequence
  RNA Oligomer
ccaggaguacauuacuuuu

SEQ ID NO: 4002 - RNA, 19 nt, Artificial Sequence
  RNA Oligomer
ugacaucaacucccaauuu

SEQ ID NO: 4003 - RNA, 19 nt, Artificial Sequence
  RNA Oligomer
cugacaucaacucccaauu

SEQ ID NO: 4004 - RNA, 19 nt, Artificial Sequence
  RNA Oligomer
cggucacuuucaacauuaa

SEQ ID NO: 4005 - RNA, 19 nt, Artificial Sequence
  RNA Oligomer
agcgaaauuagugcggaaa

SEQ ID NO: 4006 - RNA, 19 nt, Artificial Sequence
  RNA Oligomer
ggacagaagcgaaauuagu

SEQ ID NO: 4007 - RNA, 19 nt, Artificial Sequence
  RNA Oligomer
gggacagaagcgaaauuag

SEQ ID NO: 4008 - RNA, 19 nt, Artificial Sequence
  RNA Oligomer
gcuuuggccagugaacaaa

SEQ ID NO: 4009 - RNA, 19 nt, Artificial Sequence
  RNA Oligomer
uccugagugaugaaauuaa

SEQ ID NO: 4010 - RNA, 19 nt, Artificial Sequence
  RNA Oligomer
agaguuuugucaagagcca

SEQ ID NO: 4011 - RNA, 19 nt, Artificial Sequence
  RNA Oligomer
accucaagaguuuugucaa

SEQ ID NO: 4012 - RNA, 19 nt, Artificial Sequence
  RNA Oligomer
gaccucaagaguuuuguca

SEQ ID NO: 4013 - RNA, 19 nt, Artificial Sequence
  RNA Oligomer
accaggaguacauuacuuu

SEQ ID NO: 4014 - RNA, 19 nt, Artificial Sequence
  RNA Oligomer
ggaaggauacuaauuauac

SEQ ID NO: 4015 - RNA, 19 nt, Artificial Sequence
  RNA Oligomer
gaauggaaggauacuaauu

SEQ ID NO: 4016 - RNA, 19 nt, Artificial Sequence
  RNA Oligomer
ugaauggaaggauacuaau

SEQ ID NO: 4017 - RNA, 19 nt, Artificial Sequence
  RNA Oligomer
ggagacaaagcuuuuguug

SEQ ID NO: 4018 - RNA, 19 nt, Artificial Sequence
  RNA Oligomer
agaaugaugauggcaagaa

SEQ ID NO: 4019 - RNA, 19 nt, Artificial Sequence
  RNA Oligomer
ucgugguugaaguuauaaa

SEQ ID NO: 4020 - RNA, 19 nt, Artificial Sequence
  RNA Oligomer
cgacggagacaaagcuuuu

SEQ ID NO: 4021 - RNA, 19 nt, Artificial Sequence
  RNA Oligomer
gcauaaaacccucccuaag

SEQ ID NO: 4022 - RNA, 19 nt, Artificial Sequence
  RNA Oligomer
ugaugaaauuaaggaggaa

SEQ ID NO: 4023 - RNA, 19 nt, Artificial Sequence
  RNA Oligomer
ccugagugaugaaauuaag

SEQ ID NO: 4024 - RNA, 19 nt, Artificial Sequence
  RNA Oligomer
gaagaccucaagaguuuug

SEQ ID NO: 4025 - RNA, 19 nt, Artificial Sequence
  RNA Oligomer
aggaguacauuacuuuucu

SEQ ID NO: 4026 - RNA, 19 nt, Artificial Sequence
  RNA Oligomer
cuaauuauacacucaacac

SEQ ID NO: 4027 - RNA, 19 nt, Artificial Sequence
  RNA Oligomer
caaagcuuuuguugauuuc

SEQ ID NO: 4028 - RNA, 19 nt, Artificial Sequence
  RNA Oligomer
cgugguugaaguuauaaag

SEQ ID NO: 4029 - RNA, 19 nt, Artificial Sequence
  RNA Oligomer
gacaucaacucccaauuuc

SEQ ID NO: 4030 - RNA, 19 nt, Artificial Sequence
  RNA Oligomer
gcagaagguugaagaacag

SEQ ID NO: 4031 - RNA, 19 nt, Artificial Sequence
  RNA Oligomer
ucaacauuaacaacagcau

SEQ ID NO: 4032 - RNA, 19 nt, Artificial Sequence
  RNA Oligomer
gaaaaaaucacggucacuu

SEQ ID NO: 4033 - RNA, 19 nt, Artificial Sequence
  RNA Oligomer
gcgaaauuagugcggaaag

SEQ ID NO: 4034 - RNA, 19 nt, Artificial Sequence
  RNA Oligomer
agcauaaaacccucccuaa

SEQ ID NO: 4035 - RNA, 19 nt, Artificial Sequence
  RNA Oligomer
gaggaaagaaaaauucaga

SEQ ID NO: 4036 - RNA, 19 nt, Artificial Sequence
  RNA Oligomer
gaaauuaaggaggaaagaa

SEQ ID NO: 4037 - RNA, 19 nt, Artificial Sequence
  RNA Oligomer
ugagugaugaaauuaagga

SEQ ID NO: 4038 - RNA, 19 nt, Artificial Sequence
  RNA Oligomer
uuacuuuucuugaagaccu

SEQ ID NO: 4039 - RNA, 19 nt, Artificial Sequence
  RNA Oligomer
cauuacuuuucuugaagac

SEQ ID NO: 4040 - RNA, 19 nt, Artificial Sequence
  RNA Oligomer
caggaguacauuacuuuuc

SEQ ID NO: 4041 - RNA, 19 nt, Artificial Sequence
  RNA Oligomer
ugauuuccugagugaugaa

SEQ ID NO: 4042 - RNA, 19 nt, Artificial Sequence
  RNA Oligomer
ggguuguccuuugcaucug

SEQ ID NO: 4043 - RNA, 19 nt, Artificial Sequence
  RNA Oligomer
gagucugaauggaaggaua

SEQ ID NO: 4044 - RNA, 19 nt, Artificial Sequence
  RNA Oligomer
cuaucagggaaguuagcuu

SEQ ID NO: 4045 - RNA, 19 nt, Artificial Sequence
  RNA Oligomer
ggcagaagguugaagaaca

SEQ ID NO: 4046 - RNA, 19 nt, Artificial Sequence
  RNA Oligomer
acggucacuuucaacauua

SEQ ID NO: 4047 - RNA, 19 nt, Artificial Sequence
  RNA Oligomer
ggaaaaaaucacggucacu

SEQ ID NO: 4048 - RNA, 19 nt, Artificial Sequence
  RNA Oligomer
aagcgaaauuagugcggaa

SEQ ID NO: 4049 - RNA, 19 nt, Artificial Sequence
  RNA Oligomer
gaagcgaaauuagugcgga

SEQ ID NO: 4050 - RNA, 19 nt, Artificial Sequence
  RNA Oligomer
gugaugaaauuaaggagga

SEQ ID NO: 4051 - RNA, 19 nt, Artificial Sequence
  RNA Oligomer
guuuugucaagagccagua

SEQ ID NO: 4052 - RNA, 19 nt, Artificial Sequence
  RNA Oligomer
caagaguuuugucaagagc

SEQ ID NO: 4053 - RNA, 19 nt, Artificial Sequence
  RNA Oligomer
gaguacauuacuuuucuug

SEQ ID NO: 4054 - RNA, 19 nt, Artificial Sequence
  RNA Oligomer
ucugaauggaaggauacua

SEQ ID NO: 4055 - RNA, 19 nt, Artificial Sequence
  RNA Oligomer
gcgagucugaauggaagga

SEQ ID NO: 4056 - RNA, 19 nt, Artificial Sequence
  RNA Oligomer
ucagggaaguuagcuuuca

SEQ ID NO: 4057 - RNA, 19 nt, Artificial Sequence
  RNA Oligomer
ggcugagagugacaucuuc

SEQ ID NO: 4058 - RNA, 19 nt, Artificial Sequence
  RNA Oligomer
gaaugaugauggcaagaag

SEQ ID NO: 4059 - RNA, 19 nt, Artificial Sequence
  RNA Oligomer
uaaagaaugaugauggcaa

SEQ ID NO: 4060 - RNA, 19 nt, Artificial Sequence
  RNA Oligomer
gugguugaaguuauaaaga

SEQ ID NO: 4061 - RNA, 19 nt, Artificial Sequence
  RNA Oligomer
caauuucgugguugaaguu

SEQ ID NO: 4062 - RNA, 19 nt, Artificial Sequence
  RNA Oligomer
acggagacaaagcuuuugu

SEQ ID NO: 4063 - RNA, 19 nt, Artificial Sequence
  RNA Oligomer
cacggucacuuucaacauu

SEQ ID NO: 4064 - RNA, 19 nt, Artificial Sequence
  RNA Oligomer
gugcuuugaaaugauuauc

SEQ ID NO: 4065 - RNA, 19 nt, Artificial Sequence
  RNA Oligomer
cuagacaugugcuuugaaa

SEQ ID NO: 4066 - RNA, 19 nt, Artificial Sequence
  RNA Oligomer
gagugaugaaauuaaggag

SEQ ID NO: 4067 - RNA, 19 nt, Artificial Sequence
  RNA Oligomer
ugaagaccucaagaguuuu

SEQ ID NO: 4068 - RNA, 19 nt, Artificial Sequence
  RNA Oligomer
uugaagaccucaagaguuu

SEQ ID NO: 4069 - RNA, 19 nt, Artificial Sequence
  RNA Oligomer
acaacacuuuugcagauga

SEQ ID NO: 4070 - RNA, 19 nt, Artificial Sequence
  RNA Oligomer
caucuucucuaucagggaa

SEQ ID NO: 4071 - RNA, 19 nt, Artificial Sequence
  RNA Oligomer
gaaauuagugcggaaaguu

SEQ ID NO: 4072 - RNA, 19 nt, Artificial Sequence
  RNA Oligomer
ugaaauuaaggaggaaaga

SEQ ID NO: 4073 - RNA, 19 nt, Artificial Sequence
  RNA Oligomer
gaugaaauuaaggaggaaa

SEQ ID NO: 4074 - RNA, 19 nt, Artificial Sequence
  RNA Oligomer
gauuuccugagugaugaaa

SEQ ID NO: 4075 - RNA, 19 nt, Artificial Sequence
  RNA Oligomer
caacacuuuugcagaugag

SEQ ID NO: 4076 - RNA, 19 nt, Artificial Sequence
  RNA Oligomer
gacaacacuuuugcagaug

SEQ ID NO: 4077 - RNA, 19 nt, Artificial Sequence
  RNA Oligomer
acacucaacacagauuccu

SEQ ID NO: 4078 - RNA, 19 nt, Artificial Sequence
  RNA Oligomer
uggcgagucugaauggaag

SEQ ID NO: 4079 - RNA, 19 nt, Artificial Sequence
  RNA Oligomer
cuggcgagucugaauggaa

SEQ ID NO: 4080 - RNA, 19 nt, Artificial Sequence
  RNA Oligomer
cagggaaguuagcuuucag

SEQ ID NO: 4081 - RNA, 19 nt, Artificial Sequence
  RNA Oligomer
agcuuuuguugauuuccug

SEQ ID NO: 4082 - RNA, 19 nt, Artificial Sequence
  RNA Oligomer
uucucuaucagggaaguua

SEQ ID NO: 4083 - RNA, 19 nt, Artificial Sequence
  RNA Oligomer
acgaggcugagagugacau

SEQ ID NO: 4084 - RNA, 19 nt, Artificial Sequence
  RNA Oligomer
gaagguugaagaacaggag

SEQ ID NO: 4085 - RNA, 19 nt, Artificial Sequence
  RNA Oligomer
aaaucacggucacuuucaa

SEQ ID NO: 4086 - RNA, 19 nt, Artificial Sequence
  RNA Oligomer
ggaacugaaugggacagaa

SEQ ID NO: 4087 - RNA, 19 nt, Artificial Sequence
  RNA Oligomer
guugggagcuggaacugaa

SEQ ID NO: 4088 - RNA, 19 nt, Artificial Sequence
  RNA Oligomer
cuacucugaagcuagacau

SEQ ID NO: 4089 - RNA, 19 nt, Artificial Sequence
  RNA Oligomer
gaaguuagcuuucagucca

SEQ ID NO: 4090 - RNA, 19 nt, Artificial Sequence
  RNA Oligomer
agggaaguuagcuuucagu

SEQ ID NO: 4091 - RNA, 19 nt, Artificial Sequence
  RNA Oligomer
ugagguuggacaagaagac

SEQ ID NO: 4092 - RNA, 19 nt, Artificial Sequence
  RNA Oligomer
gacggagacaaagcuuuug

SEQ ID NO: 4093 - RNA, 19 nt, Artificial Sequence
  RNA Oligomer
agaagguugaagaacagga

SEQ ID NO: 4094 - RNA, 19 nt, Artificial Sequence
  RNA Oligomer
caacauuugauggugagga

SEQ ID NO: 4095 - RNA, 19 nt, Artificial Sequence
  RNA Oligomer
gccaguagagcagacagau

SEQ ID NO: 4096 - RNA, 19 nt, Artificial Sequence
  RNA Oligomer
ccuaauggauuuccuugcc

SEQ ID NO: 4097 - RNA, 19 nt, Artificial Sequence
  RNA Oligomer
ucaacacagauuccuugga

SEQ ID NO: 4098 - RNA, 19 nt, Artificial Sequence
  RNA Oligomer
cacucaacacagauuccuu

SEQ ID NO: 4099 - RNA, 19 nt, Artificial Sequence
  RNA Oligomer
aagcuuuuguugauuuccu

SEQ ID NO: 4100 - RNA, 19 nt, Artificial Sequence
  RNA Oligomer
gacaagaagacgaggcuga

SEQ ID NO: 4101 - RNA, 19 nt, Artificial Sequence
  RNA Oligomer
uggacaagaagacgaggcu

SEQ ID NO: 4102 - RNA, 19 nt, Artificial Sequence
  RNA Oligomer
gguuggacaagaagacgag

SEQ ID NO: 4103 - RNA, 19 nt, Artificial Sequence
  RNA Oligomer
guguuggacugucauuauc

SEQ ID NO: 4104 - RNA, 19 nt, Artificial Sequence
  RNA Oligomer
gguugaagaacaggagccu

SEQ ID NO: 4105 - RNA, 19 nt, Artificial Sequence
  RNA Oligomer
gggcagaagguugaagaac

SEQ ID NO: 4106 - RNA, 19 nt, Artificial Sequence
  RNA Oligomer
ucacggucacuuucaacau

SEQ ID NO: 4107 - RNA, 19 nt, Artificial Sequence
  RNA Oligomer
ggaaagaaaaauucagaag

SEQ ID NO: 4108 - RNA, 19 nt, Artificial Sequence
  RNA Oligomer
gacaugugcuuugaaauga

SEQ ID NO: 4109 - RNA, 19 nt, Artificial Sequence
  RNA Oligomer
gcuagacaugugcuuugaa

SEQ ID NO: 4110 - RNA, 19 nt, Artificial Sequence
  RNA Oligomer
ccaguagagcagacagaug

SEQ ID NO: 4111 - RNA, 19 nt, Artificial Sequence
  RNA Oligomer
guggacaacacuuuugcag

SEQ ID NO: 4112 - RNA, 19 nt, Artificial Sequence
  RNA Oligomer
gggaaguuagcuuucaguc

SEQ ID NO: 4113 - RNA, 19 nt, Artificial Sequence
  RNA Oligomer
agaggaugagguuggacaa

SEQ ID NO: 4114 - RNA, 19 nt, Artificial Sequence
  RNA Oligomer
ccuuguguuggacugucau

SEQ ID NO: 4115 - RNA, 19 nt, Artificial Sequence
  RNA Oligomer
cuuucaacauuaacaacag

SEQ ID NO: 4116 - RNA, 19 nt, Artificial Sequence
  RNA Oligomer
uguguuggacugucauuau

SEQ ID NO: 4117 - RNA, 19 nt, Artificial Sequence
  RNA Oligomer
caucccaccaacauuugau

SEQ ID NO: 4118 - RNA, 19 nt, Artificial Sequence
  RNA Oligomer
gcaucccaccaacauuuga

SEQ ID NO: 4119 - RNA, 19 nt, Artificial Sequence
  RNA Oligomer
agacaugugcuuugaaaug

SEQ ID NO: 4120 - RNA, 19 nt, Artificial Sequence
  RNA Oligomer
aaauccuacucugaagcua

SEQ ID NO: 4121 - RNA, 19 nt, Artificial Sequence
  RNA Oligomer
ggaugagguuggacaagaa

SEQ ID NO: 4122 - RNA, 19 nt, Artificial Sequence
  RNA Oligomer
ccaccuaauggauuuccuu

SEQ ID NO: 4123 - RNA, 19 nt, Artificial Sequence
  RNA Oligomer
ggccuuauaugaccaccua

SEQ ID NO: 4124 - RNA, 19 nt, Artificial Sequence
  RNA Oligomer
acaugugcuuugaaaugau

SEQ ID NO: 4125 - RNA, 19 nt, Artificial Sequence
  RNA Oligomer
ggccagugaacaaauccua

SEQ ID NO: 4126 - RNA, 19 nt, Artificial Sequence
  RNA Oligomer
augaccaccuaauggauuu

SEQ ID NO: 4127 - RNA, 19 nt, Artificial Sequence
  RNA Oligomer
gaaagaaaaauucagaagc

SEQ ID NO: 4128 - RNA, 19 nt, Artificial Sequence
  RNA Oligomer
ggagcaccaggaguacauu

SEQ ID NO: 4129 - RNA, 19 nt, Artificial Sequence
  RNA Oligomer
gccuuauaugaccaccuaa

SEQ ID NO: 4130 - RNA, 19 nt, Artificial Sequence
  RNA Oligomer
ggacugucauuauccagag

SEQ ID NO: 4131 - RNA, 19 nt, Artificial Sequence
  RNA Oligomer
ucccaauuucgugguugaa

SEQ ID NO: 4132 - RNA, 19 nt, Artificial Sequence
  RNA Oligomer
cucccaauuucgugguuga

SEQ ID NO: 4133 - RNA, 19 nt, Artificial Sequence
  RNA Oligomer
gagccugaacugacaucaa

SEQ ID NO: 4134 - RNA, 19 nt, Artificial Sequence
  RNA Oligomer
caugugcuuugaaaugauu

SEQ ID NO: 4135 - RNA, 19 nt, Artificial Sequence
  RNA Oligomer
ccagugaacaaauccuacu

SEQ ID NO: 4136 - RNA, 19 nt, Artificial Sequence
  RNA Oligomer
gacagaugcugaaagccau

SEQ ID NO: 4137 - RNA, 19 nt, Artificial Sequence
  RNA Oligomer
ccucaagaguuuugucaag

SEQ ID NO: 4138 - RNA, 19 nt, Artificial Sequence
  RNA Oligomer
gggccuuauaugaccaccu

SEQ ID NO: 4139 - RNA, 19 nt, Artificial Sequence
  RNA Oligomer
aggcugagagugacaucuu

SEQ ID NO: 4140 - RNA, 19 nt, Artificial Sequence
  RNA Oligomer
ccaauuucgugguugaagu

SEQ ID NO: 4141 - RNA, 19 nt, Artificial Sequence
  RNA Oligomer
gucacuuucaacauuaaca

SEQ ID NO: 4142 - RNA, 19 nt, Artificial Sequence
  RNA Oligomer
uggagcaccaggaguacau

SEQ ID NO: 4143 - RNA, 19 nt, Artificial Sequence
  RNA Oligomer
agagugacaucuucucuau

SEQ ID NO: 4144 - RNA, 19 nt, Artificial Sequence
  RNA Oligomer
agggcagaagguugaagaa

SEQ ID NO: 4145 - RNA, 19 nt, Artificial Sequence
  RNA Oligomer
gcaagggcagaagguugaa

SEQ ID NO: 4146 - RNA, 19 nt, Artificial Sequence
  RNA Oligomer
ccuggguuguccuuugcau

SEQ ID NO: 4147 - RNA, 19 nt, Artificial Sequence
  RNA Oligomer
gaacaaauccuacucugaa

SEQ ID NO: 4148 - RNA, 19 nt, Artificial Sequence
  RNA Oligomer
ggcuuuggccagugaacaa

SEQ ID NO: 4149 - RNA, 19 nt, Artificial Sequence
  RNA Oligomer
agaugcugaaagccauagu

SEQ ID NO: 4150 - RNA, 19 nt, Artificial Sequence
  RNA Oligomer
acagaugcugaaagccaua

SEQ ID NO: 4151 - RNA, 19 nt, Artificial Sequence
  RNA Oligomer
gagcaccaggaguacauua

SEQ ID NO: 4152 - RNA, 19 nt, Artificial Sequence
  RNA Oligomer
ugaccaccuaauggauuuc

SEQ ID NO: 4153 - RNA, 19 nt, Artificial Sequence
  RNA Oligomer
aacucccaauuucgugguu

SEQ ID NO: 4154 - RNA, 19 nt, Artificial Sequence
  RNA Oligomer
gccugaacugacaucaacu

SEQ ID NO: 4155 - RNA, 19 nt, Artificial Sequence
  RNA Oligomer
ggagccugaacugacauca

SEQ ID NO: 4156 - RNA, 19 nt, Artificial Sequence
  RNA Oligomer
agagcagacagaugcugaa

SEQ ID NO: 4157 - RNA, 19 nt, Artificial Sequence
  RNA Oligomer
cucaagaguuuugucaaga

SEQ ID NO: 4158 - RNA, 19 nt, Artificial Sequence
  RNA Oligomer
gcaccaggaguacauuacu

SEQ ID NO: 4159 - RNA, 19 nt, Artificial Sequence
  RNA Oligomer
accaccuaauggauuuccu

SEQ ID NO: 4160 - RNA, 19 nt, Artificial Sequence
  RNA Oligomer
uccuuggacugggccuuau

SEQ ID NO: 4161 - RNA, 19 nt, Artificial Sequence
  RNA Oligomer
aggaugagguuggacaaga

SEQ ID NO: 4162 - RNA, 19 nt, Artificial Sequence
  RNA Oligomer
ugaagaacaggagccugaa

SEQ ID NO: 4163 - RNA, 19 nt, Artificial Sequence
  RNA Oligomer
ggucacuuucaacauuaac

SEQ ID NO: 4164 - RNA, 19 nt, Artificial Sequence
  RNA Oligomer
uggaacugaaugggacaga

SEQ ID NO: 4165 - RNA, 19 nt, Artificial Sequence
  RNA Oligomer
ccuaagaugucuggagguu

SEQ ID NO: 4166 - RNA, 19 nt, Artificial Sequence
  RNA Oligomer
ccuuggacugggccuuaua

SEQ ID NO: 4167 - RNA, 19 nt, Artificial Sequence
  RNA Oligomer
gugacaucuucucuaucag

SEQ ID NO: 4168 - RNA, 19 nt, Artificial Sequence
  RNA Oligomer
cccaauuucgugguugaag

SEQ ID NO: 4169 - RNA, 19 nt, Artificial Sequence
  RNA Oligomer
acaggagccugaacugaca

SEQ ID NO: 4170 - RNA, 19 nt, Artificial Sequence
  RNA Oligomer
auaaaacccucccuaagau

SEQ ID NO: 4171 - RNA, 19 nt, Artificial Sequence
  RNA Oligomer
cagugaacaaauccuacuc

SEQ ID NO: 4172 - RNA, 19 nt, Artificial Sequence
  RNA Oligomer
gccagugaacaaauccuac

SEQ ID NO: 4173 - RNA, 19 nt, Artificial Sequence
  RNA Oligomer
ggguggacaacacuuuugc

SEQ ID NO: 4174 - RNA, 19 nt, Artificial Sequence
  RNA Oligomer
agugacaucuucucuauca

SEQ ID NO: 4175 - RNA, 19 nt, Artificial Sequence
  RNA Oligomer
gagagugacaucuucucua

SEQ ID NO: 4176 - RNA, 19 nt, Artificial Sequence
  RNA Oligomer
acugacaucaacucccaau

SEQ ID NO: 4177 - RNA, 19 nt, Artificial Sequence
  RNA Oligomer
gaacugacaucaacuccca

SEQ ID NO: 4178 - RNA, 19 nt, Artificial Sequence
  RNA Oligomer
agccugaacugacaucaac

SEQ ID NO: 4179 - RNA, 19 nt, Artificial Sequence
  RNA Oligomer
aagcauaaaacccucccua

SEQ ID NO: 4180 - RNA, 19 nt, Artificial Sequence
  RNA Oligomer
gaagcauaaaacccucccu

SEQ ID NO: 4181 - RNA, 19 nt, Artificial Sequence
  RNA Oligomer
gugaacaaauccuacucug

SEQ ID NO: 4182 - RNA, 19 nt, Artificial Sequence
  RNA Oligomer
uggccagugaacaaauccu

SEQ ID NO: 4183 - RNA, 19 nt, Artificial Sequence
  RNA Oligomer
gcagacagaugcugaaagc

SEQ ID NO: 4184 - RNA, 19 nt, Artificial Sequence
  RNA Oligomer
agcaccaggaguacauuac

SEQ ID NO: 4185 - RNA, 19 nt, Artificial Sequence
  RNA Oligomer
ucauuauccagaggaugag

SEQ ID NO: 4186 - RNA, 19 nt, Artificial Sequence
  RNA Oligomer
cugucauuauccagaggau

SEQ ID NO: 4187 - RNA, 19 nt, Artificial Sequence
  RNA Oligomer
cccuuguguuggacuguca

SEQ ID NO: 4188 - RNA, 19 nt, Artificial Sequence
  RNA Oligomer
ccugaacugacaucaacuc

SEQ ID NO: 4189 - RNA, 19 nt, Artificial Sequence
  RNA Oligomer
ccaccaacauuugauggug

SEQ ID NO: 4190 - RNA, 19 nt, Artificial Sequence
  RNA Oligomer
cccuaagaugucuggaggu

SEQ ID NO: 4191 - RNA, 19 nt, Artificial Sequence
  RNA Oligomer
ucagaagcauaaaacccuc

SEQ ID NO: 4192 - RNA, 19 nt, Artificial Sequence
  RNA Oligomer
agugaacaaauccuacucu

SEQ ID NO: 4193 - RNA, 19 nt, Artificial Sequence
  RNA Oligomer
cuuuucuugaagaccucaa

SEQ ID NO: 4194 - RNA, 19 nt, Artificial Sequence
  RNA Oligomer
cugggccuuauaugaccac

SEQ ID NO: 4195 - RNA, 19 nt, Artificial Sequence
  RNA Oligomer
ggacugggccuuauaugac

SEQ ID NO: 4196 - RNA, 19 nt, Artificial Sequence
  RNA Oligomer
gcaagaaggcccuuguguu

SEQ ID NO: 4197 - RNA, 19 nt, Artificial Sequence
  RNA Oligomer
caacucccaauuucguggu

SEQ ID NO: 4198 - RNA, 19 nt, Artificial Sequence
  RNA Oligomer
cccaccaacauuugauggu

SEQ ID NO: 4199 - RNA, 19 nt, Artificial Sequence
  RNA Oligomer
agagccaguagagcagaca

SEQ ID NO: 4200 - RNA, 19 nt, Artificial Sequence
  RNA Oligomer
acagcaucccaccaacauu

SEQ ID NO: 4201 - RNA, 19 nt, Artificial Sequence
  RNA Oligomer
caacacagauuccuuggac

SEQ ID NO: 4202 - RNA, 19 nt, Artificial Sequence
  RNA Oligomer
caccaacauuugaugguga

SEQ ID NO: 4203 - RNA, 19 nt, Artificial Sequence
  RNA Oligomer
cucccuaagaugucuggag

SEQ ID NO: 4204 - RNA, 19 nt, Artificial Sequence
  RNA Oligomer
agcagacagaugcugaaag

SEQ ID NO: 4205 - RNA, 19 nt, Artificial Sequence
  RNA Oligomer
cacuuuugcagaugagcug

SEQ ID NO: 4206 - RNA, 19 nt, Artificial Sequence
  RNA Oligomer
uggacugucauuauccaga

SEQ ID NO: 4207 - RNA, 19 nt, Artificial Sequence
  RNA Oligomer
agaaggcccuuguguugga

SEQ ID NO: 4208 - RNA, 19 nt, Artificial Sequence
  RNA Oligomer
accaacauuugauggugag

SEQ ID NO: 4209 - RNA, 19 nt, Artificial Sequence
  RNA Oligomer
cugagagugacaucuucuc

SEQ ID NO: 4210 - RNA, 19 nt, Artificial Sequence
  RNA Oligomer
cagcaucccaccaacauuu

SEQ ID NO: 4211 - RNA, 19 nt, Artificial Sequence
  RNA Oligomer
gagcagacagaugcugaaa

SEQ ID NO: 4212 - RNA, 19 nt, Artificial Sequence
  RNA Oligomer
agccaguagagcagacaga

SEQ ID NO: 4213 - RNA, 19 nt, Artificial Sequence
  RNA Oligomer
ccuacucugaagcuagaca

SEQ ID NO: 4214 - RNA, 19 nt, Artificial Sequence
  RNA Oligomer
acaacagcaucccaccaac

SEQ ID NO: 4215 - RNA, 19 nt, Artificial Sequence
  RNA Oligomer
aacaacagcaucccaccaa

SEQ ID NO: 4216 - RNA, 19 nt, Artificial Sequence
  RNA Oligomer
uccagaggaugagguugga

SEQ ID NO: 4217 - RNA, 19 nt, Artificial Sequence
  RNA Oligomer
gaccaccuaauggauuucc

SEQ ID NO: 4218 - RNA, 19 nt, Artificial Sequence
  RNA Oligomer
aagaaaaguaauguacucc

SEQ ID NO: 4219 - RNA, 19 nt, Artificial Sequence
  RNA Oligomer
aucaacaaaagcuuugucu

SEQ ID NO: 4220 - RNA, 19 nt, Artificial Sequence
  RNA Oligomer
auuagguggucauauaagg

SEQ ID NO: 4221 - RNA, 19 nt, Artificial Sequence
  RNA Oligomer
aacaaaagcuuugucuccg

SEQ ID NO: 4222 - RNA, 19 nt, Artificial Sequence
  RNA Oligomer
uaauuucgcuucuguccca

SEQ ID NO: 4223 - RNA, 19 nt, Artificial Sequence
  RNA Oligomer
uuucgcuucugucccauuc

SEQ ID NO: 4224 - RNA, 19 nt, Artificial Sequence
  RNA Oligomer
aucugcaaaaguguugucc

SEQ ID NO: 4225 - RNA, 19 nt, Artificial Sequence
  RNA Oligomer
gaguguauaauuaguaucc

SEQ ID NO: 4226 - RNA, 19 nt, Artificial Sequence
  RNA Oligomer
cugaauuuuucuuuccucc

SEQ ID NO: 4227 - RNA, 19 nt, Artificial Sequence
  RNA Oligomer
auccuuccauucagacucg

SEQ ID NO: 4228 - RNA, 19 nt, Artificial Sequence
  RNA Oligomer
aaucaacaaaagcuuuguc

SEQ ID NO: 4229 - RNA, 19 nt, Artificial Sequence
  RNA Oligomer
gugaccgugauuuuuuccc

SEQ ID NO: 4230 - RNA, 19 nt, Artificial Sequence
  RNA Oligomer
aaguaauguacuccuggug

SEQ ID NO: 4231 - RNA, 19 nt, Artificial Sequence
  RNA Oligomer
uuaguauccuuccauucag

SEQ ID NO: 4232 - RNA, 19 nt, Artificial Sequence
  RNA Oligomer
aaagcuuugucuccgucgg

SEQ ID NO: 4233 - RNA, 19 nt, Artificial Sequence
  RNA Oligomer
acuuuccgcacuaauuucg

SEQ ID NO: 4234 - RNA, 19 nt, Artificial Sequence
  RNA Oligomer
aauuucgcuucugucccau

SEQ ID NO: 4235 - RNA, 19 nt, Artificial Sequence
  RNA Oligomer
cucuugacaaaacucuuga

SEQ ID NO: 4236 - RNA, 19 nt, Artificial Sequence
  RNA Oligomer
aaaaguaauguacuccugg

SEQ ID NO: 4237 - RNA, 19 nt, Artificial Sequence
  RNA Oligomer
aaauugggaguugauguca

SEQ ID NO: 4238 - RNA, 19 nt, Artificial Sequence
  RNA Oligomer
aauugggaguugaugucag

SEQ ID NO: 4239 - RNA, 19 nt, Artificial Sequence
  RNA Oligomer
uuaauguugaaagugaccg

SEQ ID NO: 4240 - RNA, 19 nt, Artificial Sequence
  RNA Oligomer
uuuccgcacuaauuucgcu

SEQ ID NO: 4241 - RNA, 19 nt, Artificial Sequence
  RNA Oligomer
acuaauuucgcuucugucc

SEQ ID NO: 4242 - RNA, 19 nt, Artificial Sequence
  RNA Oligomer
cuaauuucgcuucuguccc

SEQ ID NO: 4243 - RNA, 19 nt, Artificial Sequence
  RNA Oligomer
uuuguucacuggccaaagc

SEQ ID NO: 4244 - RNA, 19 nt, Artificial Sequence
  RNA Oligomer
uuaauuucaucacucagga

SEQ ID NO: 4245 - RNA, 19 nt, Artificial Sequence
  RNA Oligomer
uggcucuugacaaaacucu

SEQ ID NO: 4246 - RNA, 19 nt, Artificial Sequence
  RNA Oligomer
uugacaaaacucuugaggu

SEQ ID NO: 4247 - RNA, 19 nt, Artificial Sequence
  RNA Oligomer
ugacaaaacucuugagguc

SEQ ID NO: 4248 - RNA, 19 nt, Artificial Sequence
  RNA Oligomer
aaaguaauguacuccuggu

SEQ ID NO: 4249 - RNA, 19 nt, Artificial Sequence
  RNA Oligomer
guauaauuaguauccuucc

SEQ ID NO: 4250 - RNA, 19 nt, Artificial Sequence
  RNA Oligomer
aauuaguauccuuccauuc

SEQ ID NO: 4251 - RNA, 19 nt, Artificial Sequence
  RNA Oligomer
auuaguauccuuccauuca

SEQ ID NO: 4252 - RNA, 19 nt, Artificial Sequence
  RNA Oligomer
caacaaaagcuuugucucc

SEQ ID NO: 4253 - RNA, 19 nt, Artificial Sequence
  RNA Oligomer
uucuugccaucaucauucu

SEQ ID NO: 4254 - RNA, 19 nt, Artificial Sequence
  RNA Oligomer
uuuauaacuucaaccacga

SEQ ID NO: 4255 - RNA, 19 nt, Artificial Sequence
  RNA Oligomer
aaaagcuuugucuccgucg

SEQ ID NO: 4256 - RNA, 19 nt, Artificial Sequence
  RNA Oligomer
cuuagggaggguuuuaugc

SEQ ID NO: 4257 - RNA, 19 nt, Artificial Sequence
  RNA Oligomer
uuccuccuuaauuucauca

SEQ ID NO: 4258 - RNA, 19 nt, Artificial Sequence
  RNA Oligomer
cuuaauuucaucacucagg

SEQ ID NO: 4259 - RNA, 19 nt, Artificial Sequence
  RNA Oligomer
caaaacucuugaggucuuc

SEQ ID NO: 4260 - RNA, 19 nt, Artificial Sequence
  RNA Oligomer
agaaaaguaauguacuccu

SEQ ID NO: 4261 - RNA, 19 nt, Artificial Sequence
  RNA Oligomer
guguugaguguauaauuag

SEQ ID NO: 4262 - RNA, 19 nt, Artificial Sequence
  RNA Oligomer
gaaaucaacaaaagcuuug

SEQ ID NO: 4263 - RNA, 19 nt, Artificial Sequence
  RNA Oligomer
cuuuauaacuucaaccacg

SEQ ID NO: 4264 - RNA, 19 nt, Artificial Sequence
  RNA Oligomer
gaaauugggaguugauguc

SEQ ID NO: 4265 - RNA, 19 nt, Artificial Sequence
  RNA Oligomer
cuguucuucaaccuucugc

SEQ ID NO: 4266 - RNA, 19 nt, Artificial Sequence
  RNA Oligomer
augcuguuguuaauguuga

SEQ ID NO: 4267 - RNA, 19 nt, Artificial Sequence
  RNA Oligomer
aagugaccgugauuuuuuc

SEQ ID NO: 4268 - RNA, 19 nt, Artificial Sequence
  RNA Oligomer
cuuuccgcacuaauuucgc

SEQ ID NO: 4269 - RNA, 19 nt, Artificial Sequence
  RNA Oligomer
uuagggaggguuuuaugcu

SEQ ID NO: 4270 - RNA, 19 nt, Artificial Sequence
  RNA Oligomer
ucugaauuuuucuuuccuc

SEQ ID NO: 4271 - RNA, 19 nt, Artificial Sequence
  RNA Oligomer
uucuuuccuccuuaauuuc

SEQ ID NO: 4272 - RNA, 19 nt, Artificial Sequence
  RNA Oligomer
uccuuaauuucaucacuca

SEQ ID NO: 4273 - RNA, 19 nt, Artificial Sequence
  RNA Oligomer
aggucuucaagaaaaguaa

SEQ ID NO: 4274 - RNA, 19 nt, Artificial Sequence
  RNA Oligomer
gucuucaagaaaaguaaug

SEQ ID NO: 4275 - RNA, 19 nt, Artificial Sequence
  RNA Oligomer
gaaaaguaauguacuccug

SEQ ID NO: 4276 - RNA, 19 nt, Artificial Sequence
  RNA Oligomer
uucaucacucaggaaauca

SEQ ID NO: 4277 - RNA, 19 nt, Artificial Sequence
  RNA Oligomer
cagaugcaaaggacaaccc

SEQ ID NO: 4278 - RNA, 19 nt, Artificial Sequence
  RNA Oligomer
uauccuuccauucagacuc

SEQ ID NO: 4279 - RNA, 19 nt, Artificial Sequence
  RNA Oligomer
aagcuaacuucccugauag

SEQ ID NO: 4280 - RNA, 19 nt, Artificial Sequence
  RNA Oligomer
uguucuucaaccuucugcc

SEQ ID NO: 4281 - RNA, 19 nt, Artificial Sequence
  RNA Oligomer
uaauguugaaagugaccgu

SEQ ID NO: 4282 - RNA, 19 nt, Artificial Sequence
  RNA Oligomer
agugaccgugauuuuuucc

SEQ ID NO: 4283 - RNA, 19 nt, Artificial Sequence
  RNA Oligomer
uuccgcacuaauuucgcuu

SEQ ID NO: 4284 - RNA, 19 nt, Artificial Sequence
  RNA Oligomer
uccgcacuaauuucgcuuc

SEQ ID NO: 4285 - RNA, 19 nt, Artificial Sequence
  RNA Oligomer
uccuccuuaauuucaucac

SEQ ID NO: 4286 - RNA, 19 nt, Artificial Sequence
  RNA Oligomer
uacuggcucuugacaaaac

SEQ ID NO: 4287 - RNA, 19 nt, Artificial Sequence
  RNA Oligomer
gcucuugacaaaacucuug

SEQ ID NO: 4288 - RNA, 19 nt, Artificial Sequence
  RNA Oligomer
caagaaaaguaauguacuc

SEQ ID NO: 4289 - RNA, 19 nt, Artificial Sequence
  RNA Oligomer
uaguauccuuccauucaga

SEQ ID NO: 4290 - RNA, 19 nt, Artificial Sequence
  RNA Oligomer
uccuuccauucagacucgc

SEQ ID NO: 4291 - RNA, 19 nt, Artificial Sequence
  RNA Oligomer
ugaaagcuaacuucccuga

SEQ ID NO: 4292 - RNA, 19 nt, Artificial Sequence
  RNA Oligomer
gaagaugucacucucagcc

SEQ ID NO: 4293 - RNA, 19 nt, Artificial Sequence
  RNA Oligomer
cuucuugccaucaucauuc

SEQ ID NO: 4294 - RNA, 19 nt, Artificial Sequence
  RNA Oligomer
uugccaucaucauucuuua

SEQ ID NO: 4295 - RNA, 19 nt, Artificial Sequence
  RNA Oligomer
ucuuuauaacuucaaccac

SEQ ID NO: 4296 - RNA, 19 nt, Artificial Sequence
  RNA Oligomer
aacuucaaccacgaaauug

SEQ ID NO: 4297 - RNA, 19 nt, Artificial Sequence
  RNA Oligomer
acaaaagcuuugucuccgu

SEQ ID NO: 4298 - RNA, 19 nt, Artificial Sequence
  RNA Oligomer
aauguugaaagugaccgug

SEQ ID NO: 4299 - RNA, 19 nt, Artificial Sequence
  RNA Oligomer
gauaaucauuucaaagcac

SEQ ID NO: 4300 - RNA, 19 nt, Artificial Sequence
  RNA Oligomer
uuucaaagcacaugucuag

SEQ ID NO: 4301 - RNA, 19 nt, Artificial Sequence
  RNA Oligomer
cuccuuaauuucaucacuc

SEQ ID NO: 4302 - RNA, 19 nt, Artificial Sequence
  RNA Oligomer
aaaacucuugaggucuuca

SEQ ID NO: 4303 - RNA, 19 nt, Artificial Sequence
  RNA Oligomer
aaacucuugaggucuucaa

SEQ ID NO: 4304 - RNA, 19 nt, Artificial Sequence
  RNA Oligomer
ucaucugcaaaaguguugu

SEQ ID NO: 4305 - RNA, 19 nt, Artificial Sequence
  RNA Oligomer
uucccugauagagaagaug

SEQ ID NO: 4306 - RNA, 19 nt, Artificial Sequence
  RNA Oligomer
aacuuuccgcacuaauuuc

SEQ ID NO: 4307 - RNA, 19 nt, Artificial Sequence
  RNA Oligomer
ucuuuccuccuuaauuuca

SEQ ID NO: 4308 - RNA, 19 nt, Artificial Sequence
  RNA Oligomer
uuuccuccuuaauuucauc

SEQ ID NO: 4309 - RNA, 19 nt, Artificial Sequence
  RNA Oligomer
uuucaucacucaggaaauc

SEQ ID NO: 4310 - RNA, 19 nt, Artificial Sequence
  RNA Oligomer
cucaucugcaaaaguguug

SEQ ID NO: 4311 - RNA, 19 nt, Artificial Sequence
  RNA Oligomer
caucugcaaaaguguuguc

SEQ ID NO: 4312 - RNA, 19 nt, Artificial Sequence
  RNA Oligomer
aggaaucuguguugagugu

SEQ ID NO: 4313 - RNA, 19 nt, Artificial Sequence
  RNA Oligomer
cuuccauucagacucgcca

SEQ ID NO: 4314 - RNA, 19 nt, Artificial Sequence
  RNA Oligomer
uuccauucagacucgccag

SEQ ID NO: 4315 - RNA, 19 nt, Artificial Sequence
  RNA Oligomer
cugaaagcuaacuucccug

SEQ ID NO: 4316 - RNA, 19 nt, Artificial Sequence
  RNA Oligomer
caggaaaucaacaaaagcu

SEQ ID NO: 4317 - RNA, 19 nt, Artificial Sequence
  RNA Oligomer
uaacuucccugauagagaa

SEQ ID NO: 4318 - RNA, 19 nt, Artificial Sequence
  RNA Oligomer
augucacucucagccucgu

SEQ ID NO: 4319 - RNA, 19 nt, Artificial Sequence
  RNA Oligomer
cuccuguucuucaaccuuc

SEQ ID NO: 4320 - RNA, 19 nt, Artificial Sequence
  RNA Oligomer
uugaaagugaccgugauuu

SEQ ID NO: 4321 - RNA, 19 nt, Artificial Sequence
  RNA Oligomer
uucugucccauucaguucc

SEQ ID NO: 4322 - RNA, 19 nt, Artificial Sequence
  RNA Oligomer
uucaguuccagcucccaac

SEQ ID NO: 4323 - RNA, 19 nt, Artificial Sequence
  RNA Oligomer
augucuagcuucagaguag

SEQ ID NO: 4324 - RNA, 19 nt, Artificial Sequence
  RNA Oligomer
uggacugaaagcuaacuuc

SEQ ID NO: 4325 - RNA, 19 nt, Artificial Sequence
  RNA Oligomer
acugaaagcuaacuucccu

SEQ ID NO: 4326 - RNA, 19 nt, Artificial Sequence
  RNA Oligomer
gucuucuuguccaaccuca

SEQ ID NO: 4327 - RNA, 19 nt, Artificial Sequence
  RNA Oligomer
caaaagcuuugucuccguc

SEQ ID NO: 4328 - RNA, 19 nt, Artificial Sequence
  RNA Oligomer
uccuguucuucaaccuucu

SEQ ID NO: 4329 - RNA, 19 nt, Artificial Sequence
  RNA Oligomer
uccucaccaucaaauguug

SEQ ID NO: 4330 - RNA, 19 nt, Artificial Sequence
  RNA Oligomer
aucugucugcucuacuggc

SEQ ID NO: 4331 - RNA, 19 nt, Artificial Sequence
  RNA Oligomer
ggcaaggaaauccauuagg

SEQ ID NO: 4332 - RNA, 19 nt, Artificial Sequence
  RNA Oligomer
uccaaggaaucuguguuga

SEQ ID NO: 4333 - RNA, 19 nt, Artificial Sequence
  RNA Oligomer
aaggaaucuguguugagug

SEQ ID NO: 4334 - RNA, 19 nt, Artificial Sequence
  RNA Oligomer
aggaaaucaacaaaagcuu

SEQ ID NO: 4335 - RNA, 19 nt, Artificial Sequence
  RNA Oligomer
ucagccucgucuucuuguc

SEQ ID NO: 4336 - RNA, 19 nt, Artificial Sequence
  RNA Oligomer
agccucgucuucuugucca

SEQ ID NO: 4337 - RNA, 19 nt, Artificial Sequence
  RNA Oligomer
cucgucuucuuguccaacc

SEQ ID NO: 4338 - RNA, 19 nt, Artificial Sequence
  RNA Oligomer
gauaaugacaguccaacac

SEQ ID NO: 4339 - RNA, 19 nt, Artificial Sequence
  RNA Oligomer
aggcuccuguucuucaacc

SEQ ID NO: 4340 - RNA, 19 nt, Artificial Sequence
  RNA Oligomer
guucuucaaccuucugccc

SEQ ID NO: 4341 - RNA, 19 nt, Artificial Sequence
  RNA Oligomer
auguugaaagugaccguga

SEQ ID NO: 4342 - RNA, 19 nt, Artificial Sequence
  RNA Oligomer
cuucugaauuuuucuuucc

SEQ ID NO: 4343 - RNA, 19 nt, Artificial Sequence
  RNA Oligomer
ucauuucaaagcacauguc

SEQ ID NO: 4344 - RNA, 19 nt, Artificial Sequence
  RNA Oligomer
uucaaagcacaugucuagc

SEQ ID NO: 4345 - RNA, 19 nt, Artificial Sequence
  RNA Oligomer
caucugucugcucuacugg

SEQ ID NO: 4346 - RNA, 19 nt, Artificial Sequence
  RNA Oligomer
cugcaaaaguguuguccac

SEQ ID NO: 4347 - RNA, 19 nt, Artificial Sequence
  RNA Oligomer
gacugaaagcuaacuuccc

SEQ ID NO: 4348 - RNA, 19 nt, Artificial Sequence
  RNA Oligomer
uuguccaaccucauccucu

SEQ ID NO: 4349 - RNA, 19 nt, Artificial Sequence
  RNA Oligomer
augacaguccaacacaagg

SEQ ID NO: 4350 - RNA, 19 nt, Artificial Sequence
  RNA Oligomer
cuguuguuaauguugaaag

SEQ ID NO: 4351 - RNA, 19 nt, Artificial Sequence
  RNA Oligomer
auaaugacaguccaacaca

SEQ ID NO: 4352 - RNA, 19 nt, Artificial Sequence
  RNA Oligomer
aucaaauguuggugggaug

SEQ ID NO: 4353 - RNA, 19 nt, Artificial Sequence
  RNA Oligomer
ucaaauguuggugggaugc

SEQ ID NO: 4354 - RNA, 19 nt, Artificial Sequence
  RNA Oligomer
cauuucaaagcacaugucu

SEQ ID NO: 4355 - RNA, 19 nt, Artificial Sequence
  RNA Oligomer
uagcuucagaguaggauuu

SEQ ID NO: 4356 - RNA, 19 nt, Artificial Sequence
  RNA Oligomer
uucuuguccaaccucaucc

SEQ ID NO: 4357 - RNA, 19 nt, Artificial Sequence
  RNA Oligomer
aaggaaauccauuaggugg

SEQ ID NO: 4358 - RNA, 19 nt, Artificial Sequence
  RNA Oligomer
uagguggucauauaaggcc

SEQ ID NO: 4359 - RNA, 19 nt, Artificial Sequence
  RNA Oligomer
aucauuucaaagcacaugu

SEQ ID NO: 4360 - RNA, 19 nt, Artificial Sequence
  RNA Oligomer
uaggauuuguucacuggcc

SEQ ID NO: 4361 - RNA, 19 nt, Artificial Sequence
  RNA Oligomer
aaauccauuagguggucau

SEQ ID NO: 4362 - RNA, 19 nt, Artificial Sequence
  RNA Oligomer
gcuucugaauuuuucuuuc

SEQ ID NO: 4363 - RNA, 19 nt, Artificial Sequence
  RNA Oligomer
aauguacuccuggugcucc

SEQ ID NO: 4364 - RNA, 19 nt, Artificial Sequence
  RNA Oligomer
uuagguggucauauaaggc

SEQ ID NO: 4365 - RNA, 19 nt, Artificial Sequence
  RNA Oligomer
cucuggauaaugacagucc

SEQ ID NO: 4366 - RNA, 19 nt, Artificial Sequence
  RNA Oligomer
uucaaccacgaaauuggga

SEQ ID NO: 4367 - RNA, 19 nt, Artificial Sequence
  RNA Oligomer
ucaaccacgaaauugggag

SEQ ID NO: 4368 - RNA, 19 nt, Artificial Sequence
  RNA Oligomer
uugaugucaguucaggcuc

SEQ ID NO: 4369 - RNA, 19 nt, Artificial Sequence
  RNA Oligomer
aaucauuucaaagcacaug

SEQ ID NO: 4370 - RNA, 19 nt, Artificial Sequence
  RNA Oligomer
aguaggauuuguucacugg

SEQ ID NO: 4371 - RNA, 19 nt, Artificial Sequence
  RNA Oligomer
auggcuuucagcaucuguc

SEQ ID NO: 4372 - RNA, 19 nt, Artificial Sequence
  RNA Oligomer
cuugacaaaacucuugagg

SEQ ID NO: 4373 - RNA, 19 nt, Artificial Sequence
  RNA Oligomer
agguggucauauaaggccc

SEQ ID NO: 4374 - RNA, 19 nt, Artificial Sequence
  RNA Oligomer
aagaugucacucucagccu

SEQ ID NO: 4375 - RNA, 19 nt, Artificial Sequence
  RNA Oligomer
acuucaaccacgaaauugg

SEQ ID NO: 4376 - RNA, 19 nt, Artificial Sequence
  RNA Oligomer
uguuaauguugaaagugac

SEQ ID NO: 4377 - RNA, 19 nt, Artificial Sequence
  RNA Oligomer
auguacuccuggugcucca

SEQ ID NO: 4378 - RNA, 19 nt, Artificial Sequence
  RNA Oligomer
auagagaagaugucacucu

SEQ ID NO: 4379 - RNA, 19 nt, Artificial Sequence
  RNA Oligomer
uucuucaaccuucugcccu

SEQ ID NO: 4380 - RNA, 19 nt, Artificial Sequence
  RNA Oligomer
uucaaccuucugcccuugc

SEQ ID NO: 4381 - RNA, 19 nt, Artificial Sequence
  RNA Oligomer
augcaaaggacaacccagg

SEQ ID NO: 4382 - RNA, 19 nt, Artificial Sequence
  RNA Oligomer
uucagaguaggauuuguuc

SEQ ID NO: 4383 - RNA, 19 nt, Artificial Sequence
  RNA Oligomer
uuguucacuggccaaagcc

SEQ ID NO: 4384 - RNA, 19 nt, Artificial Sequence
  RNA Oligomer
acuauggcuuucagcaucu

SEQ ID NO: 4385 - RNA, 19 nt, Artificial Sequence
  RNA Oligomer
uauggcuuucagcaucugu

SEQ ID NO: 4386 - RNA, 19 nt, Artificial Sequence
  RNA Oligomer
uaauguacuccuggugcuc

SEQ ID NO: 4387 - RNA, 19 nt, Artificial Sequence
  RNA Oligomer
gaaauccauuaggugguca

SEQ ID NO: 4388 - RNA, 19 nt, Artificial Sequence
  RNA Oligomer
aaccacgaaauugggaguu

SEQ ID NO: 4389 - RNA, 19 nt, Artificial Sequence
  RNA Oligomer
aguugaugucaguucaggc

SEQ ID NO: 4390 - RNA, 19 nt, Artificial Sequence
  RNA Oligomer
ugaugucaguucaggcucc

SEQ ID NO: 4391 - RNA, 19 nt, Artificial Sequence
  RNA Oligomer
uucagcaucugucugcucu

SEQ ID NO: 4392 - RNA, 19 nt, Artificial Sequence
  RNA Oligomer
ucuugacaaaacucuugag

SEQ ID NO: 4393 - RNA, 19 nt, Artificial Sequence
  RNA Oligomer
aguaauguacuccuggugc

SEQ ID NO: 4394 - RNA, 19 nt, Artificial Sequence
  RNA Oligomer
aggaaauccauuagguggu

SEQ ID NO: 4395 - RNA, 19 nt, Artificial Sequence
  RNA Oligomer
auaaggcccaguccaagga

SEQ ID NO: 4396 - RNA, 19 nt, Artificial Sequence
  RNA Oligomer
ucuuguccaaccucauccu

SEQ ID NO: 4397 - RNA, 19 nt, Artificial Sequence
  RNA Oligomer
uucaggcuccuguucuuca

SEQ ID NO: 4398 - RNA, 19 nt, Artificial Sequence
  RNA Oligomer
guuaauguugaaagugacc

SEQ ID NO: 4399 - RNA, 19 nt, Artificial Sequence
  RNA Oligomer
ucugucccauucaguucca

SEQ ID NO: 4400 - RNA, 19 nt, Artificial Sequence
  RNA Oligomer
aaccuccagacaucuuagg

SEQ ID NO: 4401 - RNA, 19 nt, Artificial Sequence
  RNA Oligomer
uauaaggcccaguccaagg

SEQ ID NO: 4402 - RNA, 19 nt, Artificial Sequence
  RNA Oligomer
cugauagagaagaugucac

SEQ ID NO: 4403 - RNA, 19 nt, Artificial Sequence
  RNA Oligomer
cuucaaccacgaaauuggg

SEQ ID NO: 4404 - RNA, 19 nt, Artificial Sequence
  RNA Oligomer
ugucaguucaggcuccugu

SEQ ID NO: 4405 - RNA, 19 nt, Artificial Sequence
  RNA Oligomer
aucuuagggaggguuuuau

SEQ ID NO: 4406 - RNA, 19 nt, Artificial Sequence
  RNA Oligomer
gaguaggauuuguucacug

SEQ ID NO: 4407 - RNA, 19 nt, Artificial Sequence
  RNA Oligomer
guaggauuuguucacuggc

SEQ ID NO: 4408 - RNA, 19 nt, Artificial Sequence
  RNA Oligomer
gcaaaaguguuguccaccc

SEQ ID NO: 4409 - RNA, 19 nt, Artificial Sequence
  RNA Oligomer
ugauagagaagaugucacu

SEQ ID NO: 4410 - RNA, 19 nt, Artificial Sequence
  RNA Oligomer
uagagaagaugucacucuc

SEQ ID NO: 4411 - RNA, 19 nt, Artificial Sequence
  RNA Oligomer
auugggaguugaugucagu

SEQ ID NO: 4412 - RNA, 19 nt, Artificial Sequence
  RNA Oligomer
ugggaguugaugucaguuc

SEQ ID NO: 4413 - RNA, 19 nt, Artificial Sequence
  RNA Oligomer
guugaugucaguucaggcu

SEQ ID NO: 4414 - RNA, 19 nt, Artificial Sequence
  RNA Oligomer
uagggaggguuuuaugcuu

SEQ ID NO: 4415 - RNA, 19 nt, Artificial Sequence
  RNA Oligomer
agggaggguuuuaugcuuc

SEQ ID NO: 4416 - RNA, 19 nt, Artificial Sequence
  RNA Oligomer
cagaguaggauuuguucac

SEQ ID NO: 4417 - RNA, 19 nt, Artificial Sequence
  RNA Oligomer
aggauuuguucacuggcca

SEQ ID NO: 4418 - RNA, 19 nt, Artificial Sequence
  RNA Oligomer
gcuuucagcaucugucugc

SEQ ID NO: 4419 - RNA, 19 nt, Artificial Sequence
  RNA Oligomer
guaauguacuccuggugcu

SEQ ID NO: 4420 - RNA, 19 nt, Artificial Sequence
  RNA Oligomer
cucauccucuggauaauga

SEQ ID NO: 4421 - RNA, 19 nt, Artificial Sequence
  RNA Oligomer
auccucuggauaaugacag

SEQ ID NO: 4422 - RNA, 19 nt, Artificial Sequence
  RNA Oligomer
ugacaguccaacacaaggg

SEQ ID NO: 4423 - RNA, 19 nt, Artificial Sequence
  RNA Oligomer
gaguugaugucaguucagg

SEQ ID NO: 4424 - RNA, 19 nt, Artificial Sequence
  RNA Oligomer
caccaucaaauguuggugg

SEQ ID NO: 4425 - RNA, 19 nt, Artificial Sequence
  RNA Oligomer
accuccagacaucuuaggg

SEQ ID NO: 4426 - RNA, 19 nt, Artificial Sequence
  RNA Oligomer
gaggguuuuaugcuucuga

SEQ ID NO: 4427 - RNA, 19 nt, Artificial Sequence
  RNA Oligomer
agaguaggauuuguucacu

SEQ ID NO: 4428 - RNA, 19 nt, Artificial Sequence
  RNA Oligomer
uugaggucuucaagaaaag

SEQ ID NO: 4429 - RNA, 19 nt, Artificial Sequence
  RNA Oligomer
guggucauauaaggcccag

SEQ ID NO: 4430 - RNA, 19 nt, Artificial Sequence
  RNA Oligomer
gucauauaaggcccagucc

SEQ ID NO: 4431 - RNA, 19 nt, Artificial Sequence
  RNA Oligomer
aacacaagggccuucuugc

SEQ ID NO: 4432 - RNA, 19 nt, Artificial Sequence
  RNA Oligomer
accacgaaauugggaguug

SEQ ID NO: 4433 - RNA, 19 nt, Artificial Sequence
  RNA Oligomer
accaucaaauguugguggg

SEQ ID NO: 4434 - RNA, 19 nt, Artificial Sequence
  RNA Oligomer
ugucugcucuacuggcucu

SEQ ID NO: 4435 - RNA, 19 nt, Artificial Sequence
  RNA Oligomer
aauguuggugggaugcugu

SEQ ID NO: 4436 - RNA, 19 nt, Artificial Sequence
  RNA Oligomer
guccaaggaaucuguguug

SEQ ID NO: 4437 - RNA, 19 nt, Artificial Sequence
  RNA Oligomer
ucaccaucaaauguuggug

SEQ ID NO: 4438 - RNA, 19 nt, Artificial Sequence
  RNA Oligomer
cuccagacaucuuagggag

SEQ ID NO: 4439 - RNA, 19 nt, Artificial Sequence
  RNA Oligomer
cuuucagcaucugucugcu

SEQ ID NO: 4440 - RNA, 19 nt, Artificial Sequence
  RNA Oligomer
cagcucaucugcaaaagug

SEQ ID NO: 4441 - RNA, 19 nt, Artificial Sequence
  RNA Oligomer
ucuggauaaugacagucca

SEQ ID NO: 4442 - RNA, 19 nt, Artificial Sequence
  RNA Oligomer
uccaacacaagggccuucu

SEQ ID NO: 4443 - RNA, 19 nt, Artificial Sequence
  RNA Oligomer
cucaccaucaaauguuggu

SEQ ID NO: 4444 - RNA, 19 nt, Artificial Sequence
  RNA Oligomer
gagaagaugucacucucag

SEQ ID NO: 4445 - RNA, 19 nt, Artificial Sequence
  RNA Oligomer
aaauguuggugggaugcug

SEQ ID NO: 4446 - RNA, 19 nt, Artificial Sequence
  RNA Oligomer
uuucagcaucugucugcuc

SEQ ID NO: 4447 - RNA, 19 nt, Artificial Sequence
  RNA Oligomer
ucugucugcucuacuggcu

SEQ ID NO: 4448 - RNA, 19 nt, Artificial Sequence
  RNA Oligomer
ugucuagcuucagaguagg

SEQ ID NO: 4449 - RNA, 19 nt, Artificial Sequence
  RNA Oligomer
guuggugggaugcuguugu

SEQ ID NO: 4450 - RNA, 19 nt, Artificial Sequence
  RNA Oligomer
uuggugggaugcuguuguu

SEQ ID NO: 4451 - RNA, 19 nt, Artificial Sequence
  RNA Oligomer
uccaaccucauccucugga

SEQ ID NO: 4452 - RNA, 19 nt, Artificial Sequence
  RNA Oligomer
ggaaauccauuaggugguc

SEQ ID NO: 4453 - RNA, 19 nt, Artificial Sequence
  RNA Oligomer
ggaaaaaauacugcuggac

SEQ ID NO: 4454 - RNA, 19 nt, Artificial Sequence
  RNA Oligomer
agguugucuacuaaagaaa

SEQ ID NO: 4455 - RNA, 19 nt, Artificial Sequence
  RNA Oligomer
gccuuauauaucacacuau

SEQ ID NO: 4456 - RNA, 19 nt, Artificial Sequence
  RNA Oligomer
gagaaaaacagcucacagu

SEQ ID NO: 4457 - RNA, 19 nt, Artificial Sequence
  RNA Oligomer
uggaaaaaauacugcugga

SEQ ID NO: 4458 - RNA, 19 nt, Artificial Sequence
  RNA Oligomer
ggguuuguccaaaauaaau

SEQ ID NO: 4459 - RNA, 19 nt, Artificial Sequence
  RNA Oligomer
ggagacauggaaaaaauac

SEQ ID NO: 4460 - RNA, 19 nt, Artificial Sequence
  RNA Oligomer
gcauuggugaauuuaaucc

SEQ ID NO: 4461 - RNA, 19 nt, Artificial Sequence
  RNA Oligomer
cacucugcauuggugaauu

SEQ ID NO: 4462 - RNA, 19 nt, Artificial Sequence
  RNA Oligomer
gcguuccuaauuuaguaaa

SEQ ID NO: 4463 - RNA, 19 nt, Artificial Sequence
  RNA Oligomer
agacauggaaaaaauacug

SEQ ID NO: 4464 - RNA, 19 nt, Artificial Sequence
  RNA Oligomer
ugugugcuuuuaaaaucag

SEQ ID NO: 4465 - RNA, 19 nt, Artificial Sequence
  RNA Oligomer
ccgauuauuaggugaucac

SEQ ID NO: 4466 - RNA, 19 nt, Artificial Sequence
  RNA Oligomer
ccuuaauucagcugaagua

SEQ ID NO: 4467 - RNA, 19 nt, Artificial Sequence
  RNA Oligomer
acauggaaaaaauacugcu

SEQ ID NO: 4468 - RNA, 19 nt, Artificial Sequence
  RNA Oligomer
gagacauggaaaaaauacu

SEQ ID NO: 4469 - RNA, 19 nt, Artificial Sequence
  RNA Oligomer
uggagacauggaaaaaaua

SEQ ID NO: 4470 - RNA, 19 nt, Artificial Sequence
  RNA Oligomer
auggagacauggaaaaaau

SEQ ID NO: 4471 - RNA, 19 nt, Artificial Sequence
  RNA Oligomer
uccucuccuuuguguucaa

SEQ ID NO: 4472 - RNA, 19 nt, Artificial Sequence
  RNA Oligomer
ucugcauuggugaauuuaa

SEQ ID NO: 4473 - RNA, 19 nt, Artificial Sequence
  RNA Oligomer
cucugcauuggugaauuua

SEQ ID NO: 4474 - RNA, 19 nt, Artificial Sequence
  RNA Oligomer
caaacucagcuguacaguu

SEQ ID NO: 4475 - RNA, 19 nt, Artificial Sequence
  RNA Oligomer
cugugaaaauuugguagua

SEQ ID NO: 4476 - RNA, 19 nt, Artificial Sequence
  RNA Oligomer
accuccaccagcaccuuuu

SEQ ID NO: 4477 - RNA, 19 nt, Artificial Sequence
  RNA Oligomer
agccucgguuucuauuuau

SEQ ID NO: 4478 - RNA, 19 nt, Artificial Sequence
  RNA Oligomer
gaaagcaucuugaagaaaa

SEQ ID NO: 4479 - RNA, 19 nt, Artificial Sequence
  RNA Oligomer
gugaauuuaauccucuccu

SEQ ID NO: 4480 - RNA, 19 nt, Artificial Sequence
  RNA Oligomer
cguacacuaaacucuucuu

SEQ ID NO: 4481 - RNA, 19 nt, Artificial Sequence
  RNA Oligomer
cacacuauuguagaaagua

SEQ ID NO: 4482 - RNA, 19 nt, Artificial Sequence
  RNA Oligomer
cuacugugaaaauuuggua

SEQ ID NO: 4483 - RNA, 19 nt, Artificial Sequence
  RNA Oligomer
auaauggagacauggaaaa

SEQ ID NO: 4484 - RNA, 19 nt, Artificial Sequence
  RNA Oligomer
uuauaauggagacauggaa

SEQ ID NO: 4485 - RNA, 19 nt, Artificial Sequence
  RNA Oligomer
ccuggguagaacugcacuu

SEQ ID NO: 4486 - RNA, 19 nt, Artificial Sequence
  RNA Oligomer
cucagcuguacaguucgua

SEQ ID NO: 4487 - RNA, 19 nt, Artificial Sequence
  RNA Oligomer
ucauaaucaacagaaacca

SEQ ID NO: 4488 - RNA, 19 nt, Artificial Sequence
  RNA Oligomer
uccucuuuaaacacccgaa

SEQ ID NO: 4489 - RNA, 19 nt, Artificial Sequence
  RNA Oligomer
cugaaacagauacccauag

SEQ ID NO: 4490 - RNA, 19 nt, Artificial Sequence
  RNA Oligomer
gcaugucagacugauuaau

SEQ ID NO: 4491 - RNA, 19 nt, Artificial Sequence
  RNA Oligomer
ugcguuccuaauuuaguaa

SEQ ID NO: 4492 - RNA, 19 nt, Artificial Sequence
  RNA Oligomer
cugcguuccuaauuuagua

SEQ ID NO: 4493 - RNA, 19 nt, Artificial Sequence
  RNA Oligomer
cacugaagagcuguuagau

SEQ ID NO: 4494 - RNA, 19 nt, Artificial Sequence
  RNA Oligomer
cuugguucguuaguggauu

SEQ ID NO: 4495 - RNA, 19 nt, Artificial Sequence
  RNA Oligomer
ccucuccuuuguguucaac

SEQ ID NO: 4496 - RNA, 19 nt, Artificial Sequence
  RNA Oligomer
uggccuuauauaucacacu

SEQ ID NO: 4497 - RNA, 19 nt, Artificial Sequence
  RNA Oligomer
ugaagaaaaacucagauug

SEQ ID NO: 4498 - RNA, 19 nt, Artificial Sequence
  RNA Oligomer
gcaucuugaagaaaaacuc

SEQ ID NO: 4499 - RNA, 19 nt, Artificial Sequence
  RNA Oligomer
ugaaagcaucuugaagaaa

SEQ ID NO: 4500 - RNA, 19 nt, Artificial Sequence
  RNA Oligomer
uugaaagcaucuugaagaa

SEQ ID NO: 4501 - RNA, 19 nt, Artificial Sequence
  RNA Oligomer
aagaaggaaagaaguugaa

SEQ ID NO: 4502 - RNA, 19 nt, Artificial Sequence
  RNA Oligomer
gcuuuugcauuauaaggaa

SEQ ID NO: 4503 - RNA, 19 nt, Artificial Sequence
  RNA Oligomer
cacuaaacucuucuugcuu

SEQ ID NO: 4504 - RNA, 19 nt, Artificial Sequence
  RNA Oligomer
ucguacacuaaacucuucu

SEQ ID NO: 4505 - RNA, 19 nt, Artificial Sequence
  RNA Oligomer
aucaacagaaaccaagaua

SEQ ID NO: 4506 - RNA, 19 nt, Artificial Sequence
  RNA Oligomer
gggaucaauaagcauguca

SEQ ID NO: 4507 - RNA, 19 nt, Artificial Sequence
  RNA Oligomer
guucuguaaaugcugcguu

SEQ ID NO: 4508 - RNA, 19 nt, Artificial Sequence
  RNA Oligomer
cuggguagaacugcacuuc

SEQ ID NO: 4509 - RNA, 19 nt, Artificial Sequence
  RNA Oligomer
gaaagaaguugaaagcauc

SEQ ID NO: 4510 - RNA, 19 nt, Artificial Sequence
  RNA Oligomer
acuucagcaauaaugggaa

SEQ ID NO: 4511 - RNA, 19 nt, Artificial Sequence
  RNA Oligomer
agaaggaaagaaguugaaa

SEQ ID NO: 4512 - RNA, 19 nt, Artificial Sequence
  RNA Oligomer
caccacaagauaccaacag

SEQ ID NO: 4513 - RNA, 19 nt, Artificial Sequence
  RNA Oligomer
gaaaccaagauagagcuac

SEQ ID NO: 4514 - RNA, 19 nt, Artificial Sequence
  RNA Oligomer
agaaaccaagauagagcua

SEQ ID NO: 4515 - RNA, 19 nt, Artificial Sequence
  RNA Oligomer
acugugaaaauuugguagu

SEQ ID NO: 4516 - RNA, 19 nt, Artificial Sequence
  RNA Oligomer
ggaucaauaagcaugucag

SEQ ID NO: 4517 - RNA, 19 nt, Artificial Sequence
  RNA Oligomer
cgagcgucaugaagaaagg

SEQ ID NO: 4518 - RNA, 19 nt, Artificial Sequence
  RNA Oligomer
agaaguugaaagcaucuug

SEQ ID NO: 4519 - RNA, 19 nt, Artificial Sequence
  RNA Oligomer
gugcuuuuaaaaucagcuu

SEQ ID NO: 4520 - RNA, 19 nt, Artificial Sequence
  RNA Oligomer
cucuuuaucacucugcauu

SEQ ID NO: 4521 - RNA, 19 nt, Artificial Sequence
  RNA Oligomer
guggccuuauauaucacac

SEQ ID NO: 4522 - RNA, 19 nt, Artificial Sequence
  RNA Oligomer
cuagucaugauguguguug

SEQ ID NO: 4523 - RNA, 19 nt, Artificial Sequence
  RNA Oligomer
acugauuaaugucuacugu

SEQ ID NO: 4524 - RNA, 19 nt, Artificial Sequence
  RNA Oligomer
ucagcuuuauucuaagcaa

SEQ ID NO: 4525 - RNA, 19 nt, Artificial Sequence
  RNA Oligomer
cagaaaccaagauagagcu

SEQ ID NO: 4526 - RNA, 19 nt, Artificial Sequence
  RNA Oligomer
ucaugauguguguuguauu

SEQ ID NO: 4527 - RNA, 19 nt, Artificial Sequence
  RNA Oligomer
ucucucauuugcuggccau

SEQ ID NO: 4528 - RNA, 19 nt, Artificial Sequence
  RNA Oligomer
acgagcgucaugaagaaag

SEQ ID NO: 4529 - RNA, 19 nt, Artificial Sequence
  RNA Oligomer
agcaucuugaagaaaaacu

SEQ ID NO: 4530 - RNA, 19 nt, Artificial Sequence
  RNA Oligomer
aagaaguugaaagcaucuu

SEQ ID NO: 4531 - RNA, 19 nt, Artificial Sequence
  RNA Oligomer
aggaagaugauauugaaag

SEQ ID NO: 4532 - RNA, 19 nt, Artificial Sequence
  RNA Oligomer
ggagagaaaaacagcucac

SEQ ID NO: 4533 - RNA, 19 nt, Artificial Sequence
  RNA Oligomer
gcauuggagagaaaaacag

SEQ ID NO: 4534 - RNA, 19 nt, Artificial Sequence
  RNA Oligomer
cagcuuuauucuaagcaaa

SEQ ID NO: 4535 - RNA, 19 nt, Artificial Sequence
  RNA Oligomer
ugucuacugugaaaauuug

SEQ ID NO: 4536 - RNA, 19 nt, Artificial Sequence
  RNA Oligomer
agcaugucagacugauuaa

SEQ ID NO: 4537 - RNA, 19 nt, Artificial Sequence
  RNA Oligomer
ugggaucaauaagcauguc

SEQ ID NO: 4538 - RNA, 19 nt, Artificial Sequence
  RNA Oligomer
cucucucauuugcuggcca

SEQ ID NO: 4539 - RNA, 19 nt, Artificial Sequence
  RNA Oligomer
ccucuuuaucacucugcau

SEQ ID NO: 4540 - RNA, 19 nt, Artificial Sequence
  RNA Oligomer
aagcaugucagacugauua

SEQ ID NO: 4541 - RNA, 19 nt, Artificial Sequence
  RNA Oligomer
caauaagcaugucagacug

SEQ ID NO: 4542 - RNA, 19 nt, Artificial Sequence
  RNA Oligomer
cuaugggaucaauaagcau

SEQ ID NO: 4543 - RNA, 19 nt, Artificial Sequence
  RNA Oligomer
agaugauauugaaagaagg

SEQ ID NO: 4544 - RNA, 19 nt, Artificial Sequence
  RNA Oligomer
agucaugauguguguugua

SEQ ID NO: 4545 - RNA, 19 nt, Artificial Sequence
  RNA Oligomer
auaagcaugucagacugau

SEQ ID NO: 4546 - RNA, 19 nt, Artificial Sequence
  RNA Oligomer
cauauucucugcagaauuu

SEQ ID NO: 4547 - RNA, 19 nt, Artificial Sequence
  RNA Oligomer
gggcauauucucugcagaa

SEQ ID NO: 4548 - RNA, 19 nt, Artificial Sequence
  RNA Oligomer
uccucuuuaucacucugca

SEQ ID NO: 4549 - RNA, 19 nt, Artificial Sequence
  RNA Oligomer
ugcagaauuucugaaaguu

SEQ ID NO: 4550 - RNA, 19 nt, Artificial Sequence
  RNA Oligomer
ggcauauucucugcagaau

SEQ ID NO: 4551 - RNA, 19 nt, Artificial Sequence
  RNA Oligomer
ccaaggaguuccucuuuaa

SEQ ID NO: 4552 - RNA, 19 nt, Artificial Sequence
  RNA Oligomer
cccaaggaguuccucuuua

SEQ ID NO: 4553 - RNA, 19 nt, Artificial Sequence
  RNA Oligomer
gagagaaaaacagcucaca

SEQ ID NO: 4554 - RNA, 19 nt, Artificial Sequence
  RNA Oligomer
aaggaauuaagucuccgau

SEQ ID NO: 4555 - RNA, 19 nt, Artificial Sequence
  RNA Oligomer
cugcagaauuucugaaagu

SEQ ID NO: 4556 - RNA, 19 nt, Artificial Sequence
  RNA Oligomer
gcauauucucugcagaauu

SEQ ID NO: 4557 - RNA, 19 nt, Artificial Sequence
  RNA Oligomer
cagcucacagucugaggaa

SEQ ID NO: 4558 - RNA, 19 nt, Artificial Sequence
  RNA Oligomer
acagcucacagucugagga

SEQ ID NO: 4559 - RNA, 19 nt, Artificial Sequence
  RNA Oligomer
cuaaacucuucuugcuuuu

SEQ ID NO: 4560 - RNA, 19 nt, Artificial Sequence
  RNA Oligomer
ucaacagaaaccaagauag

SEQ ID NO: 4561 - RNA, 19 nt, Artificial Sequence
  RNA Oligomer
agacacuaaaaucauguug

SEQ ID NO: 4562 - RNA, 19 nt, Artificial Sequence
  RNA Oligomer
gcagaauuucugaaaguuu

SEQ ID NO: 4563 - RNA, 19 nt, Artificial Sequence
  RNA Oligomer
cuccgauuauuaggugauc

SEQ ID NO: 4564 - RNA, 19 nt, Artificial Sequence
  RNA Oligomer
cuucuugcuuuugcauuau

SEQ ID NO: 4565 - RNA, 19 nt, Artificial Sequence
  RNA Oligomer
caaaauaaauauuguggcc

SEQ ID NO: 4566 - RNA, 19 nt, Artificial Sequence
  RNA Oligomer
gaagagcuguuagauccug

SEQ ID NO: 4567 - RNA, 19 nt, Artificial Sequence
  RNA Oligomer
caagauaccaacagggcuu

SEQ ID NO: 4568 - RNA, 19 nt, Artificial Sequence
  RNA Oligomer
caagagcucucacugugac

SEQ ID NO: 4569 - RNA, 19 nt, Artificial Sequence
  RNA Oligomer
ccaagagcucucacuguga

SEQ ID NO: 4570 - RNA, 19 nt, Artificial Sequence
  RNA Oligomer
ucuucuugcuuuugcauua

SEQ ID NO: 4571 - RNA, 19 nt, Artificial Sequence
  RNA Oligomer
guacaguucguacacuaaa

SEQ ID NO: 4572 - RNA, 19 nt, Artificial Sequence
  RNA Oligomer
cugaaaguuuuccuuccau

SEQ ID NO: 4573 - RNA, 19 nt, Artificial Sequence
  RNA Oligomer
ucucugcagaauuucugaa

SEQ ID NO: 4574 - RNA, 19 nt, Artificial Sequence
  RNA Oligomer
cccauagcauuggagagaa

SEQ ID NO: 4575 - RNA, 19 nt, Artificial Sequence
  RNA Oligomer
gcuuuauucuaagcaaauc

SEQ ID NO: 4576 - RNA, 19 nt, Artificial Sequence
  RNA Oligomer
cccuggaugaucaguuuuc

SEQ ID NO: 4577 - RNA, 19 nt, Artificial Sequence
  RNA Oligomer
ucacccuggaugaucaguu

SEQ ID NO: 4578 - RNA, 19 nt, Artificial Sequence
  RNA Oligomer
aggaauuaagucuccgauu

SEQ ID NO: 4579 - RNA, 19 nt, Artificial Sequence
  RNA Oligomer
ugcagguugucuacuaaag

SEQ ID NO: 4580 - RNA, 19 nt, Artificial Sequence
  RNA Oligomer
caaccuuaauucagcugaa

SEQ ID NO: 4581 - RNA, 19 nt, Artificial Sequence
  RNA Oligomer
cucugcugcucucucauuu

SEQ ID NO: 4582 - RNA, 19 nt, Artificial Sequence
  RNA Oligomer
cucugcagaauuucugaaa

SEQ ID NO: 4583 - RNA, 19 nt, Artificial Sequence
  RNA Oligomer
ccaacagggcuucugaaac

SEQ ID NO: 4584 - RNA, 19 nt, Artificial Sequence
  RNA Oligomer
accaacagggcuucugaaa

SEQ ID NO: 4585 - RNA, 19 nt, Artificial Sequence
  RNA Oligomer
ucacucugcauuggugaau

SEQ ID NO: 4586 - RNA, 19 nt, Artificial Sequence
  RNA Oligomer
cucuucuugcuuuugcauu

SEQ ID NO: 4587 - RNA, 19 nt, Artificial Sequence
  RNA Oligomer
guagcuccaagagcucuca

SEQ ID NO: 4588 - RNA, 19 nt, Artificial Sequence
  RNA Oligomer
gcuguacaguucguacacu

SEQ ID NO: 4589 - RNA, 19 nt, Artificial Sequence
  RNA Oligomer
gccacgucacuuguguuua

SEQ ID NO: 4590 - RNA, 19 nt, Artificial Sequence
  RNA Oligomer
ucugcagaauuucugaaag

SEQ ID NO: 4591 - RNA, 19 nt, Artificial Sequence
  RNA Oligomer
agcaaaucugugucuacuu

SEQ ID NO: 4592 - RNA, 19 nt, Artificial Sequence
  RNA Oligomer
ggaugaucaguuuucugcu

SEQ ID NO: 4593 - RNA, 19 nt, Artificial Sequence
  RNA Oligomer
uccaagagcucucacugug

SEQ ID NO: 4594 - RNA, 19 nt, Artificial Sequence
  RNA Oligomer
acaguucguacacuaaacu

SEQ ID NO: 4595 - RNA, 19 nt, Artificial Sequence
  RNA Oligomer
uucagcugaaguacuuuau

SEQ ID NO: 4596 - RNA, 19 nt, Artificial Sequence
  RNA Oligomer
gcaaccuuaauucagcuga

SEQ ID NO: 4597 - RNA, 19 nt, Artificial Sequence
  RNA Oligomer
gacacuaaaaucauguuga

SEQ ID NO: 4598 - RNA, 19 nt, Artificial Sequence
  RNA Oligomer
gcucacugaagagcuguua

SEQ ID NO: 4599 - RNA, 19 nt, Artificial Sequence
  RNA Oligomer
gcaacauagcucacugaag

SEQ ID NO: 4600 - RNA, 19 nt, Artificial Sequence
  RNA Oligomer
gcuugcaacauagcucacu

SEQ ID NO: 4601 - RNA, 19 nt, Artificial Sequence
  RNA Oligomer
cuugaagaaaaacucagau

SEQ ID NO: 4602 - RNA, 19 nt, Artificial Sequence
  RNA Oligomer
uggagagaaaaacagcuca

SEQ ID NO: 4603 - RNA, 19 nt, Artificial Sequence
  RNA Oligomer
ugaucaguuuucugcugaa

SEQ ID NO: 4604 - RNA, 19 nt, Artificial Sequence
  RNA Oligomer
cuguacaguucguacacua

SEQ ID NO: 4605 - RNA, 19 nt, Artificial Sequence
  RNA Oligomer
ugaaaguuuuccuuccauc

SEQ ID NO: 4606 - RNA, 19 nt, Artificial Sequence
  RNA Oligomer
ugaggaacacgagcgucau

SEQ ID NO: 4607 - RNA, 19 nt, Artificial Sequence
  RNA Oligomer
ggaguuccucuuuaaacac

SEQ ID NO: 4608 - RNA, 19 nt, Artificial Sequence
  RNA Oligomer
uggugaauuuaauccucuc

SEQ ID NO: 4609 - RNA, 19 nt, Artificial Sequence
  RNA Oligomer
uccgauuauuaggugauca

SEQ ID NO: 4610 - RNA, 19 nt, Artificial Sequence
  RNA Oligomer
ucuccgauuauuaggugau

SEQ ID NO: 4611 - RNA, 19 nt, Artificial Sequence
  RNA Oligomer
ugcaacauagcucacugaa

SEQ ID NO: 4612 - RNA, 19 nt, Artificial Sequence
  RNA Oligomer
uccaccagcaccuuuugau

SEQ ID NO: 4613 - RNA, 19 nt, Artificial Sequence
  RNA Oligomer
acccuggaugaucaguuuu

SEQ ID NO: 4614 - RNA, 19 nt, Artificial Sequence
  RNA Oligomer
ucagacugauuaaugucua

SEQ ID NO: 4615 - RNA, 19 nt, Artificial Sequence
  RNA Oligomer
ucugaaaguuuuccuucca

SEQ ID NO: 4616 - RNA, 19 nt, Artificial Sequence
  RNA Oligomer
ccagccucgguuucuauuu

SEQ ID NO: 4617 - RNA, 19 nt, Artificial Sequence
  RNA Oligomer
ccucuuuaaacacccgaag

SEQ ID NO: 4618 - RNA, 19 nt, Artificial Sequence
  RNA Oligomer
ugaucacccuggaugauca

SEQ ID NO: 4619 - RNA, 19 nt, Artificial Sequence
  RNA Oligomer
gucuccgauuauuagguga

SEQ ID NO: 4620 - RNA, 19 nt, Artificial Sequence
  RNA Oligomer
uaauucagcugaaguacuu

SEQ ID NO: 4621 - RNA, 19 nt, Artificial Sequence
  RNA Oligomer
gcugcucucucauuugcug

SEQ ID NO: 4622 - RNA, 19 nt, Artificial Sequence
  RNA Oligomer
agauacccauagcauugga

SEQ ID NO: 4623 - RNA, 19 nt, Artificial Sequence
  RNA Oligomer
aacugcacuucagcaauaa

SEQ ID NO: 4624 - RNA, 19 nt, Artificial Sequence
  RNA Oligomer
agacaccacaagauaccaa

SEQ ID NO: 4625 - RNA, 19 nt, Artificial Sequence
  RNA Oligomer
ggugaauuuaauccucucc

SEQ ID NO: 4626 - RNA, 19 nt, Artificial Sequence
  RNA Oligomer
gcagacaccacaagauacc

SEQ ID NO: 4627 - RNA, 19 nt, Artificial Sequence
  RNA Oligomer
gaaggcaccuacucaguau

SEQ ID NO: 4628 - RNA, 19 nt, Artificial Sequence
  RNA Oligomer
ccuggaugaucaguuuucu

SEQ ID NO: 4629 - RNA, 19 nt, Artificial Sequence
  RNA Oligomer
ggugaucacccuggaugau

SEQ ID NO: 4630 - RNA, 19 nt, Artificial Sequence
  RNA Oligomer
cagcuguacaguucguaca

SEQ ID NO: 4631 - RNA, 19 nt, Artificial Sequence
  RNA Oligomer
cugcaaccuuaauucagcu

SEQ ID NO: 4632 - RNA, 19 nt, Artificial Sequence
  RNA Oligomer
gacugauuaaugucuacug

SEQ ID NO: 4633 - RNA, 19 nt, Artificial Sequence
  RNA Oligomer
ccaccagcaccuuuugaug

SEQ ID NO: 4634 - RNA, 19 nt, Artificial Sequence
  RNA Oligomer
cugcacuucagcaauaaug

SEQ ID NO: 4635 - RNA, 19 nt, Artificial Sequence
  RNA Oligomer
acccauagcauuggagaga

SEQ ID NO: 4636 - RNA, 19 nt, Artificial Sequence
  RNA Oligomer
agaacugcacuucagcaau

SEQ ID NO: 4637 - RNA, 19 nt, Artificial Sequence
  RNA Oligomer
ccacaagauaccaacaggg

SEQ ID NO: 4638 - RNA, 19 nt, Artificial Sequence
  RNA Oligomer
cucgcagacaccacaagau

SEQ ID NO: 4639 - RNA, 19 nt, Artificial Sequence
  RNA Oligomer
ugcaaccuuaauucagcug

SEQ ID NO: 4640 - RNA, 19 nt, Artificial Sequence
  RNA Oligomer
agacugauuaaugucuacu

SEQ ID NO: 4641 - RNA, 19 nt, Artificial Sequence
  RNA Oligomer
caaggaguuccucuuuaaa

SEQ ID NO: 4642 - RNA, 19 nt, Artificial Sequence
  RNA Oligomer
cagacugauuaaugucuac

SEQ ID NO: 4643 - RNA, 19 nt, Artificial Sequence
  RNA Oligomer
aggaguuccucuuuaaaca

SEQ ID NO: 4644 - RNA, 19 nt, Artificial Sequence
  RNA Oligomer
cgcagacaccacaagauac

SEQ ID NO: 4645 - RNA, 19 nt, Artificial Sequence
  RNA Oligomer
ucaguuuucugcugaaggc

SEQ ID NO: 4646 - RNA, 19 nt, Artificial Sequence
  RNA Oligomer
gagcuugcaacauagcuca

SEQ ID NO: 4647 - RNA, 19 nt, Artificial Sequence
  RNA Oligomer
agggcuucugaaacagaua

SEQ ID NO: 4648 - RNA, 19 nt, Artificial Sequence
  RNA Oligomer
ugaaggcaccuacucagua

SEQ ID NO: 4649 - RNA, 19 nt, Artificial Sequence
  RNA Oligomer
ugagcuugcaacauagcuc

SEQ ID NO: 4650 - RNA, 19 nt, Artificial Sequence
  RNA Oligomer
gucagacugauuaaugucu

SEQ ID NO: 4651 - RNA, 19 nt, Artificial Sequence
  RNA Oligomer
gggcuucugaaacagauac

SEQ ID NO: 4652 - RNA, 19 nt, Artificial Sequence
  RNA Oligomer
ugcuuuugcauuauaagga

SEQ ID NO: 4653 - RNA, 19 nt, Artificial Sequence
  RNA Oligomer
ccaaaauaaauauuguggc

SEQ ID NO: 4654 - RNA, 19 nt, Artificial Sequence
  RNA Oligomer
cagggcuucugaaacagau

SEQ ID NO: 4655 - RNA, 19 nt, Artificial Sequence
  RNA Oligomer
agcucacugaagagcuguu

SEQ ID NO: 4656 - RNA, 19 nt, Artificial Sequence
  RNA Oligomer
ggcuucugaaacagauacc

SEQ ID NO: 4657 - RNA, 19 nt, Artificial Sequence
  RNA Oligomer
agcuccaagagcucucacu

SEQ ID NO: 4658 - RNA, 19 nt, Artificial Sequence
  RNA Oligomer
gacauggaaaaaauacugc

SEQ ID NO: 4659 - RNA, 19 nt, Artificial Sequence
  RNA Oligomer
acccucagcaugaggaaca

SEQ ID NO: 4660 - RNA, 19 nt, Artificial Sequence
  RNA Oligomer
guccagcaguauuuuuucc

SEQ ID NO: 4661 - RNA, 19 nt, Artificial Sequence
  RNA Oligomer
uuucuuuaguagacaaccu

SEQ ID NO: 4662 - RNA, 19 nt, Artificial Sequence
  RNA Oligomer
auagugugauauauaaggc

SEQ ID NO: 4663 - RNA, 19 nt, Artificial Sequence
  RNA Oligomer
acugugagcuguuuuucuc

SEQ ID NO: 4664 - RNA, 19 nt, Artificial Sequence
  RNA Oligomer
uccagcaguauuuuuucca

SEQ ID NO: 4665 - RNA, 19 nt, Artificial Sequence
  RNA Oligomer
auuuauuuuggacaaaccc

SEQ ID NO: 4666 - RNA, 19 nt, Artificial Sequence
  RNA Oligomer
guauuuuuuccaugucucc

SEQ ID NO: 4667 - RNA, 19 nt, Artificial Sequence
  RNA Oligomer
ggauuaaauucaccaaugc

SEQ ID NO: 4668 - RNA, 19 nt, Artificial Sequence
  RNA Oligomer
aauucaccaaugcagagug

SEQ ID NO: 4669 - RNA, 19 nt, Artificial Sequence
  RNA Oligomer
uuuacuaaauuaggaacgc

SEQ ID NO: 4670 - RNA, 19 nt, Artificial Sequence
  RNA Oligomer
caguauuuuuuccaugucu

SEQ ID NO: 4671 - RNA, 19 nt, Artificial Sequence
  RNA Oligomer
cugauuuuaaaagcacaca

SEQ ID NO: 4672 - RNA, 19 nt, Artificial Sequence
  RNA Oligomer
gugaucaccuaauaaucgg

SEQ ID NO: 4673 - RNA, 19 nt, Artificial Sequence
  RNA Oligomer
uacuucagcugaauuaagg

SEQ ID NO: 4674 - RNA, 19 nt, Artificial Sequence
  RNA Oligomer
agcaguauuuuuuccaugu

SEQ ID NO: 4675 - RNA, 19 nt, Artificial Sequence
  RNA Oligomer
aguauuuuuuccaugucuc

SEQ ID NO: 4676 - RNA, 19 nt, Artificial Sequence
  RNA Oligomer
uauuuuuuccaugucucca

SEQ ID NO: 4677 - RNA, 19 nt, Artificial Sequence
  RNA Oligomer
auuuuuuccaugucuccau

SEQ ID NO: 4678 - RNA, 19 nt, Artificial Sequence
  RNA Oligomer
uugaacacaaaggagagga

SEQ ID NO: 4679 - RNA, 19 nt, Artificial Sequence
  RNA Oligomer
uuaaauucaccaaugcaga

SEQ ID NO: 4680 - RNA, 19 nt, Artificial Sequence
  RNA Oligomer
uaaauucaccaaugcagag

SEQ ID NO: 4681 - RNA, 19 nt, Artificial Sequence
  RNA Oligomer
aacuguacagcugaguuug

SEQ ID NO: 4682 - RNA, 19 nt, Artificial Sequence
  RNA Oligomer
uacuaccaaauuuucacag

SEQ ID NO: 4683 - RNA, 19 nt, Artificial Sequence
  RNA Oligomer
aaaaggugcugguggaggu

SEQ ID NO: 4684 - RNA, 19 nt, Artificial Sequence
  RNA Oligomer
auaaauagaaaccgaggcu

SEQ ID NO: 4685 - RNA, 19 nt, Artificial Sequence
  RNA Oligomer
uuuucuucaagaugcuuuc

SEQ ID NO: 4686 - RNA, 19 nt, Artificial Sequence
  RNA Oligomer
aggagaggauuaaauucac

SEQ ID NO: 4687 - RNA, 19 nt, Artificial Sequence
  RNA Oligomer
aagaagaguuuaguguacg

SEQ ID NO: 4688 - RNA, 19 nt, Artificial Sequence
  RNA Oligomer
uacuuucuacaauagugug

SEQ ID NO: 4689 - RNA, 19 nt, Artificial Sequence
  RNA Oligomer
uaccaaauuuucacaguag

SEQ ID NO: 4690 - RNA, 19 nt, Artificial Sequence
  RNA Oligomer
uuuuccaugucuccauuau

SEQ ID NO: 4691 - RNA, 19 nt, Artificial Sequence
  RNA Oligomer
uuccaugucuccauuauaa

SEQ ID NO: 4692 - RNA, 19 nt, Artificial Sequence
  RNA Oligomer
aagugcaguucuacccagg

SEQ ID NO: 4693 - RNA, 19 nt, Artificial Sequence
  RNA Oligomer
uacgaacuguacagcugag

SEQ ID NO: 4694 - RNA, 19 nt, Artificial Sequence
  RNA Oligomer
ugguuucuguugauuauga

SEQ ID NO: 4695 - RNA, 19 nt, Artificial Sequence
  RNA Oligomer
uucggguguuuaaagagga

SEQ ID NO: 4696 - RNA, 19 nt, Artificial Sequence
  RNA Oligomer
cuauggguaucuguuucag

SEQ ID NO: 4697 - RNA, 19 nt, Artificial Sequence
  RNA Oligomer
auuaaucagucugacaugc

SEQ ID NO: 4698 - RNA, 19 nt, Artificial Sequence
  RNA Oligomer
uuacuaaauuaggaacgca

SEQ ID NO: 4699 - RNA, 19 nt, Artificial Sequence
  RNA Oligomer
uacuaaauuaggaacgcag

SEQ ID NO: 4700 - RNA, 19 nt, Artificial Sequence
  RNA Oligomer
aucuaacagcucuucagug

SEQ ID NO: 4701 - RNA, 19 nt, Artificial Sequence
  RNA Oligomer
aauccacuaacgaaccaag

SEQ ID NO: 4702 - RNA, 19 nt, Artificial Sequence
  RNA Oligomer
guugaacacaaaggagagg

SEQ ID NO: 4703 - RNA, 19 nt, Artificial Sequence
  RNA Oligomer
agugugauauauaaggcca

SEQ ID NO: 4704 - RNA, 19 nt, Artificial Sequence
  RNA Oligomer
caaucugaguuuuucuuca

SEQ ID NO: 4705 - RNA, 19 nt, Artificial Sequence
  RNA Oligomer
gaguuuuucuucaagaugc

SEQ ID NO: 4706 - RNA, 19 nt, Artificial Sequence
  RNA Oligomer
uuucuucaagaugcuuuca

SEQ ID NO: 4707 - RNA, 19 nt, Artificial Sequence
  RNA Oligomer
uucuucaagaugcuuucaa

SEQ ID NO: 4708 - RNA, 19 nt, Artificial Sequence
  RNA Oligomer
uucaacuucuuuccuucuu

SEQ ID NO: 4709 - RNA, 19 nt, Artificial Sequence
  RNA Oligomer
uuccuuauaaugcaaaagc

SEQ ID NO: 4710 - RNA, 19 nt, Artificial Sequence
  RNA Oligomer
aagcaagaagaguuuagug

SEQ ID NO: 4711 - RNA, 19 nt, Artificial Sequence
  RNA Oligomer
agaagaguuuaguguacga

SEQ ID NO: 4712 - RNA, 19 nt, Artificial Sequence
  RNA Oligomer
uaucuugguuucuguugau

SEQ ID NO: 4713 - RNA, 19 nt, Artificial Sequence
  RNA Oligomer
ugacaugcuuauugauccc

SEQ ID NO: 4714 - RNA, 19 nt, Artificial Sequence
  RNA Oligomer
aacgcagcauuuacagaac

SEQ ID NO: 4715 - RNA, 19 nt, Artificial Sequence
  RNA Oligomer
gaagugcaguucuacccag

SEQ ID NO: 4716 - RNA, 19 nt, Artificial Sequence
  RNA Oligomer
gaugcuuucaacuucuuuc

SEQ ID NO: 4717 - RNA, 19 nt, Artificial Sequence
  RNA Oligomer
uucccauuauugcugaagu

SEQ ID NO: 4718 - RNA, 19 nt, Artificial Sequence
  RNA Oligomer
uuucaacuucuuuccuucu

SEQ ID NO: 4719 - RNA, 19 nt, Artificial Sequence
  RNA Oligomer
cuguugguaucuuguggug

SEQ ID NO: 4720 - RNA, 19 nt, Artificial Sequence
  RNA Oligomer
guagcucuaucuugguuuc

SEQ ID NO: 4721 - RNA, 19 nt, Artificial Sequence
  RNA Oligomer
uagcucuaucuugguuucu

SEQ ID NO: 4722 - RNA, 19 nt, Artificial Sequence
  RNA Oligomer
acuaccaaauuuucacagu

SEQ ID NO: 4723 - RNA, 19 nt, Artificial Sequence
  RNA Oligomer
cugacaugcuuauugaucc

SEQ ID NO: 4724 - RNA, 19 nt, Artificial Sequence
  RNA Oligomer
ccuuucuucaugacgcucg

SEQ ID NO: 4725 - RNA, 19 nt, Artificial Sequence
  RNA Oligomer
caagaugcuuucaacuucu

SEQ ID NO: 4726 - RNA, 19 nt, Artificial Sequence
  RNA Oligomer
aagcugauuuuaaaagcac

SEQ ID NO: 4727 - RNA, 19 nt, Artificial Sequence
  RNA Oligomer
aaugcagagugauaaagag

SEQ ID NO: 4728 - RNA, 19 nt, Artificial Sequence
  RNA Oligomer
gugugauauauaaggccac

SEQ ID NO: 4729 - RNA, 19 nt, Artificial Sequence
  RNA Oligomer
caacacacaucaugacuag

SEQ ID NO: 4730 - RNA, 19 nt, Artificial Sequence
  RNA Oligomer
acaguagacauuaaucagu

SEQ ID NO: 4731 - RNA, 19 nt, Artificial Sequence
  RNA Oligomer
uugcuuagaauaaagcuga

SEQ ID NO: 4732 - RNA, 19 nt, Artificial Sequence
  RNA Oligomer
agcucuaucuugguuucug

SEQ ID NO: 4733 - RNA, 19 nt, Artificial Sequence
  RNA Oligomer
aauacaacacacaucauga

SEQ ID NO: 4734 - RNA, 19 nt, Artificial Sequence
  RNA Oligomer
auggccagcaaaugagaga

SEQ ID NO: 4735 - RNA, 19 nt, Artificial Sequence
  RNA Oligomer
cuuucuucaugacgcucgu

SEQ ID NO: 4736 - RNA, 19 nt, Artificial Sequence
  RNA Oligomer
aguuuuucuucaagaugcu

SEQ ID NO: 4737 - RNA, 19 nt, Artificial Sequence
  RNA Oligomer
aagaugcuuucaacuucuu

SEQ ID NO: 4738 - RNA, 19 nt, Artificial Sequence
  RNA Oligomer
cuuucaauaucaucuuccu

SEQ ID NO: 4739 - RNA, 19 nt, Artificial Sequence
  RNA Oligomer
gugagcuguuuuucucucc

SEQ ID NO: 4740 - RNA, 19 nt, Artificial Sequence
  RNA Oligomer
cuguuuuucucuccaaugc

SEQ ID NO: 4741 - RNA, 19 nt, Artificial Sequence
  RNA Oligomer
uuugcuuagaauaaagcug

SEQ ID NO: 4742 - RNA, 19 nt, Artificial Sequence
  RNA Oligomer
caaauuuucacaguagaca

SEQ ID NO: 4743 - RNA, 19 nt, Artificial Sequence
  RNA Oligomer
uuaaucagucugacaugcu

SEQ ID NO: 4744 - RNA, 19 nt, Artificial Sequence
  RNA Oligomer
gacaugcuuauugauccca

SEQ ID NO: 4745 - RNA, 19 nt, Artificial Sequence
  RNA Oligomer
uggccagcaaaugagagag

SEQ ID NO: 4746 - RNA, 19 nt, Artificial Sequence
  RNA Oligomer
augcagagugauaaagagg

SEQ ID NO: 4747 - RNA, 19 nt, Artificial Sequence
  RNA Oligomer
uaaucagucugacaugcuu

SEQ ID NO: 4748 - RNA, 19 nt, Artificial Sequence
  RNA Oligomer
cagucugacaugcuuauug

SEQ ID NO: 4749 - RNA, 19 nt, Artificial Sequence
  RNA Oligomer
augcuuauugaucccauag

SEQ ID NO: 4750 - RNA, 19 nt, Artificial Sequence
  RNA Oligomer
ccuucuuucaauaucaucu

SEQ ID NO: 4751 - RNA, 19 nt, Artificial Sequence
  RNA Oligomer
uacaacacacaucaugacu

SEQ ID NO: 4752 - RNA, 19 nt, Artificial Sequence
  RNA Oligomer
aucagucugacaugcuuau

SEQ ID NO: 4753 - RNA, 19 nt, Artificial Sequence
  RNA Oligomer
aaauucugcagagaauaug

SEQ ID NO: 4754 - RNA, 19 nt, Artificial Sequence
  RNA Oligomer
uucugcagagaauaugccc

SEQ ID NO: 4755 - RNA, 19 nt, Artificial Sequence
  RNA Oligomer
ugcagagugauaaagagga

SEQ ID NO: 4756 - RNA, 19 nt, Artificial Sequence
  RNA Oligomer
aacuuucagaaauucugca

SEQ ID NO: 4757 - RNA, 19 nt, Artificial Sequence
  RNA Oligomer
auucugcagagaauaugcc

SEQ ID NO: 4758 - RNA, 19 nt, Artificial Sequence
  RNA Oligomer
uuaaagaggaacuccuugg

SEQ ID NO: 4759 - RNA, 19 nt, Artificial Sequence
  RNA Oligomer
uaaagaggaacuccuuggg

SEQ ID NO: 4760 - RNA, 19 nt, Artificial Sequence
  RNA Oligomer
ugugagcuguuuuucucuc

SEQ ID NO: 4761 - RNA, 19 nt, Artificial Sequence
  RNA Oligomer
aucggagacuuaauuccuu

SEQ ID NO: 4762 - RNA, 19 nt, Artificial Sequence
  RNA Oligomer
acuuucagaaauucugcag

SEQ ID NO: 4763 - RNA, 19 nt, Artificial Sequence
  RNA Oligomer
aauucugcagagaauaugc

SEQ ID NO: 4764 - RNA, 19 nt, Artificial Sequence
  RNA Oligomer
uuccucagacugugagcug

SEQ ID NO: 4765 - RNA, 19 nt, Artificial Sequence
  RNA Oligomer
uccucagacugugagcugu

SEQ ID NO: 4766 - RNA, 19 nt, Artificial Sequence
  RNA Oligomer
aaaagcaagaagaguuuag

SEQ ID NO: 4767 - RNA, 19 nt, Artificial Sequence
  RNA Oligomer
cuaucuugguuucuguuga

SEQ ID NO: 4768 - RNA, 19 nt, Artificial Sequence
  RNA Oligomer
caacaugauuuuagugucu

SEQ ID NO: 4769 - RNA, 19 nt, Artificial Sequence
  RNA Oligomer
aaacuuucagaaauucugc

SEQ ID NO: 4770 - RNA, 19 nt, Artificial Sequence
  RNA Oligomer
gaucaccuaauaaucggag

SEQ ID NO: 4771 - RNA, 19 nt, Artificial Sequence
  RNA Oligomer
auaaugcaaaagcaagaag

SEQ ID NO: 4772 - RNA, 19 nt, Artificial Sequence
  RNA Oligomer
ggccacaauauuuauuuug

SEQ ID NO: 4773 - RNA, 19 nt, Artificial Sequence
  RNA Oligomer
caggaucuaacagcucuuc

SEQ ID NO: 4774 - RNA, 19 nt, Artificial Sequence
  RNA Oligomer
aagcccuguugguaucuug

SEQ ID NO: 4775 - RNA, 19 nt, Artificial Sequence
  RNA Oligomer
gucacagugagagcucuug

SEQ ID NO: 4776 - RNA, 19 nt, Artificial Sequence
  RNA Oligomer
ucacagugagagcucuugg

SEQ ID NO: 4777 - RNA, 19 nt, Artificial Sequence
  RNA Oligomer
uaaugcaaaagcaagaaga

SEQ ID NO: 4778 - RNA, 19 nt, Artificial Sequence
  RNA Oligomer
uuuaguguacgaacuguac

SEQ ID NO: 4779 - RNA, 19 nt, Artificial Sequence
  RNA Oligomer
auggaaggaaaacuuucag

SEQ ID NO: 4780 - RNA, 19 nt, Artificial Sequence
  RNA Oligomer
uucagaaauucugcagaga

SEQ ID NO: 4781 - RNA, 19 nt, Artificial Sequence
  RNA Oligomer
uucucuccaaugcuauggg

SEQ ID NO: 4782 - RNA, 19 nt, Artificial Sequence
  RNA Oligomer
gauuugcuuagaauaaagc

SEQ ID NO: 4783 - RNA, 19 nt, Artificial Sequence
  RNA Oligomer
gaaaacugaucauccaggg

SEQ ID NO: 4784 - RNA, 19 nt, Artificial Sequence
  RNA Oligomer
aacugaucauccaggguga

SEQ ID NO: 4785 - RNA, 19 nt, Artificial Sequence
  RNA Oligomer
aaucggagacuuaauuccu

SEQ ID NO: 4786 - RNA, 19 nt, Artificial Sequence
  RNA Oligomer
cuuuaguagacaaccugca

SEQ ID NO: 4787 - RNA, 19 nt, Artificial Sequence
  RNA Oligomer
uucagcugaauuaagguug

SEQ ID NO: 4788 - RNA, 19 nt, Artificial Sequence
  RNA Oligomer
aaaugagagagcagcagag

SEQ ID NO: 4789 - RNA, 19 nt, Artificial Sequence
  RNA Oligomer
uuucagaaauucugcagag

SEQ ID NO: 4790 - RNA, 19 nt, Artificial Sequence
  RNA Oligomer
guuucagaagcccuguugg

SEQ ID NO: 4791 - RNA, 19 nt, Artificial Sequence
  RNA Oligomer
uuucagaagcccuguuggu

SEQ ID NO: 4792 - RNA, 19 nt, Artificial Sequence
  RNA Oligomer
auucaccaaugcagaguga

SEQ ID NO: 4793 - RNA, 19 nt, Artificial Sequence
  RNA Oligomer
aaugcaaaagcaagaagag

SEQ ID NO: 4794 - RNA, 19 nt, Artificial Sequence
  RNA Oligomer
ugagagcucuuggagcuac

SEQ ID NO: 4795 - RNA, 19 nt, Artificial Sequence
  RNA Oligomer
aguguacgaacuguacagc

SEQ ID NO: 4796 - RNA, 19 nt, Artificial Sequence
  RNA Oligomer
uaaacacaagugacguggc

SEQ ID NO: 4797 - RNA, 19 nt, Artificial Sequence
  RNA Oligomer
cuuucagaaauucugcaga

SEQ ID NO: 4798 - RNA, 19 nt, Artificial Sequence
  RNA Oligomer
aaguagacacagauuugcu

SEQ ID NO: 4799 - RNA, 19 nt, Artificial Sequence
  RNA Oligomer
agcagaaaacugaucaucc

SEQ ID NO: 4800 - RNA, 19 nt, Artificial Sequence
  RNA Oligomer
cacagugagagcucuugga

SEQ ID NO: 4801 - RNA, 19 nt, Artificial Sequence
  RNA Oligomer
aguuuaguguacgaacugu

SEQ ID NO: 4802 - RNA, 19 nt, Artificial Sequence
  RNA Oligomer
auaaaguacuucagcugaa

SEQ ID NO: 4803 - RNA, 19 nt, Artificial Sequence
  RNA Oligomer
ucagcugaauuaagguugc

SEQ ID NO: 4804 - RNA, 19 nt, Artificial Sequence
  RNA Oligomer
ucaacaugauuuuaguguc

SEQ ID NO: 4805 - RNA, 19 nt, Artificial Sequence
  RNA Oligomer
uaacagcucuucagugagc

SEQ ID NO: 4806 - RNA, 19 nt, Artificial Sequence
  RNA Oligomer
cuucagugagcuauguugc

SEQ ID NO: 4807 - RNA, 19 nt, Artificial Sequence
  RNA Oligomer
agugagcuauguugcaagc

SEQ ID NO: 4808 - RNA, 19 nt, Artificial Sequence
  RNA Oligomer
aucugaguuuuucuucaag

SEQ ID NO: 4809 - RNA, 19 nt, Artificial Sequence
  RNA Oligomer
ugagcuguuuuucucucca

SEQ ID NO: 4810 - RNA, 19 nt, Artificial Sequence
  RNA Oligomer
uucagcagaaaacugauca

SEQ ID NO: 4811 - RNA, 19 nt, Artificial Sequence
  RNA Oligomer
uaguguacgaacuguacag

SEQ ID NO: 4812 - RNA, 19 nt, Artificial Sequence
  RNA Oligomer
gauggaaggaaaacuuuca

SEQ ID NO: 4813 - RNA, 19 nt, Artificial Sequence
  RNA Oligomer
augacgcucguguuccuca

SEQ ID NO: 4814 - RNA, 19 nt, Artificial Sequence
  RNA Oligomer
guguuuaaagaggaacucc

SEQ ID NO: 4815 - RNA, 19 nt, Artificial Sequence
  RNA Oligomer
gagaggauuaaauucacca

SEQ ID NO: 4816 - RNA, 19 nt, Artificial Sequence
  RNA Oligomer
ugaucaccuaauaaucgga

SEQ ID NO: 4817 - RNA, 19 nt, Artificial Sequence
  RNA Oligomer
aucaccuaauaaucggaga

SEQ ID NO: 4818 - RNA, 19 nt, Artificial Sequence
  RNA Oligomer
uucagugagcuauguugca

SEQ ID NO: 4819 - RNA, 19 nt, Artificial Sequence
  RNA Oligomer
aucaaaaggugcuggugga

SEQ ID NO: 4820 - RNA, 19 nt, Artificial Sequence
  RNA Oligomer
aaaacugaucauccagggu

SEQ ID NO: 4821 - RNA, 19 nt, Artificial Sequence
  RNA Oligomer
uagacauuaaucagucuga

SEQ ID NO: 4822 - RNA, 19 nt, Artificial Sequence
  RNA Oligomer
uggaaggaaaacuuucaga

SEQ ID NO: 4823 - RNA, 19 nt, Artificial Sequence
  RNA Oligomer
aaauagaaaccgaggcugg

SEQ ID NO: 4824 - RNA, 19 nt, Artificial Sequence
  RNA Oligomer
cuucggguguuuaaagagg

SEQ ID NO: 4825 - RNA, 19 nt, Artificial Sequence
  RNA Oligomer
ugaucauccagggugauca

SEQ ID NO: 4826 - RNA, 19 nt, Artificial Sequence
  RNA Oligomer
ucaccuaauaaucggagac

SEQ ID NO: 4827 - RNA, 19 nt, Artificial Sequence
  RNA Oligomer
aaguacuucagcugaauua

SEQ ID NO: 4828 - RNA, 19 nt, Artificial Sequence
  RNA Oligomer
cagcaaaugagagagcagc

SEQ ID NO: 4829 - RNA, 19 nt, Artificial Sequence
  RNA Oligomer
uccaaugcuauggguaucu

SEQ ID NO: 4830 - RNA, 19 nt, Artificial Sequence
  RNA Oligomer
uuauugcugaagugcaguu

SEQ ID NO: 4831 - RNA, 19 nt, Artificial Sequence
  RNA Oligomer
uugguaucuuguggugucu

SEQ ID NO: 4832 - RNA, 19 nt, Artificial Sequence
  RNA Oligomer
ggagaggauuaaauucacc

SEQ ID NO: 4833 - RNA, 19 nt, Artificial Sequence
  RNA Oligomer
gguaucuuguggugucugc

SEQ ID NO: 4834 - RNA, 19 nt, Artificial Sequence
  RNA Oligomer
auacugaguaggugccuuc

SEQ ID NO: 4835 - RNA, 19 nt, Artificial Sequence
  RNA Oligomer
agaaaacugaucauccagg

SEQ ID NO: 4836 - RNA, 19 nt, Artificial Sequence
  RNA Oligomer
aucauccagggugaucacc

SEQ ID NO: 4837 - RNA, 19 nt, Artificial Sequence
  RNA Oligomer
uguacgaacuguacagcug

SEQ ID NO: 4838 - RNA, 19 nt, Artificial Sequence
  RNA Oligomer
agcugaauuaagguugcag

SEQ ID NO: 4839 - RNA, 19 nt, Artificial Sequence
  RNA Oligomer
caguagacauuaaucaguc

SEQ ID NO: 4840 - RNA, 19 nt, Artificial Sequence
  RNA Oligomer
caucaaaaggugcuggugg

SEQ ID NO: 4841 - RNA, 19 nt, Artificial Sequence
  RNA Oligomer
cauuauugcugaagugcag

SEQ ID NO: 4842 - RNA, 19 nt, Artificial Sequence
  RNA Oligomer
ucucuccaaugcuaugggu

SEQ ID NO: 4843 - RNA, 19 nt, Artificial Sequence
  RNA Oligomer
auugcugaagugcaguucu

SEQ ID NO: 4844 - RNA, 19 nt, Artificial Sequence
  RNA Oligomer
cccuguugguaucuugugg

SEQ ID NO: 4845 - RNA, 19 nt, Artificial Sequence
  RNA Oligomer
aucuuguggugucugcgag

SEQ ID NO: 4846 - RNA, 19 nt, Artificial Sequence
  RNA Oligomer
cagcugaauuaagguugca

SEQ ID NO: 4847 - RNA, 19 nt, Artificial Sequence
  RNA Oligomer
aguagacauuaaucagucu

SEQ ID NO: 4848 - RNA, 19 nt, Artificial Sequence
  RNA Oligomer
uuuaaagaggaacuccuug

SEQ ID NO: 4849 - RNA, 19 nt, Artificial Sequence
  RNA Oligomer
guagacauuaaucagucug

SEQ ID NO: 4850 - RNA, 19 nt, Artificial Sequence
  RNA Oligomer
uguuuaaagaggaacuccu

SEQ ID NO: 4851 - RNA, 19 nt, Artificial Sequence
  RNA Oligomer
guaucuuguggugucugcg

SEQ ID NO: 4852 - RNA, 19 nt, Artificial Sequence
  RNA Oligomer
gccuucagcagaaaacuga

SEQ ID NO: 4853 - RNA, 19 nt, Artificial Sequence
  RNA Oligomer
ugagcuauguugcaagcuc

SEQ ID NO: 4854 - RNA, 19 nt, Artificial Sequence
  RNA Oligomer
uaucuguuucagaagcccu

SEQ ID NO: 4855 - RNA, 19 nt, Artificial Sequence
  RNA Oligomer
uacugaguaggugccuuca

SEQ ID NO: 4856 - RNA, 19 nt, Artificial Sequence
  RNA Oligomer
gagcuauguugcaagcuca

SEQ ID NO: 4857 - RNA, 19 nt, Artificial Sequence
  RNA Oligomer
agacauuaaucagucugac

SEQ ID NO: 4858 - RNA, 19 nt, Artificial Sequence
  RNA Oligomer
guaucuguuucagaagccc

SEQ ID NO: 4859 - RNA, 19 nt, Artificial Sequence
  RNA Oligomer
uccuuauaaugcaaaagca

SEQ ID NO: 4860 - RNA, 19 nt, Artificial Sequence
  RNA Oligomer
gccacaauauuuauuuugg

SEQ ID NO: 4861 - RNA, 19 nt, Artificial Sequence
  RNA Oligomer
aucuguuucagaagcccug

SEQ ID NO: 4862 - RNA, 19 nt, Artificial Sequence
  RNA Oligomer
aacagcucuucagugagcu

SEQ ID NO: 4863 - RNA, 19 nt, Artificial Sequence
  RNA Oligomer
gguaucuguuucagaagcc

SEQ ID NO: 4864 - RNA, 19 nt, Artificial Sequence
  RNA Oligomer
agugagagcucuuggagcu

SEQ ID NO: 4865 - RNA, 19 nt, Artificial Sequence
  RNA Oligomer
gcaguauuuuuuccauguc

SEQ ID NO: 4866 - RNA, 19 nt, Artificial Sequence
  RNA Oligomer
uguuccucaugcugagggu

SEQ ID NO: 4867 - RNA, 19 nt, Artificial Sequence
  RNA Oligomer
ggagauucuacauucacag

SEQ ID NO: 4868 - RNA, 19 nt, Artificial Sequence
  RNA Oligomer
acaacaaacuuaaagccag

SEQ ID NO: 4869 - RNA, 19 nt, Artificial Sequence
  RNA Oligomer
ccugaauucaugaagaaac

SEQ ID NO: 4870 - RNA, 19 nt, Artificial Sequence
  RNA Oligomer
accuaaauaugcuggauau

SEQ ID NO: 4871 - RNA, 19 nt, Artificial Sequence
  RNA Oligomer
gcaaucaagaagcuaagcc

SEQ ID NO: 4872 - RNA, 19 nt, Artificial Sequence
  RNA Oligomer
cgguuagucauugauagaa

SEQ ID NO: 4873 - RNA, 19 nt, Artificial Sequence
  RNA Oligomer
gcaucuaaaaggaucucug

SEQ ID NO: 4874 - RNA, 19 nt, Artificial Sequence
  RNA Oligomer
uccugaauucaugaagaaa

SEQ ID NO: 4875 - RNA, 19 nt, Artificial Sequence
  RNA Oligomer
agauuggagauucuacauu

SEQ ID NO: 4876 - RNA, 19 nt, Artificial Sequence
  RNA Oligomer
gaauuauucaucgggacuu

SEQ ID NO: 4877 - RNA, 19 nt, Artificial Sequence
  RNA Oligomer
ucacaccacagaaaucccu

SEQ ID NO: 4878 - RNA, 19 nt, Artificial Sequence
  RNA Oligomer
ggagcucaaggaauaguau

SEQ ID NO: 4879 - RNA, 19 nt, Artificial Sequence
  RNA Oligomer
guacaucaaugucugguau

SEQ ID NO: 4880 - RNA, 19 nt, Artificial Sequence
  RNA Oligomer
cucagaacacaacaaacuu

SEQ ID NO: 4881 - RNA, 19 nt, Artificial Sequence
  RNA Oligomer
cugacucagaacacaacaa

SEQ ID NO: 4882 - RNA, 19 nt, Artificial Sequence
  RNA Oligomer
agaccuaaauaugcuggau

SEQ ID NO: 4883 - RNA, 19 nt, Artificial Sequence
  RNA Oligomer
uggagauucuacauucaca

SEQ ID NO: 4884 - RNA, 19 nt, Artificial Sequence
  RNA Oligomer
agcuagaucaugaaagaau

SEQ ID NO: 4885 - RNA, 19 nt, Artificial Sequence
  RNA Oligomer
gucuuauuuuugggugauu

SEQ ID NO: 4886 - RNA, 19 nt, Artificial Sequence
  RNA Oligomer
ggucuuauuuuugggugau

SEQ ID NO: 4887 - RNA, 19 nt, Artificial Sequence
  RNA Oligomer
agaguggaaagaauugaua

SEQ ID NO: 4888 - RNA, 19 nt, Artificial Sequence
  RNA Oligomer
aggagcucaaggaauagua

SEQ ID NO: 4889 - RNA, 19 nt, Artificial Sequence
  RNA Oligomer
gcaguuagaugaaagggaa

SEQ ID NO: 4890 - RNA, 19 nt, Artificial Sequence
  RNA Oligomer
cguacaucaaugucuggua

SEQ ID NO: 4891 - RNA, 19 nt, Artificial Sequence
  RNA Oligomer
ccaacacccguacaucaau

SEQ ID NO: 4892 - RNA, 19 nt, Artificial Sequence
  RNA Oligomer
caccauguccugaauucau

SEQ ID NO: 4893 - RNA, 19 nt, Artificial Sequence
  RNA Oligomer
agauucuacauucacaguc

SEQ ID NO: 4894 - RNA, 19 nt, Artificial Sequence
  RNA Oligomer
cccaguaauauaguaguaa

SEQ ID NO: 4895 - RNA, 19 nt, Artificial Sequence
  RNA Oligomer
gcaccuucauucugcugga

SEQ ID NO: 4896 - RNA, 19 nt, Artificial Sequence
  RNA Oligomer
caagaagcuaagccgacca

SEQ ID NO: 4897 - RNA, 19 nt, Artificial Sequence
  RNA Oligomer
gucaaugaugugucuucaa

SEQ ID NO: 4898 - RNA, 19 nt, Artificial Sequence
  RNA Oligomer
ggaacacacaauagaagag

SEQ ID NO: 4899 - RNA, 19 nt, Artificial Sequence
  RNA Oligomer
ccagucaggcaagggauuu

SEQ ID NO: 4900 - RNA, 19 nt, Artificial Sequence
  RNA Oligomer
ccagcugacucagaacaca

SEQ ID NO: 4901 - RNA, 19 nt, Artificial Sequence
  RNA Oligomer
guaaaaucugauugcacuu

SEQ ID NO: 4902 - RNA, 19 nt, Artificial Sequence
  RNA Oligomer
guaguaaaaucugauugca

SEQ ID NO: 4903 - RNA, 19 nt, Artificial Sequence
  RNA Oligomer
ccauuucagaaucagacuc

SEQ ID NO: 4904 - RNA, 19 nt, Artificial Sequence
  RNA Oligomer
acaguccugaaacgauauc

SEQ ID NO: 4905 - RNA, 19 nt, Artificial Sequence
  RNA Oligomer
ccuaaauaugcuggauaua

SEQ ID NO: 4906 - RNA, 19 nt, Artificial Sequence
  RNA Oligomer
guugaaaacagaccuaaau

SEQ ID NO: 4907 - RNA, 19 nt, Artificial Sequence
  RNA Oligomer
ugaagaaacugcaaccaac

SEQ ID NO: 4908 - RNA, 19 nt, Artificial Sequence
  RNA Oligomer
gcaugggcuacaaggaaaa

SEQ ID NO: 4909 - RNA, 19 nt, Artificial Sequence
  RNA Oligomer
ggaauuauucaucgggacu

SEQ ID NO: 4910 - RNA, 19 nt, Artificial Sequence
  RNA Oligomer
caccuucauucugcuggaa

SEQ ID NO: 4911 - RNA, 19 nt, Artificial Sequence
  RNA Oligomer
aagaagcuaagccgaccau

SEQ ID NO: 4912 - RNA, 19 nt, Artificial Sequence
  RNA Oligomer
gguuagucauugauagaac

SEQ ID NO: 4913 - RNA, 19 nt, Artificial Sequence
  RNA Oligomer
cugucaaugaugugucuuc

SEQ ID NO: 4914 - RNA, 19 nt, Artificial Sequence
  RNA Oligomer
cucuccaacacccguacau

SEQ ID NO: 4915 - RNA, 19 nt, Artificial Sequence
  RNA Oligomer
cuaaaaggaucucuguaga

SEQ ID NO: 4916 - RNA, 19 nt, Artificial Sequence
  RNA Oligomer
ugcaucuaaaaggaucucu

SEQ ID NO: 4917 - RNA, 19 nt, Artificial Sequence
  RNA Oligomer
uggauauagcuuugagaaa

SEQ ID NO: 4918 - RNA, 19 nt, Artificial Sequence
  RNA Oligomer
guuuuaugaugacgccuua

SEQ ID NO: 4919 - RNA, 19 nt, Artificial Sequence
  RNA Oligomer
cgaguuuuaugaugacgcc

SEQ ID NO: 4920 - RNA, 19 nt, Artificial Sequence
  RNA Oligomer
gaacgaguuuuaugaugac

SEQ ID NO: 4921 - RNA, 19 nt, Artificial Sequence
  RNA Oligomer
gagauuggagauucuacau

SEQ ID NO: 4922 - RNA, 19 nt, Artificial Sequence
  RNA Oligomer
gcaggaacgaguuuuauga

SEQ ID NO: 4923 - RNA, 19 nt, Artificial Sequence
  RNA Oligomer
agagauuggagauucuaca

SEQ ID NO: 4924 - RNA, 19 nt, Artificial Sequence
  RNA Oligomer
gcacuuugaagauucuuga

SEQ ID NO: 4925 - RNA, 19 nt, Artificial Sequence
  RNA Oligomer
agcgugacaacaauuuuua

SEQ ID NO: 4926 - RNA, 19 nt, Artificial Sequence
  RNA Oligomer
cuaguucuuaugaaaugug

SEQ ID NO: 4927 - RNA, 19 nt, Artificial Sequence
  RNA Oligomer
agcuaguucuuaugaaaug

SEQ ID NO: 4928 - RNA, 19 nt, Artificial Sequence
  RNA Oligomer
agaagcuaagccgaccauu

SEQ ID NO: 4929 - RNA, 19 nt, Artificial Sequence
  RNA Oligomer
gucauugauagaacuacuu

SEQ ID NO: 4930 - RNA, 19 nt, Artificial Sequence
  RNA Oligomer
aggaauaguaugcgcagcu

SEQ ID NO: 4931 - RNA, 19 nt, Artificial Sequence
  RNA Oligomer
ucaaggaauaguaugcgca

SEQ ID NO: 4932 - RNA, 19 nt, Artificial Sequence
  RNA Oligomer
gcagcagugaucaauggcu

SEQ ID NO: 4933 - RNA, 19 nt, Artificial Sequence
  RNA Oligomer
gaguggaaagaauugauau

SEQ ID NO: 4934 - RNA, 19 nt, Artificial Sequence
  RNA Oligomer
caauagaagaguggaaaga

SEQ ID NO: 4935 - RNA, 19 nt, Artificial Sequence
  RNA Oligomer
caggagcucaaggaauagu

SEQ ID NO: 4936 - RNA, 19 nt, Artificial Sequence
  RNA Oligomer
gcugguaauagaugcaucu

SEQ ID NO: 4937 - RNA, 19 nt, Artificial Sequence
  RNA Oligomer
cacaguccugaaacgauau

SEQ ID NO: 4938 - RNA, 19 nt, Artificial Sequence
  RNA Oligomer
cguugaaaacagaccuaaa

SEQ ID NO: 4939 - RNA, 19 nt, Artificial Sequence
  RNA Oligomer
aaaucugauugcacuuuga

SEQ ID NO: 4940 - RNA, 19 nt, Artificial Sequence
  RNA Oligomer
aaaaucugauugcacuuug

SEQ ID NO: 4941 - RNA, 19 nt, Artificial Sequence
  RNA Oligomer
uggaauuauucaucgggac

SEQ ID NO: 4942 - RNA, 19 nt, Artificial Sequence
  RNA Oligomer
cuggaauuauucaucggga

SEQ ID NO: 4943 - RNA, 19 nt, Artificial Sequence
  RNA Oligomer
guccuaccuucucuaucag

SEQ ID NO: 4944 - RNA, 19 nt, Artificial Sequence
  RNA Oligomer
gcgugacaacaauuuuuau

SEQ ID NO: 4945 - RNA, 19 nt, Artificial Sequence
  RNA Oligomer
ucaugaaagaauguccuac

SEQ ID NO: 4946 - RNA, 19 nt, Artificial Sequence
  RNA Oligomer
cuagaucaugaaagaaugu

SEQ ID NO: 4947 - RNA, 19 nt, Artificial Sequence
  RNA Oligomer
gagcuagaucaugaaagaa

SEQ ID NO: 4948 - RNA, 19 nt, Artificial Sequence
  RNA Oligomer
gcuaguucuuaugaaaugu

SEQ ID NO: 4949 - RNA, 19 nt, Artificial Sequence
  RNA Oligomer
uggucuuauuuuuggguga

SEQ ID NO: 4950 - RNA, 19 nt, Artificial Sequence
  RNA Oligomer
gucgguuagucauugauag

SEQ ID NO: 4951 - RNA, 19 nt, Artificial Sequence
  RNA Oligomer
gagucgguuagucauugau

SEQ ID NO: 4952 - RNA, 19 nt, Artificial Sequence
  RNA Oligomer
gucuucaaugucaacagau

SEQ ID NO: 4953 - RNA, 19 nt, Artificial Sequence
  RNA Oligomer
gaugugucuucaaugucaa

SEQ ID NO: 4954 - RNA, 19 nt, Artificial Sequence
  RNA Oligomer
gucugucaaugaugugucu

SEQ ID NO: 4955 - RNA, 19 nt, Artificial Sequence
  RNA Oligomer
cgucugucaaugauguguc

SEQ ID NO: 4956 - RNA, 19 nt, Artificial Sequence
  RNA Oligomer
cacccguacaucaaugucu

SEQ ID NO: 4957 - RNA, 19 nt, Artificial Sequence
  RNA Oligomer
agaugcaucuaaaaggauc

SEQ ID NO: 4958 - RNA, 19 nt, Artificial Sequence
  RNA Oligomer
cagcugacucagaacacaa

SEQ ID NO: 4959 - RNA, 19 nt, Artificial Sequence
  RNA Oligomer
caguccugaaacgauauca

SEQ ID NO: 4960 - RNA, 19 nt, Artificial Sequence
  RNA Oligomer
cuggauauagcuuugagaa

SEQ ID NO: 4961 - RNA, 19 nt, Artificial Sequence
  RNA Oligomer
cagaccuaaauaugcugga

SEQ ID NO: 4962 - RNA, 19 nt, Artificial Sequence
  RNA Oligomer
aguuuuaugaugacgccuu

SEQ ID NO: 4963 - RNA, 19 nt, Artificial Sequence
  RNA Oligomer
guagagauuggagauucua

SEQ ID NO: 4964 - RNA, 19 nt, Artificial Sequence
  RNA Oligomer
aguguagagauuggagauu

SEQ ID NO: 4965 - RNA, 19 nt, Artificial Sequence
  RNA Oligomer
accuucauucugcuggaau

SEQ ID NO: 4966 - RNA, 19 nt, Artificial Sequence
  RNA Oligomer
uggagcuagaucaugaaag

SEQ ID NO: 4967 - RNA, 19 nt, Artificial Sequence
  RNA Oligomer
acauagucauggagcucau

SEQ ID NO: 4968 - RNA, 19 nt, Artificial Sequence
  RNA Oligomer
uuggccuuuugaauguuuu

SEQ ID NO: 4969 - RNA, 19 nt, Artificial Sequence
  RNA Oligomer
gaccauuucagaaucagac

SEQ ID NO: 4970 - RNA, 19 nt, Artificial Sequence
  RNA Oligomer
ugaugccauucuugaaaga

SEQ ID NO: 4971 - RNA, 19 nt, Artificial Sequence
  RNA Oligomer
guggucuuauuuuugggug

SEQ ID NO: 4972 - RNA, 19 nt, Artificial Sequence
  RNA Oligomer
gaaaacaauucaguggucu

SEQ ID NO: 4973 - RNA, 19 nt, Artificial Sequence
  RNA Oligomer
cgucgucugucaaugaugu

SEQ ID NO: 4974 - RNA, 19 nt, Artificial Sequence
  RNA Oligomer
cagcauccaucaucaucgu

SEQ ID NO: 4975 - RNA, 19 nt, Artificial Sequence
  RNA Oligomer
gcagugaucaauggcucuc

SEQ ID NO: 4976 - RNA, 19 nt, Artificial Sequence
  RNA Oligomer
agggaacacacaauagaag

SEQ ID NO: 4977 - RNA, 19 nt, Artificial Sequence
  RNA Oligomer
acccguacaucaaugucug

SEQ ID NO: 4978 - RNA, 19 nt, Artificial Sequence
  RNA Oligomer
caaaaugcugguaauagau

SEQ ID NO: 4979 - RNA, 19 nt, Artificial Sequence
  RNA Oligomer
aggcaagggauuuguuauc

SEQ ID NO: 4980 - RNA, 19 nt, Artificial Sequence
  RNA Oligomer
gucaggcaagggauuuguu

SEQ ID NO: 4981 - RNA, 19 nt, Artificial Sequence
  RNA Oligomer
guaaggacuuacguugaaa

SEQ ID NO: 4982 - RNA, 19 nt, Artificial Sequence
  RNA Oligomer
cuuugaagauucuugacuu

SEQ ID NO: 4983 - RNA, 19 nt, Artificial Sequence
  RNA Oligomer
cugauugcacuuugaagau

SEQ ID NO: 4984 - RNA, 19 nt, Artificial Sequence
  RNA Oligomer
ucaguggucuuauuuuugg

SEQ ID NO: 4985 - RNA, 19 nt, Artificial Sequence
  RNA Oligomer
aggugcagcagugaucaau

SEQ ID NO: 4986 - RNA, 19 nt, Artificial Sequence
  RNA Oligomer
aagaguggaaagaauugau

SEQ ID NO: 4987 - RNA, 19 nt, Artificial Sequence
  RNA Oligomer
guaugauccuucugaagca

SEQ ID NO: 4988 - RNA, 19 nt, Artificial Sequence
  RNA Oligomer
caggcaagggauuuguuau

SEQ ID NO: 4989 - RNA, 19 nt, Artificial Sequence
  RNA Oligomer
cuaaauaugcuggauauag

SEQ ID NO: 4990 - RNA, 19 nt, Artificial Sequence
  RNA Oligomer
cugaauucaugaagaaacu

SEQ ID NO: 4991 - RNA, 19 nt, Artificial Sequence
  RNA Oligomer
cuuauguagugacucgcua

SEQ ID NO: 4992 - RNA, 19 nt, Artificial Sequence
  RNA Oligomer
aggaacgaguuuuaugaug

SEQ ID NO: 4993 - RNA, 19 nt, Artificial Sequence
  RNA Oligomer
caggaacgaguuuuaugau

SEQ ID NO: 4994 - RNA, 19 nt, Artificial Sequence
  RNA Oligomer
cugcaggaacgaguuuuau

SEQ ID NO: 4995 - RNA, 19 nt, Artificial Sequence
  RNA Oligomer
uguagagauuggagauucu

SEQ ID NO: 4996 - RNA, 19 nt, Artificial Sequence
  RNA Oligomer
gauggagcuagaucaugaa

SEQ ID NO: 4997 - RNA, 19 nt, Artificial Sequence
  RNA Oligomer
caagcgugacaacaauuuu

SEQ ID NO: 4998 - RNA, 19 nt, Artificial Sequence
  RNA Oligomer
gcucucagcauccaucauc

SEQ ID NO: 4999 - RNA, 19 nt, Artificial Sequence
  RNA Oligomer
aggaaguuauggacuugga

SEQ ID NO: 5000 - RNA, 19 nt, Artificial Sequence
  RNA Oligomer
auaaggaaguuauggacuu

SEQ ID NO: 5001 - RNA, 19 nt, Artificial Sequence
  RNA Oligomer
augaaagggaacacacaau

SEQ ID NO: 5002 - RNA, 19 nt, Artificial Sequence
  RNA Oligomer
uaaggacuuacguugaaaa

SEQ ID NO: 5003 - RNA, 19 nt, Artificial Sequence
  RNA Oligomer
ugggcuacaaggaaaacgu

SEQ ID NO: 5004 - RNA, 19 nt, Artificial Sequence
  RNA Oligomer
gccuuauguagugacucgc

SEQ ID NO: 5005 - RNA, 19 nt, Artificial Sequence
  RNA Oligomer
agcccaguaauauaguagu

SEQ ID NO: 5006 - RNA, 19 nt, Artificial Sequence
  RNA Oligomer
aagcgugacaacaauuuuu

SEQ ID NO: 5007 - RNA, 19 nt, Artificial Sequence
  RNA Oligomer
ucagauggagcuagaucau

SEQ ID NO: 5008 - RNA, 19 nt, Artificial Sequence
  RNA Oligomer
ggaugcaaaucuuugccaa

SEQ ID NO: 5009 - RNA, 19 nt, Artificial Sequence
  RNA Oligomer
agcaagcgugacaacaauu

SEQ ID NO: 5010 - RNA, 19 nt, Artificial Sequence
  RNA Oligomer
cagagagcuaguucuuaug

SEQ ID NO: 5011 - RNA, 19 nt, Artificial Sequence
  RNA Oligomer
cuugaaagaaauguugcaa

SEQ ID NO: 5012 - RNA, 19 nt, Artificial Sequence
  RNA Oligomer
agucauugauagaacuacu

SEQ ID NO: 5013 - RNA, 19 nt, Artificial Sequence
  RNA Oligomer
cucucagcauccaucauca

SEQ ID NO: 5014 - RNA, 19 nt, Artificial Sequence
  RNA Oligomer
cagugaucaauggcucuca

SEQ ID NO: 5015 - RNA, 19 nt, Artificial Sequence
  RNA Oligomer
ggaaguuauggacuuggag

SEQ ID NO: 5016 - RNA, 19 nt, Artificial Sequence
  RNA Oligomer
acucuucccugauguccuu

SEQ ID NO: 5017 - RNA, 19 nt, Artificial Sequence
  RNA Oligomer
ugcacuuugaagauucuug

SEQ ID NO: 5018 - RNA, 19 nt, Artificial Sequence
  RNA Oligomer
agaugcuguguggaaucaa

SEQ ID NO: 5019 - RNA, 19 nt, Artificial Sequence
  RNA Oligomer
aguaugcgcagcuuaugau

SEQ ID NO: 5020 - RNA, 19 nt, Artificial Sequence
  RNA Oligomer
uggacuuggaggagagaac

SEQ ID NO: 5021 - RNA, 19 nt, Artificial Sequence
  RNA Oligomer
agcaguuagaugaaaggga

SEQ ID NO: 5022 - RNA, 19 nt, Artificial Sequence
  RNA Oligomer
acaagcaguuagaugaaag

SEQ ID NO: 5023 - RNA, 19 nt, Artificial Sequence
  RNA Oligomer
agaagcuccaccaccaaag

SEQ ID NO: 5024 - RNA, 19 nt, Artificial Sequence
  RNA Oligomer
ccuuuucccagcugacuca

SEQ ID NO: 5025 - RNA, 19 nt, Artificial Sequence
  RNA Oligomer
caguggaauaaaguuauug

SEQ ID NO: 5026 - RNA, 19 nt, Artificial Sequence
  RNA Oligomer
ugaucaguggaauaaaguu

SEQ ID NO: 5027 - RNA, 19 nt, Artificial Sequence
  RNA Oligomer
cgggacuuaaagcccagua

SEQ ID NO: 5028 - RNA, 19 nt, Artificial Sequence
  RNA Oligomer
accacagaaaucccuagaa

SEQ ID NO: 5029 - RNA, 19 nt, Artificial Sequence
  RNA Oligomer
ccuacagagagcuaguucu

SEQ ID NO: 5030 - RNA, 19 nt, Artificial Sequence
  RNA Oligomer
ucaaugucaacagauccga

SEQ ID NO: 5031 - RNA, 19 nt, Artificial Sequence
  RNA Oligomer
cugacaagcaguuagauga

SEQ ID NO: 5032 - RNA, 19 nt, Artificial Sequence
  RNA Oligomer
caaacuuaaagccagucag

SEQ ID NO: 5033 - RNA, 19 nt, Artificial Sequence
  RNA Oligomer
ugauguccuuuucccagcu

SEQ ID NO: 5034 - RNA, 19 nt, Artificial Sequence
  RNA Oligomer
ucuucccugauguccuuuu

SEQ ID NO: 5035 - RNA, 19 nt, Artificial Sequence
  RNA Oligomer
agaaccaagaauggaguua

SEQ ID NO: 5036 - RNA, 19 nt, Artificial Sequence
  RNA Oligomer
ggaggagagaaccaagaau

SEQ ID NO: 5037 - RNA, 19 nt, Artificial Sequence
  RNA Oligomer
gguaauagaugcaucuaaa

SEQ ID NO: 5038 - RNA, 19 nt, Artificial Sequence
  RNA Oligomer
uggaacaccauguccugaa

SEQ ID NO: 5039 - RNA, 19 nt, Artificial Sequence
  RNA Oligomer
uggcaugggcuacaaggaa

SEQ ID NO: 5040 - RNA, 19 nt, Artificial Sequence
  RNA Oligomer
gaauguccuaccuucucua

SEQ ID NO: 5041 - RNA, 19 nt, Artificial Sequence
  RNA Oligomer
gugauucagauggagcuag

SEQ ID NO: 5042 - RNA, 19 nt, Artificial Sequence
  RNA Oligomer
auuaauugcuugccaucau

SEQ ID NO: 5043 - RNA, 19 nt, Artificial Sequence
  RNA Oligomer
agggauuuguuauccaaaa

SEQ ID NO: 5044 - RNA, 19 nt, Artificial Sequence
  RNA Oligomer
guugcaaucaagaagcuaa

SEQ ID NO: 5045 - RNA, 19 nt, Artificial Sequence
  RNA Oligomer
acaucaaugucugguauga

SEQ ID NO: 5046 - RNA, 19 nt, Artificial Sequence
  RNA Oligomer
gggauuuguuauccaaaau

SEQ ID NO: 5047 - RNA, 19 nt, Artificial Sequence
  RNA Oligomer
acaaacuuaaagccaguca

SEQ ID NO: 5048 - RNA, 19 nt, Artificial Sequence
  RNA Oligomer
caacaaacuuaaagccagu

SEQ ID NO: 5049 - RNA, 19 nt, Artificial Sequence
  RNA Oligomer
cccugauguccuuuuccca

SEQ ID NO: 5050 - RNA, 19 nt, Artificial Sequence
  RNA Oligomer
acguugaaaacagaccuaa

SEQ ID NO: 5051 - RNA, 19 nt, Artificial Sequence
  RNA Oligomer
cucauggaugcaaaucuuu

SEQ ID NO: 5052 - RNA, 19 nt, Artificial Sequence
  RNA Oligomer
ggagcucauggaugcaaau

SEQ ID NO: 5053 - RNA, 19 nt, Artificial Sequence
  RNA Oligomer
caccacagaaaucccuaga

SEQ ID NO: 5054 - RNA, 19 nt, Artificial Sequence
  RNA Oligomer
ugaauguuuucacaccaca

SEQ ID NO: 5055 - RNA, 19 nt, Artificial Sequence
  RNA Oligomer
gcgcagcuuaugaugccau

SEQ ID NO: 5056 - RNA, 19 nt, Artificial Sequence
  RNA Oligomer
ccgacuuuggccucugaua

SEQ ID NO: 5057 - RNA, 19 nt, Artificial Sequence
  RNA Oligomer
gcaaccaacaguaaggacu

SEQ ID NO: 5058 - RNA, 19 nt, Artificial Sequence
  RNA Oligomer
uguccugaauucaugaaga

SEQ ID NO: 5059 - RNA, 19 nt, Artificial Sequence
  RNA Oligomer
gggacuuaaagcccaguaa

SEQ ID NO: 5060 - RNA, 19 nt, Artificial Sequence
  RNA Oligomer
acaccacagaaaucccuag

SEQ ID NO: 5061 - RNA, 19 nt, Artificial Sequence
  RNA Oligomer
caagggauuuguuauccaa

SEQ ID NO: 5062 - RNA, 19 nt, Artificial Sequence
  RNA Oligomer
cugaaacgauaucagaauu

SEQ ID NO: 5063 - RNA, 19 nt, Artificial Sequence
  RNA Oligomer
ccugaaacgauaucagaau

SEQ ID NO: 5064 - RNA, 19 nt, Artificial Sequence
  RNA Oligomer
gaaaucccuagaagaauuu

SEQ ID NO: 5065 - RNA, 19 nt, Artificial Sequence
  RNA Oligomer
uguuuucacaccacagaaa

SEQ ID NO: 5066 - RNA, 19 nt, Artificial Sequence
  RNA Oligomer
gcagaagcaagcgugacaa

SEQ ID NO: 5067 - RNA, 19 nt, Artificial Sequence
  RNA Oligomer
gagaaccaagaauggaguu

SEQ ID NO: 5068 - RNA, 19 nt, Artificial Sequence
  RNA Oligomer
agagaaccaagaauggagu

SEQ ID NO: 5069 - RNA, 19 nt, Artificial Sequence
  RNA Oligomer
ggaucucuguagaugaagc

SEQ ID NO: 5070 - RNA, 19 nt, Artificial Sequence
  RNA Oligomer
ggauuuguuauccaaaaug

SEQ ID NO: 5071 - RNA, 19 nt, Artificial Sequence
  RNA Oligomer
uacguugaaaacagaccua

SEQ ID NO: 5072 - RNA, 19 nt, Artificial Sequence
  RNA Oligomer
caaccaacaguaaggacuu

SEQ ID NO: 5073 - RNA, 19 nt, Artificial Sequence
  RNA Oligomer
ucauucugcuggaauuauu

SEQ ID NO: 5074 - RNA, 19 nt, Artificial Sequence
  RNA Oligomer
uggaugcaaaucuuugcca

SEQ ID NO: 5075 - RNA, 19 nt, Artificial Sequence
  RNA Oligomer
uggagcucauggaugcaaa

SEQ ID NO: 5076 - RNA, 19 nt, Artificial Sequence
  RNA Oligomer
gccgaccauuucagaauca

SEQ ID NO: 5077 - RNA, 19 nt, Artificial Sequence
  RNA Oligomer
agccgaccauuucagaauc

SEQ ID NO: 5078 - RNA, 19 nt, Artificial Sequence
  RNA Oligomer
cugguaugauccuucugaa

SEQ ID NO: 5079 - RNA, 19 nt, Artificial Sequence
  RNA Oligomer
aaggaucucuguagaugaa

SEQ ID NO: 5080 - RNA, 19 nt, Artificial Sequence
  RNA Oligomer
ugaaagaauguccuaccuu

SEQ ID NO: 5081 - RNA, 19 nt, Artificial Sequence
  RNA Oligomer
gcaaaucuuugccaaguga

SEQ ID NO: 5082 - RNA, 19 nt, Artificial Sequence
  RNA Oligomer
gccuuuugaauguuuucac

SEQ ID NO: 5083 - RNA, 19 nt, Artificial Sequence
  RNA Oligomer
ccaucaugagcagaagcaa

SEQ ID NO: 5084 - RNA, 19 nt, Artificial Sequence
  RNA Oligomer
cgcagcuuaugaugccauu

SEQ ID NO: 5085 - RNA, 19 nt, Artificial Sequence
  RNA Oligomer
acacaauagaagaguggaa

SEQ ID NO: 5086 - RNA, 19 nt, Artificial Sequence
  RNA Oligomer
ugguaauagaugcaucuaa

SEQ ID NO: 5087 - RNA, 19 nt, Artificial Sequence
  RNA Oligomer
uuauccaaaaugcugguaa

SEQ ID NO: 5088 - RNA, 19 nt, Artificial Sequence
  RNA Oligomer
auagcuuugagaaacucuu

SEQ ID NO: 5089 - RNA, 19 nt, Artificial Sequence
  RNA Oligomer
aaccaacaguaaggacuua

SEQ ID NO: 5090 - RNA, 19 nt, Artificial Sequence
  RNA Oligomer
ccuucauucugcuggaauu

SEQ ID NO: 5091 - RNA, 19 nt, Artificial Sequence
  RNA Oligomer
gaaagaauguccuaccuuc

SEQ ID NO: 5092 - RNA, 19 nt, Artificial Sequence
  RNA Oligomer
caaaucuuugccaagugau

SEQ ID NO: 5093 - RNA, 19 nt, Artificial Sequence
  RNA Oligomer
cagaaaucccuagaagaau

SEQ ID NO: 5094 - RNA, 19 nt, Artificial Sequence
  RNA Oligomer
aagccgaccauuucagaau

SEQ ID NO: 5095 - RNA, 19 nt, Artificial Sequence
  RNA Oligomer
cacaauagaagaguggaaa

SEQ ID NO: 5096 - RNA, 19 nt, Artificial Sequence
  RNA Oligomer
gaaacugcaaccaacagua

SEQ ID NO: 5097 - RNA, 19 nt, Artificial Sequence
  RNA Oligomer
cagcuuggaacaccauguc

SEQ ID NO: 5098 - RNA, 19 nt, Artificial Sequence
  RNA Oligomer
acagcuuggaacaccaugu

SEQ ID NO: 5099 - RNA, 19 nt, Artificial Sequence
  RNA Oligomer
ccuuuugaauguuuucaca

SEQ ID NO: 5100 - RNA, 19 nt, Artificial Sequence
  RNA Oligomer
ggccuuuugaauguuuuca

SEQ ID NO: 5101 - RNA, 19 nt, Artificial Sequence
  RNA Oligomer
agaaucagacucaugccaa

SEQ ID NO: 5102 - RNA, 19 nt, Artificial Sequence
  RNA Oligomer
ccgaccauuucagaaucag

SEQ ID NO: 5103 - RNA, 19 nt, Artificial Sequence
  RNA Oligomer
gcagcuuaugaugccauuc

SEQ ID NO: 5104 - RNA, 19 nt, Artificial Sequence
  RNA Oligomer
uggaggagagaaccaagaa

SEQ ID NO: 5105 - RNA, 19 nt, Artificial Sequence
  RNA Oligomer
uauccaaaaugcugguaau

SEQ ID NO: 5106 - RNA, 19 nt, Artificial Sequence
  RNA Oligomer
guuauccaaaaugcuggua

SEQ ID NO: 5107 - RNA, 19 nt, Artificial Sequence
  RNA Oligomer
gcaagggauuuguuaucca

SEQ ID NO: 5108 - RNA, 19 nt, Artificial Sequence
  RNA Oligomer
gaauuuaaaaccuauaggc

SEQ ID NO: 5109 - RNA, 19 nt, Artificial Sequence
  RNA Oligomer
auaugcuggauauagcuuu

SEQ ID NO: 5110 - RNA, 19 nt, Artificial Sequence
  RNA Oligomer
cauguccugaauucaugaa

SEQ ID NO: 5111 - RNA, 19 nt, Artificial Sequence
  RNA Oligomer
ccauguccugaauucauga

SEQ ID NO: 5112 - RNA, 19 nt, Artificial Sequence
  RNA Oligomer
accauguccugaauucaug

SEQ ID NO: 5113 - RNA, 19 nt, Artificial Sequence
  RNA Oligomer
cuacauucacaguccugaa

SEQ ID NO: 5114 - RNA, 19 nt, Artificial Sequence
  RNA Oligomer
guggaaucaagcaccuuca

SEQ ID NO: 5115 - RNA, 19 nt, Artificial Sequence
  RNA Oligomer
ccuucucuaucagaugcug

SEQ ID NO: 5116 - RNA, 19 nt, Artificial Sequence
  RNA Oligomer
ccuaccuucucuaucagau

SEQ ID NO: 5117 - RNA, 19 nt, Artificial Sequence
  RNA Oligomer
ugcaaaucuuugccaagug

SEQ ID NO: 5118 - RNA, 19 nt, Artificial Sequence
  RNA Oligomer
ccuagaagaauuucaagau

SEQ ID NO: 5119 - RNA, 19 nt, Artificial Sequence
  RNA Oligomer
gaaucagacucaugccaag

SEQ ID NO: 5120 - RNA, 19 nt, Artificial Sequence
  RNA Oligomer
uggccucugauacagacag

SEQ ID NO: 5121 - RNA, 19 nt, Artificial Sequence
  RNA Oligomer
ccaccaaagaucccugaca

SEQ ID NO: 5122 - RNA, 19 nt, Artificial Sequence
  RNA Oligomer
cuugccaucaugagcagaa

SEQ ID NO: 5123 - RNA, 19 nt, Artificial Sequence
  RNA Oligomer
cucuguagaugaagcucuc

SEQ ID NO: 5124 - RNA, 19 nt, Artificial Sequence
  RNA Oligomer
ugagaaacucuucccugau

SEQ ID NO: 5125 - RNA, 19 nt, Artificial Sequence
  RNA Oligomer
acaguaaggacuuacguug

SEQ ID NO: 5126 - RNA, 19 nt, Artificial Sequence
  RNA Oligomer
agaaacugcaaccaacagu

SEQ ID NO: 5127 - RNA, 19 nt, Artificial Sequence
  RNA Oligomer
uacauucacaguccugaaa

SEQ ID NO: 5128 - RNA, 19 nt, Artificial Sequence
  RNA Oligomer
gacgccuuauguagugacu

SEQ ID NO: 5129 - RNA, 19 nt, Artificial Sequence
  RNA Oligomer
agcucauggaugcaaaucu

SEQ ID NO: 5130 - RNA, 19 nt, Artificial Sequence
  RNA Oligomer
cccuagaagaauuucaaga

SEQ ID NO: 5131 - RNA, 19 nt, Artificial Sequence
  RNA Oligomer
ggccuacagagagcuaguu

SEQ ID NO: 5132 - RNA, 19 nt, Artificial Sequence
  RNA Oligomer
cgaccauuucagaaucaga

SEQ ID NO: 5133 - RNA, 19 nt, Artificial Sequence
  RNA Oligomer
ugaaaacaauucagugguc

SEQ ID NO: 5134 - RNA, 19 nt, Artificial Sequence
  RNA Oligomer
cgacuuuggccucugauac

SEQ ID NO: 5135 - RNA, 19 nt, Artificial Sequence
  RNA Oligomer
ucccugacaagcaguuaga

SEQ ID NO: 5136 - RNA, 19 nt, Artificial Sequence
  RNA Oligomer
gcucaggagcucaaggaau

SEQ ID NO: 5137 - RNA, 19 nt, Artificial Sequence
  RNA Oligomer
agaucccugacaagcaguu

SEQ ID NO: 5138 - RNA, 19 nt, Artificial Sequence
  RNA Oligomer
ugauccuucugaagcagaa

SEQ ID NO: 5139 - RNA, 19 nt, Artificial Sequence
  RNA Oligomer
ccguacaucaaugucuggu

SEQ ID NO: 5140 - RNA, 19 nt, Artificial Sequence
  RNA Oligomer
uguagaugaagcucuccaa

SEQ ID NO: 5141 - RNA, 19 nt, Artificial Sequence
  RNA Oligomer
agcugacucagaacacaac

SEQ ID NO: 5142 - RNA, 19 nt, Artificial Sequence
  RNA Oligomer
gacuuacguugaaaacaga

SEQ ID NO: 5143 - RNA, 19 nt, Artificial Sequence
  RNA Oligomer
aguaaggacuuacguugaa

SEQ ID NO: 5144 - RNA, 19 nt, Artificial Sequence
  RNA Oligomer
ugaacagcuuggaacacca

SEQ ID NO: 5145 - RNA, 19 nt, Artificial Sequence
  RNA Oligomer
cgccuuauguagugacucg

SEQ ID NO: 5146 - RNA, 19 nt, Artificial Sequence
  RNA Oligomer
ugacgccuuauguagugac

SEQ ID NO: 5147 - RNA, 19 nt, Artificial Sequence
  RNA Oligomer
gccaucaugagcagaagca

SEQ ID NO: 5148 - RNA, 19 nt, Artificial Sequence
  RNA Oligomer
gccucugauacagacagca

SEQ ID NO: 5149 - RNA, 19 nt, Artificial Sequence
  RNA Oligomer
gugucuucaaugucaacag

SEQ ID NO: 5150 - RNA, 19 nt, Artificial Sequence
  RNA Oligomer
uccaacacccguacaucaa

SEQ ID NO: 5151 - RNA, 19 nt, Artificial Sequence
  RNA Oligomer
cuguagaugaagcucucca

SEQ ID NO: 5152 - RNA, 19 nt, Artificial Sequence
  RNA Oligomer
cugguaauagaugcaucua

SEQ ID NO: 5153 - RNA, 19 nt, Artificial Sequence
  RNA Oligomer
uccugaaacgauaucagaa

SEQ ID NO: 5154 - RNA, 19 nt, Artificial Sequence
  RNA Oligomer
gcuggauauagcuuugaga

SEQ ID NO: 5155 - RNA, 19 nt, Artificial Sequence
  RNA Oligomer
ccaacaguaaggacuuacg

SEQ ID NO: 5156 - RNA, 19 nt, Artificial Sequence
  RNA Oligomer
gcuuggaacaccauguccu

SEQ ID NO: 5157 - RNA, 19 nt, Artificial Sequence
  RNA Oligomer
gaacagcuuggaacaccau

SEQ ID NO: 5158 - RNA, 19 nt, Artificial Sequence
  RNA Oligomer
acugcaggaacgaguuuua

SEQ ID NO: 5159 - RNA, 19 nt, Artificial Sequence
  RNA Oligomer
gacugcaggaacgaguuuu

SEQ ID NO: 5160 - RNA, 19 nt, Artificial Sequence
  RNA Oligomer
ccaagugauucagauggag

SEQ ID NO: 5161 - RNA, 19 nt, Artificial Sequence
  RNA Oligomer
aucccuagaagaauuucaa

SEQ ID NO: 5162 - RNA, 19 nt, Artificial Sequence
  RNA Oligomer
gcuaagccgaccauuucag

SEQ ID NO: 5163 - RNA, 19 nt, Artificial Sequence
  RNA Oligomer
augccauucuugaaagaaa

SEQ ID NO: 5164 - RNA, 19 nt, Artificial Sequence
  RNA Oligomer
cagcuuaugaugccauucu

SEQ ID NO: 5165 - RNA, 19 nt, Artificial Sequence
  RNA Oligomer
agaugacuacuugggccau

SEQ ID NO: 5166 - RNA, 19 nt, Artificial Sequence
  RNA Oligomer
ggcucucagcauccaucau

SEQ ID NO: 5167 - RNA, 19 nt, Artificial Sequence
  RNA Oligomer
ugcugguaauagaugcauc

SEQ ID NO: 5168 - RNA, 19 nt, Artificial Sequence
  RNA Oligomer
ugcuggauauagcuuugag

SEQ ID NO: 5169 - RNA, 19 nt, Artificial Sequence
  RNA Oligomer
cugcaaccaacaguaagga

SEQ ID NO: 5170 - RNA, 19 nt, Artificial Sequence
  RNA Oligomer
gaagauucuugacuucggu

SEQ ID NO: 5171 - RNA, 19 nt, Artificial Sequence
  RNA Oligomer
gaaucaagcaccuucauuc

SEQ ID NO: 5172 - RNA, 19 nt, Artificial Sequence
  RNA Oligomer
uggaaucaagcaccuucau

SEQ ID NO: 5173 - RNA, 19 nt, Artificial Sequence
  RNA Oligomer
cucuaucagaugcugugug

SEQ ID NO: 5174 - RNA, 19 nt, Artificial Sequence
  RNA Oligomer
accuucucuaucagaugcu

SEQ ID NO: 5175 - RNA, 19 nt, Artificial Sequence
  RNA Oligomer
agcagaagcaagcgugaca

SEQ ID NO: 5176 - RNA, 19 nt, Artificial Sequence
  RNA Oligomer
ugccauucuugaaagaaau

SEQ ID NO: 5177 - RNA, 19 nt, Artificial Sequence
  RNA Oligomer
cccugacaagcaguuagau

SEQ ID NO: 5178 - RNA, 19 nt, Artificial Sequence
  RNA Oligomer
augcugguaauagaugcau

SEQ ID NO: 5179 - RNA, 19 nt, Artificial Sequence
  RNA Oligomer
ggcaagggauuuguuaucc

SEQ ID NO: 5180 - RNA, 19 nt, Artificial Sequence
  RNA Oligomer
accaacaguaaggacuuac

SEQ ID NO: 5181 - RNA, 19 nt, Artificial Sequence
  RNA Oligomer
uccuuggcaugggcuacaa

SEQ ID NO: 5182 - RNA, 19 nt, Artificial Sequence
  RNA Oligomer
cagaaucagacucaugcca

SEQ ID NO: 5183 - RNA, 19 nt, Artificial Sequence
  RNA Oligomer
ugauacagacagcagucua

SEQ ID NO: 5184 - RNA, 19 nt, Artificial Sequence
  RNA Oligomer
cugauacagacagcagucu

SEQ ID NO: 5185 - RNA, 19 nt, Artificial Sequence
  RNA Oligomer
cucugauacagacagcagu

SEQ ID NO: 5186 - RNA, 19 nt, Artificial Sequence
  RNA Oligomer
ugucaacagauccgacuuu

SEQ ID NO: 5187 - RNA, 19 nt, Artificial Sequence
  RNA Oligomer
caauggcucucagcaucca

SEQ ID NO: 5188 - RNA, 19 nt, Artificial Sequence
  RNA Oligomer
agaugaagcucuccaacac

SEQ ID NO: 5189 - RNA, 19 nt, Artificial Sequence
  RNA Oligomer
ucccagcugacucagaaca

SEQ ID NO: 5190 - RNA, 19 nt, Artificial Sequence
  RNA Oligomer
agauucuugacuucggucu

SEQ ID NO: 5191 - RNA, 19 nt, Artificial Sequence
  RNA Oligomer
agauccgacuuuggccucu

SEQ ID NO: 5192 - RNA, 19 nt, Artificial Sequence
  RNA Oligomer
ugaagcagaagcuccacca

SEQ ID NO: 5193 - RNA, 19 nt, Artificial Sequence
  RNA Oligomer
ugaagauucuugacuucgg

SEQ ID NO: 5194 - RNA, 19 nt, Artificial Sequence
  RNA Oligomer
cagcagugaucaauggcuc

SEQ ID NO: 5195 - RNA, 19 nt, Artificial Sequence
  RNA Oligomer
caccaccaaagaucccuga

SEQ ID NO: 5196 - RNA, 19 nt, Artificial Sequence
  RNA Oligomer
gccuacagagagcuaguuc

SEQ ID NO: 5197 - RNA, 19 nt, Artificial Sequence
  RNA Oligomer
uccgacuuuggccucugau

SEQ ID NO: 5198 - RNA, 19 nt, Artificial Sequence
  RNA Oligomer
ugcuugccaucaugagcag

SEQ ID NO: 5199 - RNA, 19 nt, Artificial Sequence
  RNA Oligomer
gcuguguggaaucaagcac

SEQ ID NO: 5200 - RNA, 19 nt, Artificial Sequence
  RNA Oligomer
ccauucuugaaagaaaugu

SEQ ID NO: 5201 - RNA, 19 nt, Artificial Sequence
  RNA Oligomer
agaaacucuucccugaugu

SEQ ID NO: 5202 - RNA, 19 nt, Artificial Sequence
  RNA Oligomer
agaauguccuaccuucucu

SEQ ID NO: 5203 - RNA, 19 nt, Artificial Sequence
  RNA Oligomer
agcuuaugaugccauucuu

SEQ ID NO: 5204 - RNA, 19 nt, Artificial Sequence
  RNA Oligomer
uccuucugaagcagaagcu

SEQ ID NO: 5205 - RNA, 19 nt, Artificial Sequence
  RNA Oligomer
gccauucuugaaagaaaug

SEQ ID NO: 5206 - RNA, 19 nt, Artificial Sequence
  RNA Oligomer
caagcaccuucauucugcu

SEQ ID NO: 5207 - RNA, 19 nt, Artificial Sequence
  RNA Oligomer
cugugaauguagaaucucc

SEQ ID NO: 5208 - RNA, 19 nt, Artificial Sequence
  RNA Oligomer
cuggcuuuaaguuuguugu

SEQ ID NO: 5209 - RNA, 19 nt, Artificial Sequence
  RNA Oligomer
guuucuucaugaauucagg

SEQ ID NO: 5210 - RNA, 19 nt, Artificial Sequence
  RNA Oligomer
auauccagcauauuuaggu

SEQ ID NO: 5211 - RNA, 19 nt, Artificial Sequence
  RNA Oligomer
ggcuuagcuucuugauugc

SEQ ID NO: 5212 - RNA, 19 nt, Artificial Sequence
  RNA Oligomer
uucuaucaaugacuaaccg

SEQ ID NO: 5213 - RNA, 19 nt, Artificial Sequence
  RNA Oligomer
cagagauccuuuuagaugc

SEQ ID NO: 5214 - RNA, 19 nt, Artificial Sequence
  RNA Oligomer
uuucuucaugaauucagga

SEQ ID NO: 5215 - RNA, 19 nt, Artificial Sequence
  RNA Oligomer
aauguagaaucuccaaucu

SEQ ID NO: 5216 - RNA, 19 nt, Artificial Sequence
  RNA Oligomer
aagucccgaugaauaauuc

SEQ ID NO: 5217 - RNA, 19 nt, Artificial Sequence
  RNA Oligomer
agggauuucugugguguga

SEQ ID NO: 5218 - RNA, 19 nt, Artificial Sequence
  RNA Oligomer
auacuauuccuugagcucc

SEQ ID NO: 5219 - RNA, 19 nt, Artificial Sequence
  RNA Oligomer
auaccagacauugauguac

SEQ ID NO: 5220 - RNA, 19 nt, Artificial Sequence
  RNA Oligomer
aaguuuguuguguucugag

SEQ ID NO: 5221 - RNA, 19 nt, Artificial Sequence
  RNA Oligomer
uuguuguguucugagucag

SEQ ID NO: 5222 - RNA, 19 nt, Artificial Sequence
  RNA Oligomer
auccagcauauuuaggucu

SEQ ID NO: 5223 - RNA, 19 nt, Artificial Sequence
  RNA Oligomer
ugugaauguagaaucucca

SEQ ID NO: 5224 - RNA, 19 nt, Artificial Sequence
  RNA Oligomer
auucuuucaugaucuagcu

SEQ ID NO: 5225 - RNA, 19 nt, Artificial Sequence
  RNA Oligomer
aaucacccaaaaauaagac

SEQ ID NO: 5226 - RNA, 19 nt, Artificial Sequence
  RNA Oligomer
aucacccaaaaauaagacc

SEQ ID NO: 5227 - RNA, 19 nt, Artificial Sequence
  RNA Oligomer
uaucaauucuuuccacucu

SEQ ID NO: 5228 - RNA, 19 nt, Artificial Sequence
  RNA Oligomer
uacuauuccuugagcuccu

SEQ ID NO: 5229 - RNA, 19 nt, Artificial Sequence
  RNA Oligomer
uucccuuucaucuaacugc

SEQ ID NO: 5230 - RNA, 19 nt, Artificial Sequence
  RNA Oligomer
uaccagacauugauguacg

SEQ ID NO: 5231 - RNA, 19 nt, Artificial Sequence
  RNA Oligomer
auugauguacggguguugg

SEQ ID NO: 5232 - RNA, 19 nt, Artificial Sequence
  RNA Oligomer
augaauucaggacauggug

SEQ ID NO: 5233 - RNA, 19 nt, Artificial Sequence
  RNA Oligomer
gacugugaauguagaaucu

SEQ ID NO: 5234 - RNA, 19 nt, Artificial Sequence
  RNA Oligomer
uuacuacuauauuacuggg

SEQ ID NO: 5235 - RNA, 19 nt, Artificial Sequence
  RNA Oligomer
uccagcagaaugaaggugc

SEQ ID NO: 5236 - RNA, 19 nt, Artificial Sequence
  RNA Oligomer
uggucggcuuagcuucuug

SEQ ID NO: 5237 - RNA, 19 nt, Artificial Sequence
  RNA Oligomer
uugaagacacaucauugac

SEQ ID NO: 5238 - RNA, 19 nt, Artificial Sequence
  RNA Oligomer
cucuucuauuguguguucc

SEQ ID NO: 5239 - RNA, 19 nt, Artificial Sequence
  RNA Oligomer
aaaucccuugccugacugg

SEQ ID NO: 5240 - RNA, 19 nt, Artificial Sequence
  RNA Oligomer
uguguucugagucagcugg

SEQ ID NO: 5241 - RNA, 19 nt, Artificial Sequence
  RNA Oligomer
aagugcaaucagauuuuac

SEQ ID NO: 5242 - RNA, 19 nt, Artificial Sequence
  RNA Oligomer
ugcaaucagauuuuacuac

SEQ ID NO: 5243 - RNA, 19 nt, Artificial Sequence
  RNA Oligomer
gagucugauucugaaaugg

SEQ ID NO: 5244 - RNA, 19 nt, Artificial Sequence
  RNA Oligomer
gauaucguuucaggacugu

SEQ ID NO: 5245 - RNA, 19 nt, Artificial Sequence
  RNA Oligomer
uauauccagcauauuuagg

SEQ ID NO: 5246 - RNA, 19 nt, Artificial Sequence
  RNA Oligomer
auuuaggucuguuuucaac

SEQ ID NO: 5247 - RNA, 19 nt, Artificial Sequence
  RNA Oligomer
guugguugcaguuucuuca

SEQ ID NO: 5248 - RNA, 19 nt, Artificial Sequence
  RNA Oligomer
uuuuccuuguagcccaugc

SEQ ID NO: 5249 - RNA, 19 nt, Artificial Sequence
  RNA Oligomer
agucccgaugaauaauucc

SEQ ID NO: 5250 - RNA, 19 nt, Artificial Sequence
  RNA Oligomer
uuccagcagaaugaaggug

SEQ ID NO: 5251 - RNA, 19 nt, Artificial Sequence
  RNA Oligomer
auggucggcuuagcuucuu

SEQ ID NO: 5252 - RNA, 19 nt, Artificial Sequence
  RNA Oligomer
guucuaucaaugacuaacc

SEQ ID NO: 5253 - RNA, 19 nt, Artificial Sequence
  RNA Oligomer
gaagacacaucauugacag

SEQ ID NO: 5254 - RNA, 19 nt, Artificial Sequence
  RNA Oligomer
auguacggguguuggagag

SEQ ID NO: 5255 - RNA, 19 nt, Artificial Sequence
  RNA Oligomer
ucuacagagauccuuuuag

SEQ ID NO: 5256 - RNA, 19 nt, Artificial Sequence
  RNA Oligomer
agagauccuuuuagaugca

SEQ ID NO: 5257 - RNA, 19 nt, Artificial Sequence
  RNA Oligomer
uuucucaaagcuauaucca

SEQ ID NO: 5258 - RNA, 19 nt, Artificial Sequence
  RNA Oligomer
uaaggcgucaucauaaaac

SEQ ID NO: 5259 - RNA, 19 nt, Artificial Sequence
  RNA Oligomer
ggcgucaucauaaaacucg

SEQ ID NO: 5260 - RNA, 19 nt, Artificial Sequence
  RNA Oligomer
gucaucauaaaacucguuc

SEQ ID NO: 5261 - RNA, 19 nt, Artificial Sequence
  RNA Oligomer
auguagaaucuccaaucuc

SEQ ID NO: 5262 - RNA, 19 nt, Artificial Sequence
  RNA Oligomer
ucauaaaacucguuccugc

SEQ ID NO: 5263 - RNA, 19 nt, Artificial Sequence
  RNA Oligomer
uguagaaucuccaaucucu

SEQ ID NO: 5264 - RNA, 19 nt, Artificial Sequence
  RNA Oligomer
ucaagaaucuucaaagugc

SEQ ID NO: 5265 - RNA, 19 nt, Artificial Sequence
  RNA Oligomer
uaaaaauuguugucacgcu

SEQ ID NO: 5266 - RNA, 19 nt, Artificial Sequence
  RNA Oligomer
cacauuucauaagaacuag

SEQ ID NO: 5267 - RNA, 19 nt, Artificial Sequence
  RNA Oligomer
cauuucauaagaacuagcu

SEQ ID NO: 5268 - RNA, 19 nt, Artificial Sequence
  RNA Oligomer
aauggucggcuuagcuucu

SEQ ID NO: 5269 - RNA, 19 nt, Artificial Sequence
  RNA Oligomer
aaguaguucuaucaaugac

SEQ ID NO: 5270 - RNA, 19 nt, Artificial Sequence
  RNA Oligomer
agcugcgcauacuauuccu

SEQ ID NO: 5271 - RNA, 19 nt, Artificial Sequence
  RNA Oligomer
ugcgcauacuauuccuuga

SEQ ID NO: 5272 - RNA, 19 nt, Artificial Sequence
  RNA Oligomer
agccauugaucacugcugc

SEQ ID NO: 5273 - RNA, 19 nt, Artificial Sequence
  RNA Oligomer
auaucaauucuuuccacuc

SEQ ID NO: 5274 - RNA, 19 nt, Artificial Sequence
  RNA Oligomer
ucuuuccacucuucuauug

SEQ ID NO: 5275 - RNA, 19 nt, Artificial Sequence
  RNA Oligomer
acuauuccuugagcuccug

SEQ ID NO: 5276 - RNA, 19 nt, Artificial Sequence
  RNA Oligomer
agaugcaucuauuaccagc

SEQ ID NO: 5277 - RNA, 19 nt, Artificial Sequence
  RNA Oligomer
auaucguuucaggacugug

SEQ ID NO: 5278 - RNA, 19 nt, Artificial Sequence
  RNA Oligomer
uuuaggucuguuuucaacg

SEQ ID NO: 5279 - RNA, 19 nt, Artificial Sequence
  RNA Oligomer
ucaaagugcaaucagauuu

SEQ ID NO: 5280 - RNA, 19 nt, Artificial Sequence
  RNA Oligomer
caaagugcaaucagauuuu

SEQ ID NO: 5281 - RNA, 19 nt, Artificial Sequence
  RNA Oligomer
gucccgaugaauaauucca

SEQ ID NO: 5282 - RNA, 19 nt, Artificial Sequence
  RNA Oligomer
ucccgaugaauaauuccag

SEQ ID NO: 5283 - RNA, 19 nt, Artificial Sequence
  RNA Oligomer
cugauagagaagguaggac

SEQ ID NO: 5284 - RNA, 19 nt, Artificial Sequence
  RNA Oligomer
auaaaaauuguugucacgc

SEQ ID NO: 5285 - RNA, 19 nt, Artificial Sequence
  RNA Oligomer
guaggacauucuuucauga

SEQ ID NO: 5286 - RNA, 19 nt, Artificial Sequence
  RNA Oligomer
acauucuuucaugaucuag

SEQ ID NO: 5287 - RNA, 19 nt, Artificial Sequence
  RNA Oligomer
uucuuucaugaucuagcuc

SEQ ID NO: 5288 - RNA, 19 nt, Artificial Sequence
  RNA Oligomer
acauuucauaagaacuagc

SEQ ID NO: 5289 - RNA, 19 nt, Artificial Sequence
  RNA Oligomer
ucacccaaaaauaagacca

SEQ ID NO: 5290 - RNA, 19 nt, Artificial Sequence
  RNA Oligomer
cuaucaaugacuaaccgac

SEQ ID NO: 5291 - RNA, 19 nt, Artificial Sequence
  RNA Oligomer
aucaaugacuaaccgacuc

SEQ ID NO: 5292 - RNA, 19 nt, Artificial Sequence
  RNA Oligomer
aucuguugacauugaagac

SEQ ID NO: 5293 - RNA, 19 nt, Artificial Sequence
  RNA Oligomer
uugacauugaagacacauc

SEQ ID NO: 5294 - RNA, 19 nt, Artificial Sequence
  RNA Oligomer
agacacaucauugacagac

SEQ ID NO: 5295 - RNA, 19 nt, Artificial Sequence
  RNA Oligomer
gacacaucauugacagacg

SEQ ID NO: 5296 - RNA, 19 nt, Artificial Sequence
  RNA Oligomer
agacauugauguacgggug

SEQ ID NO: 5297 - RNA, 19 nt, Artificial Sequence
  RNA Oligomer
gauccuuuuagaugcaucu

SEQ ID NO: 5298 - RNA, 19 nt, Artificial Sequence
  RNA Oligomer
uuguguucugagucagcug

SEQ ID NO: 5299 - RNA, 19 nt, Artificial Sequence
  RNA Oligomer
ugauaucguuucaggacug

SEQ ID NO: 5300 - RNA, 19 nt, Artificial Sequence
  RNA Oligomer
uucucaaagcuauauccag

SEQ ID NO: 5301 - RNA, 19 nt, Artificial Sequence
  RNA Oligomer
uccagcauauuuaggucug

SEQ ID NO: 5302 - RNA, 19 nt, Artificial Sequence
  RNA Oligomer
aaggcgucaucauaaaacu

SEQ ID NO: 5303 - RNA, 19 nt, Artificial Sequence
  RNA Oligomer
uagaaucuccaaucucuac

SEQ ID NO: 5304 - RNA, 19 nt, Artificial Sequence
  RNA Oligomer
aaucuccaaucucuacacu

SEQ ID NO: 5305 - RNA, 19 nt, Artificial Sequence
  RNA Oligomer
auuccagcagaaugaaggu

SEQ ID NO: 5306 - RNA, 19 nt, Artificial Sequence
  RNA Oligomer
cuuucaugaucuagcucca

SEQ ID NO: 5307 - RNA, 19 nt, Artificial Sequence
  RNA Oligomer
augagcuccaugacuaugu

SEQ ID NO: 5308 - RNA, 19 nt, Artificial Sequence
  RNA Oligomer
aaaacauucaaaaggccaa

SEQ ID NO: 5309 - RNA, 19 nt, Artificial Sequence
  RNA Oligomer
gucugauucugaaaugguc

SEQ ID NO: 5310 - RNA, 19 nt, Artificial Sequence
  RNA Oligomer
ucuuucaagaauggcauca

SEQ ID NO: 5311 - RNA, 19 nt, Artificial Sequence
  RNA Oligomer
cacccaaaaauaagaccac

SEQ ID NO: 5312 - RNA, 19 nt, Artificial Sequence
  RNA Oligomer
agaccacugaauuguuuuc

SEQ ID NO: 5313 - RNA, 19 nt, Artificial Sequence
  RNA Oligomer
acaucauugacagacgacg

SEQ ID NO: 5314 - RNA, 19 nt, Artificial Sequence
  RNA Oligomer
acgaugaugauggaugcug

SEQ ID NO: 5315 - RNA, 19 nt, Artificial Sequence
  RNA Oligomer
gagagccauugaucacugc

SEQ ID NO: 5316 - RNA, 19 nt, Artificial Sequence
  RNA Oligomer
cuucuauuguguguucccu

SEQ ID NO: 5317 - RNA, 19 nt, Artificial Sequence
  RNA Oligomer
cagacauugauguacgggu

SEQ ID NO: 5318 - RNA, 19 nt, Artificial Sequence
  RNA Oligomer
aucuauuaccagcauuuug

SEQ ID NO: 5319 - RNA, 19 nt, Artificial Sequence
  RNA Oligomer
gauaacaaaucccuugccu

SEQ ID NO: 5320 - RNA, 19 nt, Artificial Sequence
  RNA Oligomer
aacaaaucccuugccugac

SEQ ID NO: 5321 - RNA, 19 nt, Artificial Sequence
  RNA Oligomer
uuucaacguaaguccuuac

SEQ ID NO: 5322 - RNA, 19 nt, Artificial Sequence
  RNA Oligomer
aagucaagaaucuucaaag

SEQ ID NO: 5323 - RNA, 19 nt, Artificial Sequence
  RNA Oligomer
aucuucaaagugcaaucag

SEQ ID NO: 5324 - RNA, 19 nt, Artificial Sequence
  RNA Oligomer
ccaaaaauaagaccacuga

SEQ ID NO: 5325 - RNA, 19 nt, Artificial Sequence
  RNA Oligomer
auugaucacugcugcaccu

SEQ ID NO: 5326 - RNA, 19 nt, Artificial Sequence
  RNA Oligomer
aucaauucuuuccacucuu

SEQ ID NO: 5327 - RNA, 19 nt, Artificial Sequence
  RNA Oligomer
ugcuucagaaggaucauac

SEQ ID NO: 5328 - RNA, 19 nt, Artificial Sequence
  RNA Oligomer
auaacaaaucccuugccug

SEQ ID NO: 5329 - RNA, 19 nt, Artificial Sequence
  RNA Oligomer
cuauauccagcauauuuag

SEQ ID NO: 5330 - RNA, 19 nt, Artificial Sequence
  RNA Oligomer
aguuucuucaugaauucag

SEQ ID NO: 5331 - RNA, 19 nt, Artificial Sequence
  RNA Oligomer
uagcgagucacuacauaag

SEQ ID NO: 5332 - RNA, 19 nt, Artificial Sequence
  RNA Oligomer
caucauaaaacucguuccu

SEQ ID NO: 5333 - RNA, 19 nt, Artificial Sequence
  RNA Oligomer
aucauaaaacucguuccug

SEQ ID NO: 5334 - RNA, 19 nt, Artificial Sequence
  RNA Oligomer
auaaaacucguuccugcag

SEQ ID NO: 5335 - RNA, 19 nt, Artificial Sequence
  RNA Oligomer
agaaucuccaaucucuaca

SEQ ID NO: 5336 - RNA, 19 nt, Artificial Sequence
  RNA Oligomer
uucaugaucuagcuccauc

SEQ ID NO: 5337 - RNA, 19 nt, Artificial Sequence
  RNA Oligomer
aaaauuguugucacgcuug

SEQ ID NO: 5338 - RNA, 19 nt, Artificial Sequence
  RNA Oligomer
gaugauggaugcugagagc

SEQ ID NO: 5339 - RNA, 19 nt, Artificial Sequence
  RNA Oligomer
uccaaguccauaacuuccu

SEQ ID NO: 5340 - RNA, 19 nt, Artificial Sequence
  RNA Oligomer
aaguccauaacuuccuuau

SEQ ID NO: 5341 - RNA, 19 nt, Artificial Sequence
  RNA Oligomer
auuguguguucccuuucau

SEQ ID NO: 5342 - RNA, 19 nt, Artificial Sequence
  RNA Oligomer
uuuucaacguaaguccuua

SEQ ID NO: 5343 - RNA, 19 nt, Artificial Sequence
  RNA Oligomer
acguuuuccuuguagccca

SEQ ID NO: 5344 - RNA, 19 nt, Artificial Sequence
  RNA Oligomer
gcgagucacuacauaaggc

SEQ ID NO: 5345 - RNA, 19 nt, Artificial Sequence
  RNA Oligomer
acuacuauauuacugggcu

SEQ ID NO: 5346 - RNA, 19 nt, Artificial Sequence
  RNA Oligomer
aaaaauuguugucacgcuu

SEQ ID NO: 5347 - RNA, 19 nt, Artificial Sequence
  RNA Oligomer
augaucuagcuccaucuga

SEQ ID NO: 5348 - RNA, 19 nt, Artificial Sequence
  RNA Oligomer
uuggcaaagauuugcaucc

SEQ ID NO: 5349 - RNA, 19 nt, Artificial Sequence
  RNA Oligomer
aauuguugucacgcuugcu

SEQ ID NO: 5350 - RNA, 19 nt, Artificial Sequence
  RNA Oligomer
cauaagaacuagcucucug

SEQ ID NO: 5351 - RNA, 19 nt, Artificial Sequence
  RNA Oligomer
uugcaacauuucuuucaag

SEQ ID NO: 5352 - RNA, 19 nt, Artificial Sequence
  RNA Oligomer
aguaguucuaucaaugacu

SEQ ID NO: 5353 - RNA, 19 nt, Artificial Sequence
  RNA Oligomer
ugaugauggaugcugagag

SEQ ID NO: 5354 - RNA, 19 nt, Artificial Sequence
  RNA Oligomer
ugagagccauugaucacug

SEQ ID NO: 5355 - RNA, 19 nt, Artificial Sequence
  RNA Oligomer
cuccaaguccauaacuucc

SEQ ID NO: 5356 - RNA, 19 nt, Artificial Sequence
  RNA Oligomer
aaggacaucagggaagagu

SEQ ID NO: 5357 - RNA, 19 nt, Artificial Sequence
  RNA Oligomer
caagaaucuucaaagugca

SEQ ID NO: 5358 - RNA, 19 nt, Artificial Sequence
  RNA Oligomer
uugauuccacacagcaucu

SEQ ID NO: 5359 - RNA, 19 nt, Artificial Sequence
  RNA Oligomer
aucauaagcugcgcauacu

SEQ ID NO: 5360 - RNA, 19 nt, Artificial Sequence
  RNA Oligomer
guucucuccuccaagucca

SEQ ID NO: 5361 - RNA, 19 nt, Artificial Sequence
  RNA Oligomer
ucccuuucaucuaacugcu

SEQ ID NO: 5362 - RNA, 19 nt, Artificial Sequence
  RNA Oligomer
cuuucaucuaacugcuugu

SEQ ID NO: 5363 - RNA, 19 nt, Artificial Sequence
  RNA Oligomer
cuuuggugguggagcuucu

SEQ ID NO: 5364 - RNA, 19 nt, Artificial Sequence
  RNA Oligomer
ugagucagcugggaaaagg

SEQ ID NO: 5365 - RNA, 19 nt, Artificial Sequence
  RNA Oligomer
caauaacuuuauuccacug

SEQ ID NO: 5366 - RNA, 19 nt, Artificial Sequence
  RNA Oligomer
aacuuuauuccacugauca

SEQ ID NO: 5367 - RNA, 19 nt, Artificial Sequence
  RNA Oligomer
uacugggcuuuaagucccg

SEQ ID NO: 5368 - RNA, 19 nt, Artificial Sequence
  RNA Oligomer
uucuagggauuucuguggu

SEQ ID NO: 5369 - RNA, 19 nt, Artificial Sequence
  RNA Oligomer
agaacuagcucucuguagg

SEQ ID NO: 5370 - RNA, 19 nt, Artificial Sequence
  RNA Oligomer
ucggaucuguugacauuga

SEQ ID NO: 5371 - RNA, 19 nt, Artificial Sequence
  RNA Oligomer
ucaucuaacugcuugucag

SEQ ID NO: 5372 - RNA, 19 nt, Artificial Sequence
  RNA Oligomer
cugacuggcuuuaaguuug

SEQ ID NO: 5373 - RNA, 19 nt, Artificial Sequence
  RNA Oligomer
agcugggaaaaggacauca

SEQ ID NO: 5374 - RNA, 19 nt, Artificial Sequence
  RNA Oligomer
aaaaggacaucagggaaga

SEQ ID NO: 5375 - RNA, 19 nt, Artificial Sequence
  RNA Oligomer
uaacuccauucuugguucu

SEQ ID NO: 5376 - RNA, 19 nt, Artificial Sequence
  RNA Oligomer
auucuugguucucuccucc

SEQ ID NO: 5377 - RNA, 19 nt, Artificial Sequence
  RNA Oligomer
uuuagaugcaucuauuacc

SEQ ID NO: 5378 - RNA, 19 nt, Artificial Sequence
  RNA Oligomer
uucaggacaugguguucca

SEQ ID NO: 5379 - RNA, 19 nt, Artificial Sequence
  RNA Oligomer
uuccuuguagcccaugcca

SEQ ID NO: 5380 - RNA, 19 nt, Artificial Sequence
  RNA Oligomer
uagagaagguaggacauuc

SEQ ID NO: 5381 - RNA, 19 nt, Artificial Sequence
  RNA Oligomer
cuagcuccaucugaaucac

SEQ ID NO: 5382 - RNA, 19 nt, Artificial Sequence
  RNA Oligomer
augauggcaagcaauuaau

SEQ ID NO: 5383 - RNA, 19 nt, Artificial Sequence
  RNA Oligomer
uuuuggauaacaaaucccu

SEQ ID NO: 5384 - RNA, 19 nt, Artificial Sequence
  RNA Oligomer
uuagcuucuugauugcaac

SEQ ID NO: 5385 - RNA, 19 nt, Artificial Sequence
  RNA Oligomer
ucauaccagacauugaugu

SEQ ID NO: 5386 - RNA, 19 nt, Artificial Sequence
  RNA Oligomer
auuuuggauaacaaauccc

SEQ ID NO: 5387 - RNA, 19 nt, Artificial Sequence
  RNA Oligomer
ugacuggcuuuaaguuugu

SEQ ID NO: 5388 - RNA, 19 nt, Artificial Sequence
  RNA Oligomer
acuggcuuuaaguuuguug

SEQ ID NO: 5389 - RNA, 19 nt, Artificial Sequence
  RNA Oligomer
ugggaaaaggacaucaggg

SEQ ID NO: 5390 - RNA, 19 nt, Artificial Sequence
  RNA Oligomer
uuaggucuguuuucaacgu

SEQ ID NO: 5391 - RNA, 19 nt, Artificial Sequence
  RNA Oligomer
aaagauuugcauccaugag

SEQ ID NO: 5392 - RNA, 19 nt, Artificial Sequence
  RNA Oligomer
auuugcauccaugagcucc

SEQ ID NO: 5393 - RNA, 19 nt, Artificial Sequence
  RNA Oligomer
ucuagggauuucuguggug

SEQ ID NO: 5394 - RNA, 19 nt, Artificial Sequence
  RNA Oligomer
uguggugugaaaacauuca

SEQ ID NO: 5395 - RNA, 19 nt, Artificial Sequence
  RNA Oligomer
auggcaucauaagcugcgc

SEQ ID NO: 5396 - RNA, 19 nt, Artificial Sequence
  RNA Oligomer
uaucagaggccaaagucgg

SEQ ID NO: 5397 - RNA, 19 nt, Artificial Sequence
  RNA Oligomer
aguccuuacuguugguugc

SEQ ID NO: 5398 - RNA, 19 nt, Artificial Sequence
  RNA Oligomer
ucuucaugaauucaggaca

SEQ ID NO: 5399 - RNA, 19 nt, Artificial Sequence
  RNA Oligomer
uuacugggcuuuaaguccc

SEQ ID NO: 5400 - RNA, 19 nt, Artificial Sequence
  RNA Oligomer
cuagggauuucuguggugu

SEQ ID NO: 5401 - RNA, 19 nt, Artificial Sequence
  RNA Oligomer
uuggauaacaaaucccuug

SEQ ID NO: 5402 - RNA, 19 nt, Artificial Sequence
  RNA Oligomer
aauucugauaucguuucag

SEQ ID NO: 5403 - RNA, 19 nt, Artificial Sequence
  RNA Oligomer
auucugauaucguuucagg

SEQ ID NO: 5404 - RNA, 19 nt, Artificial Sequence
  RNA Oligomer
aaauucuucuagggauuuc

SEQ ID NO: 5405 - RNA, 19 nt, Artificial Sequence
  RNA Oligomer
uuucuguggugugaaaaca

SEQ ID NO: 5406 - RNA, 19 nt, Artificial Sequence
  RNA Oligomer
uugucacgcuugcuucugc

SEQ ID NO: 5407 - RNA, 19 nt, Artificial Sequence
  RNA Oligomer
aacuccauucuugguucuc

SEQ ID NO: 5408 - RNA, 19 nt, Artificial Sequence
  RNA Oligomer
acuccauucuugguucucu

SEQ ID NO: 5409 - RNA, 19 nt, Artificial Sequence
  RNA Oligomer
gcuucaucuacagagaucc

SEQ ID NO: 5410 - RNA, 19 nt, Artificial Sequence
  RNA Oligomer
cauuuuggauaacaaaucc

SEQ ID NO: 5411 - RNA, 19 nt, Artificial Sequence
  RNA Oligomer
uaggucuguuuucaacgua

SEQ ID NO: 5412 - RNA, 19 nt, Artificial Sequence
  RNA Oligomer
aaguccuuacuguugguug

SEQ ID NO: 5413 - RNA, 19 nt, Artificial Sequence
  RNA Oligomer
aauaauuccagcagaauga

SEQ ID NO: 5414 - RNA, 19 nt, Artificial Sequence
  RNA Oligomer
uggcaaagauuugcaucca

SEQ ID NO: 5415 - RNA, 19 nt, Artificial Sequence
  RNA Oligomer
uuugcauccaugagcucca

SEQ ID NO: 5416 - RNA, 19 nt, Artificial Sequence
  RNA Oligomer
ugauucugaaauggucggc

SEQ ID NO: 5417 - RNA, 19 nt, Artificial Sequence
  RNA Oligomer
gauucugaaauggucggcu

SEQ ID NO: 5418 - RNA, 19 nt, Artificial Sequence
  RNA Oligomer
uucagaaggaucauaccag

SEQ ID NO: 5419 - RNA, 19 nt, Artificial Sequence
  RNA Oligomer
uucaucuacagagauccuu

SEQ ID NO: 5420 - RNA, 19 nt, Artificial Sequence
  RNA Oligomer
aagguaggacauucuuuca

SEQ ID NO: 5421 - RNA, 19 nt, Artificial Sequence
  RNA Oligomer
ucacuuggcaaagauuugc

SEQ ID NO: 5422 - RNA, 19 nt, Artificial Sequence
  RNA Oligomer
gugaaaacauucaaaaggc

SEQ ID NO: 5423 - RNA, 19 nt, Artificial Sequence
  RNA Oligomer
uugcuucugcucaugaugg

SEQ ID NO: 5424 - RNA, 19 nt, Artificial Sequence
  RNA Oligomer
aauggcaucauaagcugcg

SEQ ID NO: 5425 - RNA, 19 nt, Artificial Sequence
  RNA Oligomer
uuccacucuucuauugugu

SEQ ID NO: 5426 - RNA, 19 nt, Artificial Sequence
  RNA Oligomer
uuagaugcaucuauuacca

SEQ ID NO: 5427 - RNA, 19 nt, Artificial Sequence
  RNA Oligomer
uuaccagcauuuuggauaa

SEQ ID NO: 5428 - RNA, 19 nt, Artificial Sequence
  RNA Oligomer
aagaguuucucaaagcuau

SEQ ID NO: 5429 - RNA, 19 nt, Artificial Sequence
  RNA Oligomer
uaaguccuuacuguugguu

SEQ ID NO: 5430 - RNA, 19 nt, Artificial Sequence
  RNA Oligomer
aauuccagcagaaugaagg

SEQ ID NO: 5431 - RNA, 19 nt, Artificial Sequence
  RNA Oligomer
gaagguaggacauucuuuc

SEQ ID NO: 5432 - RNA, 19 nt, Artificial Sequence
  RNA Oligomer
aucacuuggcaaagauuug

SEQ ID NO: 5433 - RNA, 19 nt, Artificial Sequence
  RNA Oligomer
auucuucuagggauuucug

SEQ ID NO: 5434 - RNA, 19 nt, Artificial Sequence
  RNA Oligomer
auucugaaauggucggcuu

SEQ ID NO: 5435 - RNA, 19 nt, Artificial Sequence
  RNA Oligomer
uuuccacucuucuauugug

SEQ ID NO: 5436 - RNA, 19 nt, Artificial Sequence
  RNA Oligomer
uacuguugguugcaguuuc

SEQ ID NO: 5437 - RNA, 19 nt, Artificial Sequence
  RNA Oligomer
gacaugguguuccaagcug

SEQ ID NO: 5438 - RNA, 19 nt, Artificial Sequence
  RNA Oligomer
acaugguguuccaagcugu

SEQ ID NO: 5439 - RNA, 19 nt, Artificial Sequence
  RNA Oligomer
ugugaaaacauucaaaagg

SEQ ID NO: 5440 - RNA, 19 nt, Artificial Sequence
  RNA Oligomer
ugaaaacauucaaaaggcc

SEQ ID NO: 5441 - RNA, 19 nt, Artificial Sequence
  RNA Oligomer
uuggcaugagucugauucu

SEQ ID NO: 5442 - RNA, 19 nt, Artificial Sequence
  RNA Oligomer
cugauucugaaauggucgg

SEQ ID NO: 5443 - RNA, 19 nt, Artificial Sequence
  RNA Oligomer
gaauggcaucauaagcugc

SEQ ID NO: 5444 - RNA, 19 nt, Artificial Sequence
  RNA Oligomer
uucuugguucucuccucca

SEQ ID NO: 5445 - RNA, 19 nt, Artificial Sequence
  RNA Oligomer
auuaccagcauuuuggaua

SEQ ID NO: 5446 - RNA, 19 nt, Artificial Sequence
  RNA Oligomer
uaccagcauuuuggauaac

SEQ ID NO: 5447 - RNA, 19 nt, Artificial Sequence
  RNA Oligomer
uggauaacaaaucccuugc

SEQ ID NO: 5448 - RNA, 19 nt, Artificial Sequence
  RNA Oligomer
gccuauagguuuuaaauuc

SEQ ID NO: 5449 - RNA, 19 nt, Artificial Sequence
  RNA Oligomer
aaagcuauauccagcauau

SEQ ID NO: 5450 - RNA, 19 nt, Artificial Sequence
  RNA Oligomer
uucaugaauucaggacaug

SEQ ID NO: 5451 - RNA, 19 nt, Artificial Sequence
  RNA Oligomer
ucaugaauucaggacaugg

SEQ ID NO: 5452 - RNA, 19 nt, Artificial Sequence
  RNA Oligomer
caugaauucaggacauggu

SEQ ID NO: 5453 - RNA, 19 nt, Artificial Sequence
  RNA Oligomer
uucaggacugugaauguag

SEQ ID NO: 5454 - RNA, 19 nt, Artificial Sequence
  RNA Oligomer
ugaaggugcuugauuccac

SEQ ID NO: 5455 - RNA, 19 nt, Artificial Sequence
  RNA Oligomer
cagcaucugauagagaagg

SEQ ID NO: 5456 - RNA, 19 nt, Artificial Sequence
  RNA Oligomer
aucugauagagaagguagg

SEQ ID NO: 5457 - RNA, 19 nt, Artificial Sequence
  RNA Oligomer
cacuuggcaaagauuugca

SEQ ID NO: 5458 - RNA, 19 nt, Artificial Sequence
  RNA Oligomer
aucuugaaauucuucuagg

SEQ ID NO: 5459 - RNA, 19 nt, Artificial Sequence
  RNA Oligomer
cuuggcaugagucugauuc

SEQ ID NO: 5460 - RNA, 19 nt, Artificial Sequence
  RNA Oligomer
cugucuguaucagaggcca

SEQ ID NO: 5461 - RNA, 19 nt, Artificial Sequence
  RNA Oligomer
ugucagggaucuuuggugg

SEQ ID NO: 5462 - RNA, 19 nt, Artificial Sequence
  RNA Oligomer
uucugcucaugauggcaag

SEQ ID NO: 5463 - RNA, 19 nt, Artificial Sequence
  RNA Oligomer
gagagcuucaucuacagag

SEQ ID NO: 5464 - RNA, 19 nt, Artificial Sequence
  RNA Oligomer
aucagggaagaguuucuca

SEQ ID NO: 5465 - RNA, 19 nt, Artificial Sequence
  RNA Oligomer
caacguaaguccuuacugu

SEQ ID NO: 5466 - RNA, 19 nt, Artificial Sequence
  RNA Oligomer
acuguugguugcaguuucu

SEQ ID NO: 5467 - RNA, 19 nt, Artificial Sequence
  RNA Oligomer
uuucaggacugugaaugua

SEQ ID NO: 5468 - RNA, 19 nt, Artificial Sequence
  RNA Oligomer
agucacuacauaaggcguc

SEQ ID NO: 5469 - RNA, 19 nt, Artificial Sequence
  RNA Oligomer
agauuugcauccaugagcu

SEQ ID NO: 5470 - RNA, 19 nt, Artificial Sequence
  RNA Oligomer
ucuugaaauucuucuaggg

SEQ ID NO: 5471 - RNA, 19 nt, Artificial Sequence
  RNA Oligomer
aacuagcucucuguaggcc

SEQ ID NO: 5472 - RNA, 19 nt, Artificial Sequence
  RNA Oligomer
ucugauucugaaauggucg

SEQ ID NO: 5473 - RNA, 19 nt, Artificial Sequence
  RNA Oligomer
gaccacugaauuguuuuca

SEQ ID NO: 5474 - RNA, 19 nt, Artificial Sequence
  RNA Oligomer
guaucagaggccaaagucg

SEQ ID NO: 5475 - RNA, 19 nt, Artificial Sequence
  RNA Oligomer
ucuaacugcuugucaggga

SEQ ID NO: 5476 - RNA, 19 nt, Artificial Sequence
  RNA Oligomer
auuccuugagcuccugagc

SEQ ID NO: 5477 - RNA, 19 nt, Artificial Sequence
  RNA Oligomer
aacugcuugucagggaucu

SEQ ID NO: 5478 - RNA, 19 nt, Artificial Sequence
  RNA Oligomer
uucugcuucagaaggauca

SEQ ID NO: 5479 - RNA, 19 nt, Artificial Sequence
  RNA Oligomer
accagacauugauguacgg

SEQ ID NO: 5480 - RNA, 19 nt, Artificial Sequence
  RNA Oligomer
uuggagagcuucaucuaca

SEQ ID NO: 5481 - RNA, 19 nt, Artificial Sequence
  RNA Oligomer
guuguguucugagucagcu

SEQ ID NO: 5482 - RNA, 19 nt, Artificial Sequence
  RNA Oligomer
ucuguuuucaacguaaguc

SEQ ID NO: 5483 - RNA, 19 nt, Artificial Sequence
  RNA Oligomer
uucaacguaaguccuuacu

SEQ ID NO: 5484 - RNA, 19 nt, Artificial Sequence
  RNA Oligomer
ugguguuccaagcuguuca

SEQ ID NO: 5485 - RNA, 19 nt, Artificial Sequence
  RNA Oligomer
cgagucacuacauaaggcg

SEQ ID NO: 5486 - RNA, 19 nt, Artificial Sequence
  RNA Oligomer
gucacuacauaaggcguca

SEQ ID NO: 5487 - RNA, 19 nt, Artificial Sequence
  RNA Oligomer
ugcuucugcucaugauggc

SEQ ID NO: 5488 - RNA, 19 nt, Artificial Sequence
  RNA Oligomer
ugcugucuguaucagaggc

SEQ ID NO: 5489 - RNA, 19 nt, Artificial Sequence
  RNA Oligomer
cuguugacauugaagacac

SEQ ID NO: 5490 - RNA, 19 nt, Artificial Sequence
  RNA Oligomer
uugauguacggguguugga

SEQ ID NO: 5491 - RNA, 19 nt, Artificial Sequence
  RNA Oligomer
uggagagcuucaucuacag

SEQ ID NO: 5492 - RNA, 19 nt, Artificial Sequence
  RNA Oligomer
uagaugcaucuauuaccag

SEQ ID NO: 5493 - RNA, 19 nt, Artificial Sequence
  RNA Oligomer
uucugauaucguuucagga

SEQ ID NO: 5494 - RNA, 19 nt, Artificial Sequence
  RNA Oligomer
ucucaaagcuauauccagc

SEQ ID NO: 5495 - RNA, 19 nt, Artificial Sequence
  RNA Oligomer
cguaaguccuuacuguugg

SEQ ID NO: 5496 - RNA, 19 nt, Artificial Sequence
  RNA Oligomer
aggacaugguguuccaagc

SEQ ID NO: 5497 - RNA, 19 nt, Artificial Sequence
  RNA Oligomer
augguguuccaagcuguuc

SEQ ID NO: 5498 - RNA, 19 nt, Artificial Sequence
  RNA Oligomer
uaaaacucguuccugcagu

SEQ ID NO: 5499 - RNA, 19 nt, Artificial Sequence
  RNA Oligomer
aaaacucguuccugcaguc

SEQ ID NO: 5500 - RNA, 19 nt, Artificial Sequence
  RNA Oligomer
cuccaucugaaucacuugg

SEQ ID NO: 5501 - RNA, 19 nt, Artificial Sequence
  RNA Oligomer
uugaaauucuucuagggau

SEQ ID NO: 5502 - RNA, 19 nt, Artificial Sequence
  RNA Oligomer
cugaaauggucggcuuagc

SEQ ID NO: 5503 - RNA, 19 nt, Artificial Sequence
  RNA Oligomer
uuucuuucaagaauggcau

SEQ ID NO: 5504 - RNA, 19 nt, Artificial Sequence
  RNA Oligomer
agaauggcaucauaagcug

SEQ ID NO: 5505 - RNA, 19 nt, Artificial Sequence
  RNA Oligomer
auggcccaaguagucaucu

SEQ ID NO: 5506 - RNA, 19 nt, Artificial Sequence
  RNA Oligomer
augauggaugcugagagcc

SEQ ID NO: 5507 - RNA, 19 nt, Artificial Sequence
  RNA Oligomer
gaugcaucuauuaccagca

SEQ ID NO: 5508 - RNA, 19 nt, Artificial Sequence
  RNA Oligomer
cucaaagcuauauccagca

SEQ ID NO: 5509 - RNA, 19 nt, Artificial Sequence
  RNA Oligomer
uccuuacuguugguugcag

SEQ ID NO: 5510 - RNA, 19 nt, Artificial Sequence
  RNA Oligomer
accgaagucaagaaucuuc

SEQ ID NO: 5511 - RNA, 19 nt, Artificial Sequence
  RNA Oligomer
gaaugaaggugcuugauuc

SEQ ID NO: 5512 - RNA, 19 nt, Artificial Sequence
  RNA Oligomer
augaaggugcuugauucca

SEQ ID NO: 5513 - RNA, 19 nt, Artificial Sequence
  RNA Oligomer
cacacagcaucugauagag

SEQ ID NO: 5514 - RNA, 19 nt, Artificial Sequence
  RNA Oligomer
agcaucugauagagaaggu

SEQ ID NO: 5515 - RNA, 19 nt, Artificial Sequence
  RNA Oligomer
ugucacgcuugcuucugcu

SEQ ID NO: 5516 - RNA, 19 nt, Artificial Sequence
  RNA Oligomer
auuucuuucaagaauggca

SEQ ID NO: 5517 - RNA, 19 nt, Artificial Sequence
  RNA Oligomer
aucuaacugcuugucaggg

SEQ ID NO: 5518 - RNA, 19 nt, Artificial Sequence
  RNA Oligomer
augcaucuauuaccagcau

SEQ ID NO: 5519 - RNA, 19 nt, Artificial Sequence
  RNA Oligomer
ggauaacaaaucccuugcc

SEQ ID NO: 5520 - RNA, 19 nt, Artificial Sequence
  RNA Oligomer
guaaguccuuacuguuggu

SEQ ID NO: 5521 - RNA, 19 nt, Artificial Sequence
  RNA Oligomer
uuguagcccaugccaagga

SEQ ID NO: 5522 - RNA, 19 nt, Artificial Sequence
  RNA Oligomer
uggcaugagucugauucug

SEQ ID NO: 5523 - RNA, 19 nt, Artificial Sequence
  RNA Oligomer
uagacugcugucuguauca

SEQ ID NO: 5524 - RNA, 19 nt, Artificial Sequence
  RNA Oligomer
agacugcugucuguaucag

SEQ ID NO: 5525 - RNA, 19 nt, Artificial Sequence
  RNA Oligomer
acugcugucuguaucagag

SEQ ID NO: 5526 - RNA, 19 nt, Artificial Sequence
  RNA Oligomer
aaagucggaucuguugaca

SEQ ID NO: 5527 - RNA, 19 nt, Artificial Sequence
  RNA Oligomer
uggaugcugagagccauug

SEQ ID NO: 5528 - RNA, 19 nt, Artificial Sequence
  RNA Oligomer
guguuggagagcuucaucu

SEQ ID NO: 5529 - RNA, 19 nt, Artificial Sequence
  RNA Oligomer
uguucugagucagcuggga

SEQ ID NO: 5530 - RNA, 19 nt, Artificial Sequence
  RNA Oligomer
agaccgaagucaagaaucu

SEQ ID NO: 5531 - RNA, 19 nt, Artificial Sequence
  RNA Oligomer
agaggccaaagucggaucu

SEQ ID NO: 5532 - RNA, 19 nt, Artificial Sequence
  RNA Oligomer
ugguggagcuucugcuuca

SEQ ID NO: 5533 - RNA, 19 nt, Artificial Sequence
  RNA Oligomer
ccgaagucaagaaucuuca

SEQ ID NO: 5534 - RNA, 19 nt, Artificial Sequence
  RNA Oligomer
gagccauugaucacugcug

SEQ ID NO: 5535 - RNA, 19 nt, Artificial Sequence
  RNA Oligomer
ucagggaucuuugguggug

SEQ ID NO: 5536 - RNA, 19 nt, Artificial Sequence
  RNA Oligomer
gaacuagcucucuguaggc

SEQ ID NO: 5537 - RNA, 19 nt, Artificial Sequence
  RNA Oligomer
aucagaggccaaagucgga

SEQ ID NO: 5538 - RNA, 19 nt, Artificial Sequence
  RNA Oligomer
cugcucaugauggcaagca

SEQ ID NO: 5539 - RNA, 19 nt, Artificial Sequence
  RNA Oligomer
gugcuugauuccacacagc

SEQ ID NO: 5540 - RNA, 19 nt, Artificial Sequence
  RNA Oligomer
acauuucuuucaagaaugg

SEQ ID NO: 5541 - RNA, 19 nt, Artificial Sequence
  RNA Oligomer
acaucagggaagaguuucu

SEQ ID NO: 5542 - RNA, 19 nt, Artificial Sequence
  RNA Oligomer
agagaagguaggacauucu

SEQ ID NO: 5543 - RNA, 19 nt, Artificial Sequence
  RNA Oligomer
aagaauggcaucauaagcu

SEQ ID NO: 5544 - RNA, 19 nt, Artificial Sequence
  RNA Oligomer
agcuucugcuucagaagga

SEQ ID NO: 5545 - RNA, 19 nt, Artificial Sequence
  RNA Oligomer
cauuucuuucaagaauggc

SEQ ID NO: 5546 - RNA, 19 nt, Artificial Sequence
  RNA Oligomer
agcagaaugaaggugcuug

SEQ ID NO: 5547 - RNA, 19 nt, Artificial Sequence
  RNA Oligomer
ggaccuaaaaccuaguaau

SEQ ID NO: 5548 - RNA, 19 nt, Artificial Sequence
  RNA Oligomer
ccaucauucaugcgaaaag

SEQ ID NO: 5549 - RNA, 19 nt, Artificial Sequence
  RNA Oligomer
aggaauucaaugaugugua

SEQ ID NO: 5550 - RNA, 19 nt, Artificial Sequence
  RNA Oligomer
agaacauuguuuccuggua

SEQ ID NO: 5551 - RNA, 19 nt, Artificial Sequence
  RNA Oligomer
ggcacacagaugaugaaau

SEQ ID NO: 5552 - RNA, 19 nt, Artificial Sequence
  RNA Oligomer
gcugaagauucuggauuuu

SEQ ID NO: 5553 - RNA, 19 nt, Artificial Sequence
  RNA Oligomer
gacuggaagaacauuguuu

SEQ ID NO: 5554 - RNA, 19 nt, Artificial Sequence
  RNA Oligomer
ccaaauucuccgaggucua

SEQ ID NO: 5555 - RNA, 19 nt, Artificial Sequence
  RNA Oligomer
cugaacaacauugugaaau

SEQ ID NO: 5556 - RNA, 19 nt, Artificial Sequence
  RNA Oligomer
ggcagaucugaacaacauu

SEQ ID NO: 5557 - RNA, 19 nt, Artificial Sequence
  RNA Oligomer
accauuucaguccaucauu

SEQ ID NO: 5558 - RNA, 19 nt, Artificial Sequence
  RNA Oligomer
gaccuaaaaccuaguaauc

SEQ ID NO: 5559 - RNA, 19 nt, Artificial Sequence
  RNA Oligomer
uccuuaucuaccaaauucu

SEQ ID NO: 5560 - RNA, 19 nt, Artificial Sequence
  RNA Oligomer
ugaacaacauugugaaaug

SEQ ID NO: 5561 - RNA, 19 nt, Artificial Sequence
  RNA Oligomer
gcuguugacuggaagaaca

SEQ ID NO: 5562 - RNA, 19 nt, Artificial Sequence
  RNA Oligomer
cgaggucuaaaguauauac

SEQ ID NO: 5563 - RNA, 19 nt, Artificial Sequence
  RNA Oligomer
ccgaggucuaaaguauaua

SEQ ID NO: 5564 - RNA, 19 nt, Artificial Sequence
  RNA Oligomer
caguuccuuaucuaccaaa

SEQ ID NO: 5565 - RNA, 19 nt, Artificial Sequence
  RNA Oligomer
ggucucuggaggaauucaa

SEQ ID NO: 5566 - RNA, 19 nt, Artificial Sequence
  RNA Oligomer
gcaaggucucuggaggaau

SEQ ID NO: 5567 - RNA, 19 nt, Artificial Sequence
  RNA Oligomer
cgguuacuuaaacauauga

SEQ ID NO: 5568 - RNA, 19 nt, Artificial Sequence
  RNA Oligomer
gaacauuguuuccugguac

SEQ ID NO: 5569 - RNA, 19 nt, Artificial Sequence
  RNA Oligomer
ugacuggaagaacauuguu

SEQ ID NO: 5570 - RNA, 19 nt, Artificial Sequence
  RNA Oligomer
cuguugacuggaagaacau

SEQ ID NO: 5571 - RNA, 19 nt, Artificial Sequence
  RNA Oligomer
gagcuguugacuggaagaa

SEQ ID NO: 5572 - RNA, 19 nt, Artificial Sequence
  RNA Oligomer
guauauacauucagcugac

SEQ ID NO: 5573 - RNA, 19 nt, Artificial Sequence
  RNA Oligomer
aguuccuuaucuaccaaau

SEQ ID NO: 5574 - RNA, 19 nt, Artificial Sequence
  RNA Oligomer
gaagcuuacagaugaccau

SEQ ID NO: 5575 - RNA, 19 nt, Artificial Sequence
  RNA Oligomer
ucagaagcuuacagaugac

SEQ ID NO: 5576 - RNA, 19 nt, Artificial Sequence
  RNA Oligomer
cagaucugaacaacauugu

SEQ ID NO: 5577 - RNA, 19 nt, Artificial Sequence
  RNA Oligomer
gcgaaaagaaccuacagag

SEQ ID NO: 5578 - RNA, 19 nt, Artificial Sequence
  RNA Oligomer
uccaucauucaugcgaaaa

SEQ ID NO: 5579 - RNA, 19 nt, Artificial Sequence
  RNA Oligomer
agaucaugcugaacuggau

SEQ ID NO: 5580 - RNA, 19 nt, Artificial Sequence
  RNA Oligomer
cggcacacagaugaugaaa

SEQ ID NO: 5581 - RNA, 19 nt, Artificial Sequence
  RNA Oligomer
guuccuuaucuaccaaauu

SEQ ID NO: 5582 - RNA, 19 nt, Artificial Sequence
  RNA Oligomer
gaggaauucaaugaugugu

SEQ ID NO: 5583 - RNA, 19 nt, Artificial Sequence
  RNA Oligomer
aggagcugaacaagacaau

SEQ ID NO: 5584 - RNA, 19 nt, Artificial Sequence
  RNA Oligomer
agaacugcgguuacuuaaa

SEQ ID NO: 5585 - RNA, 19 nt, Artificial Sequence
  RNA Oligomer
cgaaaagaaccuacagaga

SEQ ID NO: 5586 - RNA, 19 nt, Artificial Sequence
  RNA Oligomer
cugaacuggaugcauuaca

SEQ ID NO: 5587 - RNA, 19 nt, Artificial Sequence
  RNA Oligomer
ccugagaucaugcugaacu

SEQ ID NO: 5588 - RNA, 19 nt, Artificial Sequence
  RNA Oligomer
acacagaugaugaaaugac

SEQ ID NO: 5589 - RNA, 19 nt, Artificial Sequence
  RNA Oligomer
ucggcacacagaugaugaa

SEQ ID NO: 5590 - RNA, 19 nt, Artificial Sequence
  RNA Oligomer
agauucuggauuuuggacu

SEQ ID NO: 5591 - RNA, 19 nt, Artificial Sequence
  RNA Oligomer
ugagcugaagauucuggau

SEQ ID NO: 5592 - RNA, 19 nt, Artificial Sequence
  RNA Oligomer
agacugugagcugaagauu

SEQ ID NO: 5593 - RNA, 19 nt, Artificial Sequence
  RNA Oligomer
ugacauaauucacagggac

SEQ ID NO: 5594 - RNA, 19 nt, Artificial Sequence
  RNA Oligomer
gaggucuaaaguauauaca

SEQ ID NO: 5595 - RNA, 19 nt, Artificial Sequence
  RNA Oligomer
ugaccauguucaguuccuu

SEQ ID NO: 5596 - RNA, 19 nt, Artificial Sequence
  RNA Oligomer
aucugaacaacauugugaa

SEQ ID NO: 5597 - RNA, 19 nt, Artificial Sequence
  RNA Oligomer
ucuggaggaauucaaugau

SEQ ID NO: 5598 - RNA, 19 nt, Artificial Sequence
  RNA Oligomer
caggagcugaacaagacaa

SEQ ID NO: 5599 - RNA, 19 nt, Artificial Sequence
  RNA Oligomer
cgagcuguugacuggaaga

SEQ ID NO: 5600 - RNA, 19 nt, Artificial Sequence
  RNA Oligomer
ugcauuacaaccagacagu

SEQ ID NO: 5601 - RNA, 19 nt, Artificial Sequence
  RNA Oligomer
cugagaucaugcugaacug

SEQ ID NO: 5602 - RNA, 19 nt, Artificial Sequence
  RNA Oligomer
ugaaaugacaggcuacgug

SEQ ID NO: 5603 - RNA, 19 nt, Artificial Sequence
  RNA Oligomer
augaugaaaugacaggcua

SEQ ID NO: 5604 - RNA, 19 nt, Artificial Sequence
  RNA Oligomer
aagacugugagcugaagau

SEQ ID NO: 5605 - RNA, 19 nt, Artificial Sequence
  RNA Oligomer
acauaauucacagggaccu

SEQ ID NO: 5606 - RNA, 19 nt, Artificial Sequence
  RNA Oligomer
cugacauaauucacaggga

SEQ ID NO: 5607 - RNA, 19 nt, Artificial Sequence
  RNA Oligomer
gccgcuggaaaaugucuca

SEQ ID NO: 5608 - RNA, 19 nt, Artificial Sequence
  RNA Oligomer
caucauucaugcgaaaaga

SEQ ID NO: 5609 - RNA, 19 nt, Artificial Sequence
  RNA Oligomer
gucagugggaugcauaaug

SEQ ID NO: 5610 - RNA, 19 nt, Artificial Sequence
  RNA Oligomer
ggucagugggaugcauaau

SEQ ID NO: 5611 - RNA, 19 nt, Artificial Sequence
  RNA Oligomer
cucugugugugcugcuuuu

SEQ ID NO: 5612 - RNA, 19 nt, Artificial Sequence
  RNA Oligomer
ugaagauucuggauuuugg

SEQ ID NO: 5613 - RNA, 19 nt, Artificial Sequence
  RNA Oligomer
cugugaaugaagacuguga

SEQ ID NO: 5614 - RNA, 19 nt, Artificial Sequence
  RNA Oligomer
agcugugaaugaagacugu

SEQ ID NO: 5615 - RNA, 19 nt, Artificial Sequence
  RNA Oligomer
accauguucaguuccuuau

SEQ ID NO: 5616 - RNA, 19 nt, Artificial Sequence
  RNA Oligomer
cucuggaggaauucaauga

SEQ ID NO: 5617 - RNA, 19 nt, Artificial Sequence
  RNA Oligomer
gucucuggaggaauucaau

SEQ ID NO: 5618 - RNA, 19 nt, Artificial Sequence
  RNA Oligomer
ggagcugaacaagacaauc

SEQ ID NO: 5619 - RNA, 19 nt, Artificial Sequence
  RNA Oligomer
aaaaugugauuggucuguu

SEQ ID NO: 5620 - RNA, 19 nt, Artificial Sequence
  RNA Oligomer
gaaaaugugauuggucugu

SEQ ID NO: 5621 - RNA, 19 nt, Artificial Sequence
  RNA Oligomer
acaugaaaaugugauuggu

SEQ ID NO: 5622 - RNA, 19 nt, Artificial Sequence
  RNA Oligomer
cugcgguuacuuaaacaua

SEQ ID NO: 5623 - RNA, 19 nt, Artificial Sequence
  RNA Oligomer
acugcgguuacuuaaacau

SEQ ID NO: 5624 - RNA, 19 nt, Artificial Sequence
  RNA Oligomer
ugcgaaaagaaccuacaga

SEQ ID NO: 5625 - RNA, 19 nt, Artificial Sequence
  RNA Oligomer
ccagaccauuucaguccau

SEQ ID NO: 5626 - RNA, 19 nt, Artificial Sequence
  RNA Oligomer
uggucagugggaugcauaa

SEQ ID NO: 5627 - RNA, 19 nt, Artificial Sequence
  RNA Oligomer
gcuccugagaucaugcuga

SEQ ID NO: 5628 - RNA, 19 nt, Artificial Sequence
  RNA Oligomer
ugaaugaagacugugagcu

SEQ ID NO: 5629 - RNA, 19 nt, Artificial Sequence
  RNA Oligomer
acaagacaaucugggaggu

SEQ ID NO: 5630 - RNA, 19 nt, Artificial Sequence
  RNA Oligomer
agcuuacagaugaccaugu

SEQ ID NO: 5631 - RNA, 19 nt, Artificial Sequence
  RNA Oligomer
agcugaacaagacaaucug

SEQ ID NO: 5632 - RNA, 19 nt, Artificial Sequence
  RNA Oligomer
gcucuccagaccauuucag

SEQ ID NO: 5633 - RNA, 19 nt, Artificial Sequence
  RNA Oligomer
cuagcugugaaugaagacu

SEQ ID NO: 5634 - RNA, 19 nt, Artificial Sequence
  RNA Oligomer
uaguaaucuagcugugaau

SEQ ID NO: 5635 - RNA, 19 nt, Artificial Sequence
  RNA Oligomer
cuccgaggucuaaaguaua

SEQ ID NO: 5636 - RNA, 19 nt, Artificial Sequence
  RNA Oligomer
ccauguucaguuccuuauc

SEQ ID NO: 5637 - RNA, 19 nt, Artificial Sequence
  RNA Oligomer
gaacaagacaaucugggag

SEQ ID NO: 5638 - RNA, 19 nt, Artificial Sequence
  RNA Oligomer
ucaugcgaaaagaaccuac

SEQ ID NO: 5639 - RNA, 19 nt, Artificial Sequence
  RNA Oligomer
caguugauauuuggucagu

SEQ ID NO: 5640 - RNA, 19 nt, Artificial Sequence
  RNA Oligomer
acaguugauauuuggucag

SEQ ID NO: 5641 - RNA, 19 nt, Artificial Sequence
  RNA Oligomer
gcucugugugugcugcuuu

SEQ ID NO: 5642 - RNA, 19 nt, Artificial Sequence
  RNA Oligomer
ucagcugacauaauucaca

SEQ ID NO: 5643 - RNA, 19 nt, Artificial Sequence
  RNA Oligomer
auguucaguuccuuaucua

SEQ ID NO: 5644 - RNA, 19 nt, Artificial Sequence
  RNA Oligomer
ggaagaacauuguuuccug

SEQ ID NO: 5645 - RNA, 19 nt, Artificial Sequence
  RNA Oligomer
agacaguugauauuugguc

SEQ ID NO: 5646 - RNA, 19 nt, Artificial Sequence
  RNA Oligomer
gggaccuaaaaccuaguaa

SEQ ID NO: 5647 - RNA, 19 nt, Artificial Sequence
  RNA Oligomer
agggaccuaaaaccuagua

SEQ ID NO: 5648 - RNA, 19 nt, Artificial Sequence
  RNA Oligomer
cagcugacauaauucacag

SEQ ID NO: 5649 - RNA, 19 nt, Artificial Sequence
  RNA Oligomer
gauauuuggucagugggau

SEQ ID NO: 5650 - RNA, 19 nt, Artificial Sequence
  RNA Oligomer
gacaguugauauuugguca

SEQ ID NO: 5651 - RNA, 19 nt, Artificial Sequence
  RNA Oligomer
ucaaugauguguaucuggu

SEQ ID NO: 5652 - RNA, 19 nt, Artificial Sequence
  RNA Oligomer
gaccauuucaguccaucau

SEQ ID NO: 5653 - RNA, 19 nt, Artificial Sequence
  RNA Oligomer
uccugguacagaccauauu

SEQ ID NO: 5654 - RNA, 19 nt, Artificial Sequence
  RNA Oligomer
ugcugcuuuugacacaaaa

SEQ ID NO: 5655 - RNA, 19 nt, Artificial Sequence
  RNA Oligomer
gcaggagcugaacaagaca

SEQ ID NO: 5656 - RNA, 19 nt, Artificial Sequence
  RNA Oligomer
guguggcagugaagaagcu

SEQ ID NO: 5657 - RNA, 19 nt, Artificial Sequence
  RNA Oligomer
aguccaucauucaugcgaa

SEQ ID NO: 5658 - RNA, 19 nt, Artificial Sequence
  RNA Oligomer
ggaugcauuacaaccagac

SEQ ID NO: 5659 - RNA, 19 nt, Artificial Sequence
  RNA Oligomer
accuaguaaucuagcugug

SEQ ID NO: 5660 - RNA, 19 nt, Artificial Sequence
  RNA Oligomer
cuaaaaccuaguaaucuag

SEQ ID NO: 5661 - RNA, 19 nt, Artificial Sequence
  RNA Oligomer
cuaccaaauucuccgaggu

SEQ ID NO: 5662 - RNA, 19 nt, Artificial Sequence
  RNA Oligomer
gaacaacauugugaaaugu

SEQ ID NO: 5663 - RNA, 19 nt, Artificial Sequence
  RNA Oligomer
uggaagaacauuguuuccu

SEQ ID NO: 5664 - RNA, 19 nt, Artificial Sequence
  RNA Oligomer
gugcugcuuuugacacaaa

SEQ ID NO: 5665 - RNA, 19 nt, Artificial Sequence
  RNA Oligomer
ugggaugcauaauggccga

SEQ ID NO: 5666 - RNA, 19 nt, Artificial Sequence
  RNA Oligomer
cagggaccuaaaaccuagu

SEQ ID NO: 5667 - RNA, 19 nt, Artificial Sequence
  RNA Oligomer
caguccaucauucaugcga

SEQ ID NO: 5668 - RNA, 19 nt, Artificial Sequence
  RNA Oligomer
cuaguaaucuagcugugaa

SEQ ID NO: 5669 - RNA, 19 nt, Artificial Sequence
  RNA Oligomer
acagggaccuaaaaccuag

SEQ ID NO: 5670 - RNA, 19 nt, Artificial Sequence
  RNA Oligomer
gcguuaccagaaccugucu

SEQ ID NO: 5671 - RNA, 19 nt, Artificial Sequence
  RNA Oligomer
agcguuaccagaaccuguc

SEQ ID NO: 5672 - RNA, 19 nt, Artificial Sequence
  RNA Oligomer
accaaauucuccgaggucu

SEQ ID NO: 5673 - RNA, 19 nt, Artificial Sequence
  RNA Oligomer
acauugugaaaugucagaa

SEQ ID NO: 5674 - RNA, 19 nt, Artificial Sequence
  RNA Oligomer
acaacauugugaaauguca

SEQ ID NO: 5675 - RNA, 19 nt, Artificial Sequence
  RNA Oligomer
gacguuuuuacaccugcaa

SEQ ID NO: 5676 - RNA, 19 nt, Artificial Sequence
  RNA Oligomer
ggacguuuuuacaccugca

SEQ ID NO: 5677 - RNA, 19 nt, Artificial Sequence
  RNA Oligomer
uuggucuguuggacguuuu

SEQ ID NO: 5678 - RNA, 19 nt, Artificial Sequence
  RNA Oligomer
cagaccauuucaguccauc

SEQ ID NO: 5679 - RNA, 19 nt, Artificial Sequence
  RNA Oligomer
uccagaccauuucagucca

SEQ ID NO: 5680 - RNA, 19 nt, Artificial Sequence
  RNA Oligomer
cugcuuuugacacaaaaac

SEQ ID NO: 5681 - RNA, 19 nt, Artificial Sequence
  RNA Oligomer
gcugcuuuugacacaaaaa

SEQ ID NO: 5682 - RNA, 19 nt, Artificial Sequence
  RNA Oligomer
ugcugaacuggaugcauua

SEQ ID NO: 5683 - RNA, 19 nt, Artificial Sequence
  RNA Oligomer
auaauucacagggaccuaa

SEQ ID NO: 5684 - RNA, 19 nt, Artificial Sequence
  RNA Oligomer
cguuaccagaaccugucuc

SEQ ID NO: 5685 - RNA, 19 nt, Artificial Sequence
  RNA Oligomer
uggucuguuggacguuuuu

SEQ ID NO: 5686 - RNA, 19 nt, Artificial Sequence
  RNA Oligomer
ugauuggucuguuggacgu

SEQ ID NO: 5687 - RNA, 19 nt, Artificial Sequence
  RNA Oligomer
ccuacagagaacugcgguu

SEQ ID NO: 5688 - RNA, 19 nt, Artificial Sequence
  RNA Oligomer
caaccagacaguugauauu

SEQ ID NO: 5689 - RNA, 19 nt, Artificial Sequence
  RNA Oligomer
uggaugcauuacaaccaga

SEQ ID NO: 5690 - RNA, 19 nt, Artificial Sequence
  RNA Oligomer
cuggaugcauuacaaccag

SEQ ID NO: 5691 - RNA, 19 nt, Artificial Sequence
  RNA Oligomer
augcugaacuggaugcauu

SEQ ID NO: 5692 - RNA, 19 nt, Artificial Sequence
  RNA Oligomer
ccgcuggaaaaugucucag

SEQ ID NO: 5693 - RNA, 19 nt, Artificial Sequence
  RNA Oligomer
gcagugaagaagcucucca

SEQ ID NO: 5694 - RNA, 19 nt, Artificial Sequence
  RNA Oligomer
acagggcuccugagaucau

SEQ ID NO: 5695 - RNA, 19 nt, Artificial Sequence
  RNA Oligomer
ugugcugcuuuugacacaa

SEQ ID NO: 5696 - RNA, 19 nt, Artificial Sequence
  RNA Oligomer
ucaugcugaacuggaugca

SEQ ID NO: 5697 - RNA, 19 nt, Artificial Sequence
  RNA Oligomer
ggucuguuggacguuuuua

SEQ ID NO: 5698 - RNA, 19 nt, Artificial Sequence
  RNA Oligomer
cagagaacugcgguuacuu

SEQ ID NO: 5699 - RNA, 19 nt, Artificial Sequence
  RNA Oligomer
gugugcugcuuuugacaca

SEQ ID NO: 5700 - RNA, 19 nt, Artificial Sequence
  RNA Oligomer
acaaccagacaguugauau

SEQ ID NO: 5701 - RNA, 19 nt, Artificial Sequence
  RNA Oligomer
gucuguuggacguuuuuac

SEQ ID NO: 5702 - RNA, 19 nt, Artificial Sequence
  RNA Oligomer
uggcagugaagaagcucuc

SEQ ID NO: 5703 - RNA, 19 nt, Artificial Sequence
  RNA Oligomer
guuuccugguacagaccau

SEQ ID NO: 5704 - RNA, 19 nt, Artificial Sequence
  RNA Oligomer
cagugaagaagcucuccag

SEQ ID NO: 5705 - RNA, 19 nt, Artificial Sequence
  RNA Oligomer
accagaaccugucuccagu

SEQ ID NO: 5706 - RNA, 19 nt, Artificial Sequence
  RNA Oligomer
auuacuagguuuuaggucc

SEQ ID NO: 5707 - RNA, 19 nt, Artificial Sequence
  RNA Oligomer
cuuuucgcaugaaugaugg

SEQ ID NO: 5708 - RNA, 19 nt, Artificial Sequence
  RNA Oligomer
uacacaucauugaauuccu

SEQ ID NO: 5709 - RNA, 19 nt, Artificial Sequence
  RNA Oligomer
uaccaggaaacaauguucu

SEQ ID NO: 5710 - RNA, 19 nt, Artificial Sequence
  RNA Oligomer
auuucaucaucugugugcc

SEQ ID NO: 5711 - RNA, 19 nt, Artificial Sequence
  RNA Oligomer
aaaauccagaaucuucagc

SEQ ID NO: 5712 - RNA, 19 nt, Artificial Sequence
  RNA Oligomer
aaacaauguucuuccaguc

SEQ ID NO: 5713 - RNA, 19 nt, Artificial Sequence
  RNA Oligomer
uagaccucggagaauuugg

SEQ ID NO: 5714 - RNA, 19 nt, Artificial Sequence
  RNA Oligomer
auuucacaauguuguucag

SEQ ID NO: 5715 - RNA, 19 nt, Artificial Sequence
  RNA Oligomer
aauguuguucagaucugcc

SEQ ID NO: 5716 - RNA, 19 nt, Artificial Sequence
  RNA Oligomer
aaugauggacugaaauggu

SEQ ID NO: 5717 - RNA, 19 nt, Artificial Sequence
  RNA Oligomer
gauuacuagguuuuagguc

SEQ ID NO: 5718 - RNA, 19 nt, Artificial Sequence
  RNA Oligomer
agaauuugguagauaagga

SEQ ID NO: 5719 - RNA, 19 nt, Artificial Sequence
  RNA Oligomer
cauuucacaauguuguuca

SEQ ID NO: 5720 - RNA, 19 nt, Artificial Sequence
  RNA Oligomer
uguucuuccagucaacagc

SEQ ID NO: 5721 - RNA, 19 nt, Artificial Sequence
  RNA Oligomer
guauauacuuuagaccucg

SEQ ID NO: 5722 - RNA, 19 nt, Artificial Sequence
  RNA Oligomer
uauauacuuuagaccucgg

SEQ ID NO: 5723 - RNA, 19 nt, Artificial Sequence
  RNA Oligomer
uuugguagauaaggaacug

SEQ ID NO: 5724 - RNA, 19 nt, Artificial Sequence
  RNA Oligomer
uugaauuccuccagagacc

SEQ ID NO: 5725 - RNA, 19 nt, Artificial Sequence
  RNA Oligomer
auuccuccagagaccuugc

SEQ ID NO: 5726 - RNA, 19 nt, Artificial Sequence
  RNA Oligomer
ucauauguuuaaguaaccg

SEQ ID NO: 5727 - RNA, 19 nt, Artificial Sequence
  RNA Oligomer
guaccaggaaacaauguuc

SEQ ID NO: 5728 - RNA, 19 nt, Artificial Sequence
  RNA Oligomer
aacaauguucuuccaguca

SEQ ID NO: 5729 - RNA, 19 nt, Artificial Sequence
  RNA Oligomer
auguucuuccagucaacag

SEQ ID NO: 5730 - RNA, 19 nt, Artificial Sequence
  RNA Oligomer
uucuuccagucaacagcuc

SEQ ID NO: 5731 - RNA, 19 nt, Artificial Sequence
  RNA Oligomer
gucagcugaauguauauac

SEQ ID NO: 5732 - RNA, 19 nt, Artificial Sequence
  RNA Oligomer
auuugguagauaaggaacu

SEQ ID NO: 5733 - RNA, 19 nt, Artificial Sequence
  RNA Oligomer
auggucaucuguaagcuuc

SEQ ID NO: 5734 - RNA, 19 nt, Artificial Sequence
  RNA Oligomer
gucaucuguaagcuucuga

SEQ ID NO: 5735 - RNA, 19 nt, Artificial Sequence
  RNA Oligomer
acaauguuguucagaucug

SEQ ID NO: 5736 - RNA, 19 nt, Artificial Sequence
  RNA Oligomer
cucuguagguucuuuucgc

SEQ ID NO: 5737 - RNA, 19 nt, Artificial Sequence
  RNA Oligomer
uuuucgcaugaaugaugga

SEQ ID NO: 5738 - RNA, 19 nt, Artificial Sequence
  RNA Oligomer
auccaguucagcaugaucu

SEQ ID NO: 5739 - RNA, 19 nt, Artificial Sequence
  RNA Oligomer
uuucaucaucugugugccg

SEQ ID NO: 5740 - RNA, 19 nt, Artificial Sequence
  RNA Oligomer
aauuugguagauaaggaac

SEQ ID NO: 5741 - RNA, 19 nt, Artificial Sequence
  RNA Oligomer
acacaucauugaauuccuc

SEQ ID NO: 5742 - RNA, 19 nt, Artificial Sequence
  RNA Oligomer
auugucuuguucagcuccu

SEQ ID NO: 5743 - RNA, 19 nt, Artificial Sequence
  RNA Oligomer
uuuaaguaaccgcaguucu

SEQ ID NO: 5744 - RNA, 19 nt, Artificial Sequence
  RNA Oligomer
ucucuguagguucuuuucg

SEQ ID NO: 5745 - RNA, 19 nt, Artificial Sequence
  RNA Oligomer
uguaaugcauccaguucag

SEQ ID NO: 5746 - RNA, 19 nt, Artificial Sequence
  RNA Oligomer
aguucagcaugaucucagg

SEQ ID NO: 5747 - RNA, 19 nt, Artificial Sequence
  RNA Oligomer
gucauuucaucaucugugu

SEQ ID NO: 5748 - RNA, 19 nt, Artificial Sequence
  RNA Oligomer
uucaucaucugugugccga

SEQ ID NO: 5749 - RNA, 19 nt, Artificial Sequence
  RNA Oligomer
aguccaaaauccagaaucu

SEQ ID NO: 5750 - RNA, 19 nt, Artificial Sequence
  RNA Oligomer
auccagaaucuucagcuca

SEQ ID NO: 5751 - RNA, 19 nt, Artificial Sequence
  RNA Oligomer
aaucuucagcucacagucu

SEQ ID NO: 5752 - RNA, 19 nt, Artificial Sequence
  RNA Oligomer
gucccugugaauuauguca

SEQ ID NO: 5753 - RNA, 19 nt, Artificial Sequence
  RNA Oligomer
uguauauacuuuagaccuc

SEQ ID NO: 5754 - RNA, 19 nt, Artificial Sequence
  RNA Oligomer
aaggaacugaacaugguca

SEQ ID NO: 5755 - RNA, 19 nt, Artificial Sequence
  RNA Oligomer
uucacaauguuguucagau

SEQ ID NO: 5756 - RNA, 19 nt, Artificial Sequence
  RNA Oligomer
aucauugaauuccuccaga

SEQ ID NO: 5757 - RNA, 19 nt, Artificial Sequence
  RNA Oligomer
uugucuuguucagcuccug

SEQ ID NO: 5758 - RNA, 19 nt, Artificial Sequence
  RNA Oligomer
ucuuccagucaacagcucg

SEQ ID NO: 5759 - RNA, 19 nt, Artificial Sequence
  RNA Oligomer
acugucugguuguaaugca

SEQ ID NO: 5760 - RNA, 19 nt, Artificial Sequence
  RNA Oligomer
caguucagcaugaucucag

SEQ ID NO: 5761 - RNA, 19 nt, Artificial Sequence
  RNA Oligomer
cacguagccugucauuuca

SEQ ID NO: 5762 - RNA, 19 nt, Artificial Sequence
  RNA Oligomer
uagccugucauuucaucau

SEQ ID NO: 5763 - RNA, 19 nt, Artificial Sequence
  RNA Oligomer
aucuucagcucacagucuu

SEQ ID NO: 5764 - RNA, 19 nt, Artificial Sequence
  RNA Oligomer
aggucccugugaauuaugu

SEQ ID NO: 5765 - RNA, 19 nt, Artificial Sequence
  RNA Oligomer
ucccugugaauuaugucag

SEQ ID NO: 5766 - RNA, 19 nt, Artificial Sequence
  RNA Oligomer
ugagacauuuuccagcggc

SEQ ID NO: 5767 - RNA, 19 nt, Artificial Sequence
  RNA Oligomer
ucuuuucgcaugaaugaug

SEQ ID NO: 5768 - RNA, 19 nt, Artificial Sequence
  RNA Oligomer
cauuaugcaucccacugac

SEQ ID NO: 5769 - RNA, 19 nt, Artificial Sequence
  RNA Oligomer
auuaugcaucccacugacc

SEQ ID NO: 5770 - RNA, 19 nt, Artificial Sequence
  RNA Oligomer
aaaagcagcacacacagag

SEQ ID NO: 5771 - RNA, 19 nt, Artificial Sequence
  RNA Oligomer
ccaaaauccagaaucuuca

SEQ ID NO: 5772 - RNA, 19 nt, Artificial Sequence
  RNA Oligomer
ucacagucuucauucacag

SEQ ID NO: 5773 - RNA, 19 nt, Artificial Sequence
  RNA Oligomer
acagucuucauucacagcu

SEQ ID NO: 5774 - RNA, 19 nt, Artificial Sequence
  RNA Oligomer
auaaggaacugaacauggu

SEQ ID NO: 5775 - RNA, 19 nt, Artificial Sequence
  RNA Oligomer
ucauugaauuccuccagag

SEQ ID NO: 5776 - RNA, 19 nt, Artificial Sequence
  RNA Oligomer
auugaauuccuccagagac

SEQ ID NO: 5777 - RNA, 19 nt, Artificial Sequence
  RNA Oligomer
gauugucuuguucagcucc

SEQ ID NO: 5778 - RNA, 19 nt, Artificial Sequence
  RNA Oligomer
aacagaccaaucacauuuu

SEQ ID NO: 5779 - RNA, 19 nt, Artificial Sequence
  RNA Oligomer
acagaccaaucacauuuuc

SEQ ID NO: 5780 - RNA, 19 nt, Artificial Sequence
  RNA Oligomer
accaaucacauuuucaugu

SEQ ID NO: 5781 - RNA, 19 nt, Artificial Sequence
  RNA Oligomer
uauguuuaaguaaccgcag

SEQ ID NO: 5782 - RNA, 19 nt, Artificial Sequence
  RNA Oligomer
auguuuaaguaaccgcagu

SEQ ID NO: 5783 - RNA, 19 nt, Artificial Sequence
  RNA Oligomer
ucuguagguucuuuucgca

SEQ ID NO: 5784 - RNA, 19 nt, Artificial Sequence
  RNA Oligomer
auggacugaaauggucugg

SEQ ID NO: 5785 - RNA, 19 nt, Artificial Sequence
  RNA Oligomer
uuaugcaucccacugacca

SEQ ID NO: 5786 - RNA, 19 nt, Artificial Sequence
  RNA Oligomer
ucagcaugaucucaggagc

SEQ ID NO: 5787 - RNA, 19 nt, Artificial Sequence
  RNA Oligomer
agcucacagucuucauuca

SEQ ID NO: 5788 - RNA, 19 nt, Artificial Sequence
  RNA Oligomer
accucccagauugucuugu

SEQ ID NO: 5789 - RNA, 19 nt, Artificial Sequence
  RNA Oligomer
acauggucaucuguaagcu

SEQ ID NO: 5790 - RNA, 19 nt, Artificial Sequence
  RNA Oligomer
cagauugucuuguucagcu

SEQ ID NO: 5791 - RNA, 19 nt, Artificial Sequence
  RNA Oligomer
cugaaauggucuggagagc

SEQ ID NO: 5792 - RNA, 19 nt, Artificial Sequence
  RNA Oligomer
agucuucauucacagcuag

SEQ ID NO: 5793 - RNA, 19 nt, Artificial Sequence
  RNA Oligomer
auucacagcuagauuacua

SEQ ID NO: 5794 - RNA, 19 nt, Artificial Sequence
  RNA Oligomer
uauacuuuagaccucggag

SEQ ID NO: 5795 - RNA, 19 nt, Artificial Sequence
  RNA Oligomer
gauaaggaacugaacaugg

SEQ ID NO: 5796 - RNA, 19 nt, Artificial Sequence
  RNA Oligomer
cucccagauugucuuguuc

SEQ ID NO: 5797 - RNA, 19 nt, Artificial Sequence
  RNA Oligomer
guagguucuuuucgcauga

SEQ ID NO: 5798 - RNA, 19 nt, Artificial Sequence
  RNA Oligomer
acugaccaaauaucaacug

SEQ ID NO: 5799 - RNA, 19 nt, Artificial Sequence
  RNA Oligomer
cugaccaaauaucaacugu

SEQ ID NO: 5800 - RNA, 19 nt, Artificial Sequence
  RNA Oligomer
aaagcagcacacacagagc

SEQ ID NO: 5801 - RNA, 19 nt, Artificial Sequence
  RNA Oligomer
ugugaauuaugucagcuga

SEQ ID NO: 5802 - RNA, 19 nt, Artificial Sequence
  RNA Oligomer
uagauaaggaacugaacau

SEQ ID NO: 5803 - RNA, 19 nt, Artificial Sequence
  RNA Oligomer
caggaaacaauguucuucc

SEQ ID NO: 5804 - RNA, 19 nt, Artificial Sequence
  RNA Oligomer
gaccaaauaucaacugucu

SEQ ID NO: 5805 - RNA, 19 nt, Artificial Sequence
  RNA Oligomer
uuacuagguuuuagguccc

SEQ ID NO: 5806 - RNA, 19 nt, Artificial Sequence
  RNA Oligomer
uacuagguuuuaggucccu

SEQ ID NO: 5807 - RNA, 19 nt, Artificial Sequence
  RNA Oligomer
cugugaauuaugucagcug

SEQ ID NO: 5808 - RNA, 19 nt, Artificial Sequence
  RNA Oligomer
aucccacugaccaaauauc

SEQ ID NO: 5809 - RNA, 19 nt, Artificial Sequence
  RNA Oligomer
ugaccaaauaucaacuguc

SEQ ID NO: 5810 - RNA, 19 nt, Artificial Sequence
  RNA Oligomer
accagauacacaucauuga

SEQ ID NO: 5811 - RNA, 19 nt, Artificial Sequence
  RNA Oligomer
augauggacugaaaugguc

SEQ ID NO: 5812 - RNA, 19 nt, Artificial Sequence
  RNA Oligomer
aauauggucuguaccagga

SEQ ID NO: 5813 - RNA, 19 nt, Artificial Sequence
  RNA Oligomer
uuuugugucaaaagcagca

SEQ ID NO: 5814 - RNA, 19 nt, Artificial Sequence
  RNA Oligomer
ugucuuguucagcuccugc

SEQ ID NO: 5815 - RNA, 19 nt, Artificial Sequence
  RNA Oligomer
agcuucuucacugccacac

SEQ ID NO: 5816 - RNA, 19 nt, Artificial Sequence
  RNA Oligomer
uucgcaugaaugauggacu

SEQ ID NO: 5817 - RNA, 19 nt, Artificial Sequence
  RNA Oligomer
gucugguuguaaugcaucc

SEQ ID NO: 5818 - RNA, 19 nt, Artificial Sequence
  RNA Oligomer
cacagcuagauuacuaggu

SEQ ID NO: 5819 - RNA, 19 nt, Artificial Sequence
  RNA Oligomer
cuagauuacuagguuuuag

SEQ ID NO: 5820 - RNA, 19 nt, Artificial Sequence
  RNA Oligomer
accucggagaauuugguag

SEQ ID NO: 5821 - RNA, 19 nt, Artificial Sequence
  RNA Oligomer
acauuucacaauguuguuc

SEQ ID NO: 5822 - RNA, 19 nt, Artificial Sequence
  RNA Oligomer
aggaaacaauguucuucca

SEQ ID NO: 5823 - RNA, 19 nt, Artificial Sequence
  RNA Oligomer
uuugugucaaaagcagcac

SEQ ID NO: 5824 - RNA, 19 nt, Artificial Sequence
  RNA Oligomer
ucggccauuaugcauccca

SEQ ID NO: 5825 - RNA, 19 nt, Artificial Sequence
  RNA Oligomer
acuagguuuuaggucccug

SEQ ID NO: 5826 - RNA, 19 nt, Artificial Sequence
  RNA Oligomer
ucgcaugaaugauggacug

SEQ ID NO: 5827 - RNA, 19 nt, Artificial Sequence
  RNA Oligomer
uucacagcuagauuacuag

SEQ ID NO: 5828 - RNA, 19 nt, Artificial Sequence
  RNA Oligomer
cuagguuuuaggucccugu

SEQ ID NO: 5829 - RNA, 19 nt, Artificial Sequence
  RNA Oligomer
agacagguucugguaacgc

SEQ ID NO: 5830 - RNA, 19 nt, Artificial Sequence
  RNA Oligomer
gacagguucugguaacgcu

SEQ ID NO: 5831 - RNA, 19 nt, Artificial Sequence
  RNA Oligomer
agaccucggagaauuuggu

SEQ ID NO: 5832 - RNA, 19 nt, Artificial Sequence
  RNA Oligomer
uucugacauuucacaaugu

SEQ ID NO: 5833 - RNA, 19 nt, Artificial Sequence
  RNA Oligomer
ugacauuucacaauguugu

SEQ ID NO: 5834 - RNA, 19 nt, Artificial Sequence
  RNA Oligomer
uugcagguguaaaaacguc

SEQ ID NO: 5835 - RNA, 19 nt, Artificial Sequence
  RNA Oligomer
ugcagguguaaaaacgucc

SEQ ID NO: 5836 - RNA, 19 nt, Artificial Sequence
  RNA Oligomer
aaaacguccaacagaccaa

SEQ ID NO: 5837 - RNA, 19 nt, Artificial Sequence
  RNA Oligomer
gauggacugaaauggucug

SEQ ID NO: 5838 - RNA, 19 nt, Artificial Sequence
  RNA Oligomer
uggacugaaauggucugga

SEQ ID NO: 5839 - RNA, 19 nt, Artificial Sequence
  RNA Oligomer
guuuuugugucaaaagcag

SEQ ID NO: 5840 - RNA, 19 nt, Artificial Sequence
  RNA Oligomer
uuuuugugucaaaagcagc

SEQ ID NO: 5841 - RNA, 19 nt, Artificial Sequence
  RNA Oligomer
uaaugcauccaguucagca

SEQ ID NO: 5842 - RNA, 19 nt, Artificial Sequence
  RNA Oligomer
uuaggucccugugaauuau

SEQ ID NO: 5843 - RNA, 19 nt, Artificial Sequence
  RNA Oligomer
gagacagguucugguaacg

SEQ ID NO: 5844 - RNA, 19 nt, Artificial Sequence
  RNA Oligomer
aaaaacguccaacagacca

SEQ ID NO: 5845 - RNA, 19 nt, Artificial Sequence
  RNA Oligomer
acguccaacagaccaauca

SEQ ID NO: 5846 - RNA, 19 nt, Artificial Sequence
  RNA Oligomer
aaccgcaguucucuguagg

SEQ ID NO: 5847 - RNA, 19 nt, Artificial Sequence
  RNA Oligomer
aauaucaacugucugguug

SEQ ID NO: 5848 - RNA, 19 nt, Artificial Sequence
  RNA Oligomer
ucugguuguaaugcaucca

SEQ ID NO: 5849 - RNA, 19 nt, Artificial Sequence
  RNA Oligomer
cugguuguaaugcauccag

SEQ ID NO: 5850 - RNA, 19 nt, Artificial Sequence
  RNA Oligomer
aaugcauccaguucagcau

SEQ ID NO: 5851 - RNA, 19 nt, Artificial Sequence
  RNA Oligomer
cugagacauuuuccagcgg

SEQ ID NO: 5852 - RNA, 19 nt, Artificial Sequence
  RNA Oligomer
uggagagcuucuucacugc

SEQ ID NO: 5853 - RNA, 19 nt, Artificial Sequence
  RNA Oligomer
augaucucaggagcccugu

SEQ ID NO: 5854 - RNA, 19 nt, Artificial Sequence
  RNA Oligomer
uugugucaaaagcagcaca

SEQ ID NO: 5855 - RNA, 19 nt, Artificial Sequence
  RNA Oligomer
ugcauccaguucagcauga

SEQ ID NO: 5856 - RNA, 19 nt, Artificial Sequence
  RNA Oligomer
uaaaaacguccaacagacc

SEQ ID NO: 5857 - RNA, 19 nt, Artificial Sequence
  RNA Oligomer
aaguaaccgcaguucucug

SEQ ID NO: 5858 - RNA, 19 nt, Artificial Sequence
  RNA Oligomer
ugugucaaaagcagcacac

SEQ ID NO: 5859 - RNA, 19 nt, Artificial Sequence
  RNA Oligomer
auaucaacugucugguugu

SEQ ID NO: 5860 - RNA, 19 nt, Artificial Sequence
  RNA Oligomer
guaaaaacguccaacagac

SEQ ID NO: 5861 - RNA, 19 nt, Artificial Sequence
  RNA Oligomer
gagagcuucuucacugcca

SEQ ID NO: 5862 - RNA, 19 nt, Artificial Sequence
  RNA Oligomer
auggucuguaccaggaaac

SEQ ID NO: 5863 - RNA, 19 nt, Artificial Sequence
  RNA Oligomer
cuggagagcuucuucacug

SEQ ID NO: 5864 - RNA, 19 nt, Artificial Sequence
  RNA Oligomer
acuggagacagguucuggu

SEQ ID NO: 5865 - RNA, 19 nt, Artificial Sequence
  RNA Oligomer
ccaauacugacccucuuua

SEQ ID NO: 5866 - RNA, 19 nt, Artificial Sequence
  RNA Oligomer
ccuucuuaaagccuuauuu

SEQ ID NO: 5867 - RNA, 19 nt, Artificial Sequence
  RNA Oligomer
ggagauuggugcuguaaaa

SEQ ID NO: 5868 - RNA, 19 nt, Artificial Sequence
  RNA Oligomer
cccuauccuauccgcaaac

SEQ ID NO: 5869 - RNA, 19 nt, Artificial Sequence
  RNA Oligomer
gggcauuuaauucaucuuu

SEQ ID NO: 5870 - RNA, 19 nt, Artificial Sequence
  RNA Oligomer
cgaguuuucugaccagcuu

SEQ ID NO: 5871 - RNA, 19 nt, Artificial Sequence
  RNA Oligomer
ggaguguuuuuacauugau

SEQ ID NO: 5872 - RNA, 19 nt, Artificial Sequence
  RNA Oligomer
gcagaauuguggaguguuu

SEQ ID NO: 5873 - RNA, 19 nt, Artificial Sequence
  RNA Oligomer
gguguaaaaaucauguguu

SEQ ID NO: 5874 - RNA, 19 nt, Artificial Sequence
  RNA Oligomer
gaacugcuauuuccucuaa

SEQ ID NO: 5875 - RNA, 19 nt, Artificial Sequence
  RNA Oligomer
gggaacuaaacuugaucuu

SEQ ID NO: 5876 - RNA, 19 nt, Artificial Sequence
  RNA Oligomer
accaauacugacccucuuu

SEQ ID NO: 5877 - RNA, 19 nt, Artificial Sequence
  RNA Oligomer
ugauuucauagcgaguuuu

SEQ ID NO: 5878 - RNA, 19 nt, Artificial Sequence
  RNA Oligomer
gugauuucauagcgaguuu

SEQ ID NO: 5879 - RNA, 19 nt, Artificial Sequence
  RNA Oligomer
guaguucucagaugcguaa

SEQ ID NO: 5880 - RNA, 19 nt, Artificial Sequence
  RNA Oligomer
ccuauccuauccgcaaaca

SEQ ID NO: 5881 - RNA, 19 nt, Artificial Sequence
  RNA Oligomer
cgcuuugccuauugauguu

SEQ ID NO: 5882 - RNA, 19 nt, Artificial Sequence
  RNA Oligomer
cgauuaguaaaagugcuuu

SEQ ID NO: 5883 - RNA, 19 nt, Artificial Sequence
  RNA Oligomer
ccuucugacugagcaauau

SEQ ID NO: 5884 - RNA, 19 nt, Artificial Sequence
  RNA Oligomer
cccuucugacugagcaaua

SEQ ID NO: 5885 - RNA, 19 nt, Artificial Sequence
  RNA Oligomer
ggaucagucuuugugauuu

SEQ ID NO: 5886 - RNA, 19 nt, Artificial Sequence
  RNA Oligomer
gccuauugauguuccuuug

SEQ ID NO: 5887 - RNA, 19 nt, Artificial Sequence
  RNA Oligomer
ugccuauugauguuccuuu

SEQ ID NO: 5888 - RNA, 19 nt, Artificial Sequence
  RNA Oligomer
caguguuugacgaagcgau

SEQ ID NO: 5889 - RNA, 19 nt, Artificial Sequence
  RNA Oligomer
guguaaaaaucauguguug

SEQ ID NO: 5890 - RNA, 19 nt, Artificial Sequence
  RNA Oligomer
gcuuuuccuuucucuuaca

SEQ ID NO: 5891 - RNA, 19 nt, Artificial Sequence
  RNA Oligomer
ggaaauguuuucuuaagcu

SEQ ID NO: 5892 - RNA, 19 nt, Artificial Sequence
  RNA Oligomer
agaugaugaaagaaagguu

SEQ ID NO: 5893 - RNA, 19 nt, Artificial Sequence
  RNA Oligomer
caguagaugaugaaagaaa

SEQ ID NO: 5894 - RNA, 19 nt, Artificial Sequence
  RNA Oligomer
gcaguagaugaugaaagaa

SEQ ID NO: 5895 - RNA, 19 nt, Artificial Sequence
  RNA Oligomer
acauuguacaaggaaugaa

SEQ ID NO: 5896 - RNA, 19 nt, Artificial Sequence
  RNA Oligomer
agaacugcuauuuccucua

SEQ ID NO: 5897 - RNA, 19 nt, Artificial Sequence
  RNA Oligomer
cagucuuugugauuucaua

SEQ ID NO: 5898 - RNA, 19 nt, Artificial Sequence
  RNA Oligomer
cagacucacauucuauuaa

SEQ ID NO: 5899 - RNA, 19 nt, Artificial Sequence
  RNA Oligomer
agauuggugcuguaaaaua

SEQ ID NO: 5900 - RNA, 19 nt, Artificial Sequence
  RNA Oligomer
gccacuacaacagaauuuu

SEQ ID NO: 5901 - RNA, 19 nt, Artificial Sequence
  RNA Oligomer
gguucuguaaacugugcua

SEQ ID NO: 5902 - RNA, 19 nt, Artificial Sequence
  RNA Oligomer
gggucugugagguucugua

SEQ ID NO: 5903 - RNA, 19 nt, Artificial Sequence
  RNA Oligomer
guaacuagguguaaaaauc

SEQ ID NO: 5904 - RNA, 19 nt, Artificial Sequence
  RNA Oligomer
ugggcauuuaauucaucuu

SEQ ID NO: 5905 - RNA, 19 nt, Artificial Sequence
  RNA Oligomer
gguauuaucaggaaauguu

SEQ ID NO: 5906 - RNA, 19 nt, Artificial Sequence
  RNA Oligomer
agguugguauuaucaggaa

SEQ ID NO: 5907 - RNA, 19 nt, Artificial Sequence
  RNA Oligomer
guacaaggaaugaaagugu

SEQ ID NO: 5908 - RNA, 19 nt, Artificial Sequence
  RNA Oligomer
aacugcuauuuccucuaau

SEQ ID NO: 5909 - RNA, 19 nt, Artificial Sequence
  RNA Oligomer
ccuauguaguucucagaug

SEQ ID NO: 5910 - RNA, 19 nt, Artificial Sequence
  RNA Oligomer
gauuaagaguugccaaaau

SEQ ID NO: 5911 - RNA, 19 nt, Artificial Sequence
  RNA Oligomer
uccugcaucauuugaaaau

SEQ ID NO: 5912 - RNA, 19 nt, Artificial Sequence
  RNA Oligomer
uaauuugcuuuucccuugu

SEQ ID NO: 5913 - RNA, 19 nt, Artificial Sequence
  RNA Oligomer
gaauuguggaguguuuuua

SEQ ID NO: 5914 - RNA, 19 nt, Artificial Sequence
  RNA Oligomer
ccacuacaacagaauuuuu

SEQ ID NO: 5915 - RNA, 19 nt, Artificial Sequence
  RNA Oligomer
cugacgauguucuguacaa

SEQ ID NO: 5916 - RNA, 19 nt, Artificial Sequence
  RNA Oligomer
agguguaaaaaucaugugu

SEQ ID NO: 5917 - RNA, 19 nt, Artificial Sequence
  RNA Oligomer
cuagguguaaaaaucaugu

SEQ ID NO: 5918 - RNA, 19 nt, Artificial Sequence
  RNA Oligomer
ugcuuuccuuaguuuucua

SEQ ID NO: 5919 - RNA, 19 nt, Artificial Sequence
  RNA Oligomer
agcuuuuccuuucucuuac

SEQ ID NO: 5920 - RNA, 19 nt, Artificial Sequence
  RNA Oligomer
gguugguauuaucaggaaa

SEQ ID NO: 5921 - RNA, 19 nt, Artificial Sequence
  RNA Oligomer
gaaagaaagguugguauua

SEQ ID NO: 5922 - RNA, 19 nt, Artificial Sequence
  RNA Oligomer
gucaaaugcaguagaugau

SEQ ID NO: 5923 - RNA, 19 nt, Artificial Sequence
  RNA Oligomer
ugcuauuuccucuaaugaa

SEQ ID NO: 5924 - RNA, 19 nt, Artificial Sequence
  RNA Oligomer
ucagucuuugugauuucau

SEQ ID NO: 5925 - RNA, 19 nt, Artificial Sequence
  RNA Oligomer
cuucugaacuacacugcau

SEQ ID NO: 5926 - RNA, 19 nt, Artificial Sequence
  RNA Oligomer
accauuuuuugaaccaauc

SEQ ID NO: 5927 - RNA, 19 nt, Artificial Sequence
  RNA Oligomer
agacaguguuugacgaagc

SEQ ID NO: 5928 - RNA, 19 nt, Artificial Sequence
  RNA Oligomer
aggagauuggugcuguaaa

SEQ ID NO: 5929 - RNA, 19 nt, Artificial Sequence
  RNA Oligomer
gugcugacgauguucugua

SEQ ID NO: 5930 - RNA, 19 nt, Artificial Sequence
  RNA Oligomer
ccuuaguuuucuaguaacu

SEQ ID NO: 5931 - RNA, 19 nt, Artificial Sequence
  RNA Oligomer
ucgauuaguaaaagugcuu

SEQ ID NO: 5932 - RNA, 19 nt, Artificial Sequence
  RNA Oligomer
caauaugccuccuuguauu

SEQ ID NO: 5933 - RNA, 19 nt, Artificial Sequence
  RNA Oligomer
gcaauaugccuccuuguau

SEQ ID NO: 5934 - RNA, 19 nt, Artificial Sequence
  RNA Oligomer
guugguauuaucaggaaau

SEQ ID NO: 5935 - RNA, 19 nt, Artificial Sequence
  RNA Oligomer
ugaaagaaagguugguauu

SEQ ID NO: 5936 - RNA, 19 nt, Artificial Sequence
  RNA Oligomer
ugcaguagaugaugaaaga

SEQ ID NO: 5937 - RNA, 19 nt, Artificial Sequence
  RNA Oligomer
cauuguacaaggaaugaaa

SEQ ID NO: 5938 - RNA, 19 nt, Artificial Sequence
  RNA Oligomer
acugcuauuuccucuaaug

SEQ ID NO: 5939 - RNA, 19 nt, Artificial Sequence
  RNA Oligomer
gcggagauuuugaacagaa

SEQ ID NO: 5940 - RNA, 19 nt, Artificial Sequence
  RNA Oligomer
ugugauuucauagcgaguu

SEQ ID NO: 5941 - RNA, 19 nt, Artificial Sequence
  RNA Oligomer
uccuauguaguucucagau

SEQ ID NO: 5942 - RNA, 19 nt, Artificial Sequence
  RNA Oligomer
cuccuauguaguucucaga

SEQ ID NO: 5943 - RNA, 19 nt, Artificial Sequence
  RNA Oligomer
aaaaugacaagccuucuua

SEQ ID NO: 5944 - RNA, 19 nt, Artificial Sequence
  RNA Oligomer
ccaaucaguaauuuuaagg

SEQ ID NO: 5945 - RNA, 19 nt, Artificial Sequence
  RNA Oligomer
gagauuggugcuguaaaau

SEQ ID NO: 5946 - RNA, 19 nt, Artificial Sequence
  RNA Oligomer
ccuugugaguccugcauca

SEQ ID NO: 5947 - RNA, 19 nt, Artificial Sequence
  RNA Oligomer
agaauuguggaguguuuuu

SEQ ID NO: 5948 - RNA, 19 nt, Artificial Sequence
  RNA Oligomer
agccacuacaacagaauuu

SEQ ID NO: 5949 - RNA, 19 nt, Artificial Sequence
  RNA Oligomer
ucagccacuacaacagaau

SEQ ID NO: 5950 - RNA, 19 nt, Artificial Sequence
  RNA Oligomer
cugugagguucuguaaacu

SEQ ID NO: 5951 - RNA, 19 nt, Artificial Sequence
  RNA Oligomer
uccuuaguuuucuaguaac

SEQ ID NO: 5952 - RNA, 19 nt, Artificial Sequence
  RNA Oligomer
caggaaauguuuucuuaag

SEQ ID NO: 5953 - RNA, 19 nt, Artificial Sequence
  RNA Oligomer
cuacauuguacaaggaaug

SEQ ID NO: 5954 - RNA, 19 nt, Artificial Sequence
  RNA Oligomer
cugcuauuuccucuaauga

SEQ ID NO: 5955 - RNA, 19 nt, Artificial Sequence
  RNA Oligomer
aguuuucugaccagcuuuu

SEQ ID NO: 5956 - RNA, 19 nt, Artificial Sequence
  RNA Oligomer
cacugaacuuugcaaagac

SEQ ID NO: 5957 - RNA, 19 nt, Artificial Sequence
  RNA Oligomer
uaaaaugacaagccuucuu

SEQ ID NO: 5958 - RNA, 19 nt, Artificial Sequence
  RNA Oligomer
uaaggagauuggugcugua

SEQ ID NO: 5959 - RNA, 19 nt, Artificial Sequence
  RNA Oligomer
ccauggcuaaggagauugg

SEQ ID NO: 5960 - RNA, 19 nt, Artificial Sequence
  RNA Oligomer
ugggaacuaaacuugaucu

SEQ ID NO: 5961 - RNA, 19 nt, Artificial Sequence
  RNA Oligomer
gugggaacuaaacuugauc

SEQ ID NO: 5962 - RNA, 19 nt, Artificial Sequence
  RNA Oligomer
gaguccugcaucauuugaa

SEQ ID NO: 5963 - RNA, 19 nt, Artificial Sequence
  RNA Oligomer
uguuuugcauguaugacuu

SEQ ID NO: 5964 - RNA, 19 nt, Artificial Sequence
  RNA Oligomer
uggaguguuuuuacauuga

SEQ ID NO: 5965 - RNA, 19 nt, Artificial Sequence
  RNA Oligomer
cuagugcugacgauguucu

SEQ ID NO: 5966 - RNA, 19 nt, Artificial Sequence
  RNA Oligomer
ucugugagguucuguaaac

SEQ ID NO: 5967 - RNA, 19 nt, Artificial Sequence
  RNA Oligomer
gucugugagguucuguaaa

SEQ ID NO: 5968 - RNA, 19 nt, Artificial Sequence
  RNA Oligomer
ggucugugagguucuguaa

SEQ ID NO: 5969 - RNA, 19 nt, Artificial Sequence
  RNA Oligomer
gcuuugccuauugauguuc

SEQ ID NO: 5970 - RNA, 19 nt, Artificial Sequence
  RNA Oligomer
ucuuaagcuuuuccuuucu

SEQ ID NO: 5971 - RNA, 19 nt, Artificial Sequence
  RNA Oligomer
caaaugcaguagaugauga

SEQ ID NO: 5972 - RNA, 19 nt, Artificial Sequence
  RNA Oligomer
acacuacauuguacaagga

SEQ ID NO: 5973 - RNA, 19 nt, Artificial Sequence
  RNA Oligomer
gaguuuucugaccagcuuu

SEQ ID NO: 5974 - RNA, 19 nt, Artificial Sequence
  RNA Oligomer
gacauaacauuguacugua

SEQ ID NO: 5975 - RNA, 19 nt, Artificial Sequence
  RNA Oligomer
cgacauaacauuguacugu

SEQ ID NO: 5976 - RNA, 19 nt, Artificial Sequence
  RNA Oligomer
cccgacauaacauuguacu

SEQ ID NO: 5977 - RNA, 19 nt, Artificial Sequence
  RNA Oligomer
gcucuccuauguaguucuc

SEQ ID NO: 5978 - RNA, 19 nt, Artificial Sequence
  RNA Oligomer
ugaacuacacugcauuguu

SEQ ID NO: 5979 - RNA, 19 nt, Artificial Sequence
  RNA Oligomer
uucugaacuacacugcauu

SEQ ID NO: 5980 - RNA, 19 nt, Artificial Sequence
  RNA Oligomer
ccuaaaaugacaagccuuc

SEQ ID NO: 5981 - RNA, 19 nt, Artificial Sequence
  RNA Oligomer
ggaagagaaaaugccugcu

SEQ ID NO: 5982 - RNA, 19 nt, Artificial Sequence
  RNA Oligomer
gaguguuuuuacauugauc

SEQ ID NO: 5983 - RNA, 19 nt, Artificial Sequence
  RNA Oligomer
guggaguguuuuuacauug

SEQ ID NO: 5984 - RNA, 19 nt, Artificial Sequence
  RNA Oligomer
uguggaguguuuuuacauu

SEQ ID NO: 5985 - RNA, 19 nt, Artificial Sequence
  RNA Oligomer
cagaauuguggaguguuuu

SEQ ID NO: 5986 - RNA, 19 nt, Artificial Sequence
  RNA Oligomer
ugcugacgauguucuguac

SEQ ID NO: 5987 - RNA, 19 nt, Artificial Sequence
  RNA Oligomer
agguucuguaaacugugcu

SEQ ID NO: 5988 - RNA, 19 nt, Artificial Sequence
  RNA Oligomer
gugagguucuguaaacugu

SEQ ID NO: 5989 - RNA, 19 nt, Artificial Sequence
  RNA Oligomer
cuauugauguuccuuuggg

SEQ ID NO: 5990 - RNA, 19 nt, Artificial Sequence
  RNA Oligomer
gcuuuccuuaguuuucuag

SEQ ID NO: 5991 - RNA, 19 nt, Artificial Sequence
  RNA Oligomer
gugcuuuccuuaguuuucu

SEQ ID NO: 5992 - RNA, 19 nt, Artificial Sequence
  RNA Oligomer
gucgauuaguaaaagugcu

SEQ ID NO: 5993 - RNA, 19 nt, Artificial Sequence
  RNA Oligomer
cuuaagcuuuuccuuucuc

SEQ ID NO: 5994 - RNA, 19 nt, Artificial Sequence
  RNA Oligomer
augaaagaaagguugguau

SEQ ID NO: 5995 - RNA, 19 nt, Artificial Sequence
  RNA Oligomer
aaaugcaguagaugaugaa

SEQ ID NO: 5996 - RNA, 19 nt, Artificial Sequence
  RNA Oligomer
acuacauuguacaaggaau

SEQ ID NO: 5997 - RNA, 19 nt, Artificial Sequence
  RNA Oligomer
ugugugaucaaaggacaaa

SEQ ID NO: 5998 - RNA, 19 nt, Artificial Sequence
  RNA Oligomer
gaucagucuuugugauuuc

SEQ ID NO: 5999 - RNA, 19 nt, Artificial Sequence
  RNA Oligomer
augaagcguugccauugaa

SEQ ID NO: 6000 - RNA, 19 nt, Artificial Sequence
  RNA Oligomer
gaacuuugcaaagaccuuc

SEQ ID NO: 6001 - RNA, 19 nt, Artificial Sequence
  RNA Oligomer
gaacuacacugcauuguug

SEQ ID NO: 6002 - RNA, 19 nt, Artificial Sequence
  RNA Oligomer
cugaacuacacugcauugu

SEQ ID NO: 6003 - RNA, 19 nt, Artificial Sequence
  RNA Oligomer
gccugcuguuguaaauguc

SEQ ID NO: 6004 - RNA, 19 nt, Artificial Sequence
  RNA Oligomer
cuaaggagauuggugcugu

SEQ ID NO: 6005 - RNA, 19 nt, Artificial Sequence
  RNA Oligomer
uaaacuugaucuuagggau

SEQ ID NO: 6006 - RNA, 19 nt, Artificial Sequence
  RNA Oligomer
guccugcaucauuugaaaa

SEQ ID NO: 6007 - RNA, 19 nt, Artificial Sequence
  RNA Oligomer
ccuuugggucugugagguu

SEQ ID NO: 6008 - RNA, 19 nt, Artificial Sequence
  RNA Oligomer
guagucgcuuugccuauug

SEQ ID NO: 6009 - RNA, 19 nt, Artificial Sequence
  RNA Oligomer
aucauguguugcagcuuua

SEQ ID NO: 6010 - RNA, 19 nt, Artificial Sequence
  RNA Oligomer
uugguauuaucaggaaaug

SEQ ID NO: 6011 - RNA, 19 nt, Artificial Sequence
  RNA Oligomer
gaugaaagaaagguuggua

SEQ ID NO: 6012 - RNA, 19 nt, Artificial Sequence
  RNA Oligomer
ugaugaaagaaagguuggu

SEQ ID NO: 6013 - RNA, 19 nt, Artificial Sequence
  RNA Oligomer
cacuacauuguacaaggaa

SEQ ID NO: 6014 - RNA, 19 nt, Artificial Sequence
  RNA Oligomer
gugugugaucaaaggacaa

SEQ ID NO: 6015 - RNA, 19 nt, Artificial Sequence
  RNA Oligomer
cggagauuuugaacagaac

SEQ ID NO: 6016 - RNA, 19 nt, Artificial Sequence
  RNA Oligomer
uggaucagucuuugugauu

SEQ ID NO: 6017 - RNA, 19 nt, Artificial Sequence
  RNA Oligomer
cuguaauggagugagcgua

SEQ ID NO: 6018 - RNA, 19 nt, Artificial Sequence
  RNA Oligomer
ugaguuagcagcacguguu

SEQ ID NO: 6019 - RNA, 19 nt, Artificial Sequence
  RNA Oligomer
guaaaacuugccuacugau

SEQ ID NO: 6020 - RNA, 19 nt, Artificial Sequence
  RNA Oligomer
ccuuauuuuucaaaagcgc

SEQ ID NO: 6021 - RNA, 19 nt, Artificial Sequence
  RNA Oligomer
ugccugcuguuguaaaugu

SEQ ID NO: 6022 - RNA, 19 nt, Artificial Sequence
  RNA Oligomer
ugaucuuagggaugauaaa

SEQ ID NO: 6023 - RNA, 19 nt, Artificial Sequence
  RNA Oligomer
ugcagaauuguggaguguu

SEQ ID NO: 6024 - RNA, 19 nt, Artificial Sequence
  RNA Oligomer
uaaauugacaguugcagaa

SEQ ID NO: 6025 - RNA, 19 nt, Artificial Sequence
  RNA Oligomer
ccuucagccacuacaacag

SEQ ID NO: 6026 - RNA, 19 nt, Artificial Sequence
  RNA Oligomer
cccuucagccacuacaaca

SEQ ID NO: 6027 - RNA, 19 nt, Artificial Sequence
  RNA Oligomer
cuguacaacuuaacucacu

SEQ ID NO: 6028 - RNA, 19 nt, Artificial Sequence
  RNA Oligomer
gaaccuucuuaacaucacu

SEQ ID NO: 6029 - RNA, 19 nt, Artificial Sequence
  RNA Oligomer
ugaaccuucuuaacaucac

SEQ ID NO: 6030 - RNA, 19 nt, Artificial Sequence
  RNA Oligomer
ucauguguugcagcuuuau

SEQ ID NO: 6031 - RNA, 19 nt, Artificial Sequence
  RNA Oligomer
gggugugugugaucaaagg

SEQ ID NO: 6032 - RNA, 19 nt, Artificial Sequence
  RNA Oligomer
ugcucuccuauguaguucu

SEQ ID NO: 6033 - RNA, 19 nt, Artificial Sequence
  RNA Oligomer
gacacuugcucuccuaugu

SEQ ID NO: 6034 - RNA, 19 nt, Artificial Sequence
  RNA Oligomer
gccuucuuaaagccuuauu

SEQ ID NO: 6035 - RNA, 19 nt, Artificial Sequence
  RNA Oligomer
gcuguuguaaaugucucag

SEQ ID NO: 6036 - RNA, 19 nt, Artificial Sequence
  RNA Oligomer
gcuaaggagauuggugcug

SEQ ID NO: 6037 - RNA, 19 nt, Artificial Sequence
  RNA Oligomer
ggcuaaggagauuggugcu

SEQ ID NO: 6038 - RNA, 19 nt, Artificial Sequence
  RNA Oligomer
cuugaucuuagggaugaua

SEQ ID NO: 6039 - RNA, 19 nt, Artificial Sequence
  RNA Oligomer
acuugaucuuagggaugau

SEQ ID NO: 6040 - RNA, 19 nt, Artificial Sequence
  RNA Oligomer
cauugaucuuuugcuaaug

SEQ ID NO: 6041 - RNA, 19 nt, Artificial Sequence
  RNA Oligomer
cagccacuacaacagaauu

SEQ ID NO: 6042 - RNA, 19 nt, Artificial Sequence
  RNA Oligomer
caacuuaacucacuggcga

SEQ ID NO: 6043 - RNA, 19 nt, Artificial Sequence
  RNA Oligomer
gccuccuuguauuauaaaa

SEQ ID NO: 6044 - RNA, 19 nt, Artificial Sequence
  RNA Oligomer
aggaaauguuuucuuaagc

SEQ ID NO: 6045 - RNA, 19 nt, Artificial Sequence
  RNA Oligomer
agaauucuguuuagcugug

SEQ ID NO: 6046 - RNA, 19 nt, Artificial Sequence
  RNA Oligomer
ggagauuuugaacagaacu

SEQ ID NO: 6047 - RNA, 19 nt, Artificial Sequence
  RNA Oligomer
uuggaucagucuuugugau

SEQ ID NO: 6048 - RNA, 19 nt, Artificial Sequence
  RNA Oligomer
acauuguacuguaauggag

SEQ ID NO: 6049 - RNA, 19 nt, Artificial Sequence
  RNA Oligomer
ccgacauaacauuguacug

SEQ ID NO: 6050 - RNA, 19 nt, Artificial Sequence
  RNA Oligomer
cagugaguuagcagcacgu

SEQ ID NO: 6051 - RNA, 19 nt, Artificial Sequence
  RNA Oligomer
cacuugcucuccuauguag

SEQ ID NO: 6052 - RNA, 19 nt, Artificial Sequence
  RNA Oligomer
ugcuguuguaaaugucuca

SEQ ID NO: 6053 - RNA, 19 nt, Artificial Sequence
  RNA Oligomer
uguagucgcuuugccuauu

SEQ ID NO: 6054 - RNA, 19 nt, Artificial Sequence
  RNA Oligomer
guaaaaaucauguguugca

SEQ ID NO: 6055 - RNA, 19 nt, Artificial Sequence
  RNA Oligomer
gaagaauucuguuuagcug

SEQ ID NO: 6056 - RNA, 19 nt, Artificial Sequence
  RNA Oligomer
gagauuuugaacagaacug

SEQ ID NO: 6057 - RNA, 19 nt, Artificial Sequence
  RNA Oligomer
ucagcucuuuggaucaguc

SEQ ID NO: 6058 - RNA, 19 nt, Artificial Sequence
  RNA Oligomer
gcucagcucuuuggaucag

SEQ ID NO: 6059 - RNA, 19 nt, Artificial Sequence
  RNA Oligomer
ucccgacauaacauuguac

SEQ ID NO: 6060 - RNA, 19 nt, Artificial Sequence
  RNA Oligomer
cagacacuugcucuccuau

SEQ ID NO: 6061 - RNA, 19 nt, Artificial Sequence
  RNA Oligomer
cugcuguuguaaaugucuc

SEQ ID NO: 6062 - RNA, 19 nt, Artificial Sequence
  RNA Oligomer
ugcuguaaaauaccuggag

SEQ ID NO: 6063 - RNA, 19 nt, Artificial Sequence
  RNA Oligomer
gugcuguaaaauaccugga

SEQ ID NO: 6064 - RNA, 19 nt, Artificial Sequence
  RNA Oligomer
ugcggagauuuugaacaga

SEQ ID NO: 6065 - RNA, 19 nt, Artificial Sequence
  RNA Oligomer
cucagcucuuuggaucagu

SEQ ID NO: 6066 - RNA, 19 nt, Artificial Sequence
  RNA Oligomer
uucccgacauaacauugua

SEQ ID NO: 6067 - RNA, 19 nt, Artificial Sequence
  RNA Oligomer
caagacaguguuugacgaa

SEQ ID NO: 6068 - RNA, 19 nt, Artificial Sequence
  RNA Oligomer
gcauuauguuuugcaugua

SEQ ID NO: 6069 - RNA, 19 nt, Artificial Sequence
  RNA Oligomer
cuguagucgcuuugccuau

SEQ ID NO: 6070 - RNA, 19 nt, Artificial Sequence
  RNA Oligomer
cuguuuagcugugggugug

SEQ ID NO: 6071 - RNA, 19 nt, Artificial Sequence
  RNA Oligomer
cuuuugcggagauuuugaa

SEQ ID NO: 6072 - RNA, 19 nt, Artificial Sequence
  RNA Oligomer
agcucuuuggaucagucuu

SEQ ID NO: 6073 - RNA, 19 nt, Artificial Sequence
  RNA Oligomer
guacuguaauggagugagc

SEQ ID NO: 6074 - RNA, 19 nt, Artificial Sequence
  RNA Oligomer
cgaaugaagcguugccauu

SEQ ID NO: 6075 - RNA, 19 nt, Artificial Sequence
  RNA Oligomer
caaaauaccuucugaacua

SEQ ID NO: 6076 - RNA, 19 nt, Artificial Sequence
  RNA Oligomer
agaguugccaaaauaccuu

SEQ ID NO: 6077 - RNA, 19 nt, Artificial Sequence
  RNA Oligomer
ccuguagucgcuuugccua

SEQ ID NO: 6078 - RNA, 19 nt, Artificial Sequence
  RNA Oligomer
gaccaauacugacccucuu

SEQ ID NO: 6079 - RNA, 19 nt, Artificial Sequence
  RNA Oligomer
ugaagaauucuguuuagcu

SEQ ID NO: 6080 - RNA, 19 nt, Artificial Sequence
  RNA Oligomer
ucagaugcguaaagcagaa

SEQ ID NO: 6081 - RNA, 19 nt, Artificial Sequence
  RNA Oligomer
ugccaaaauaccuucugaa

SEQ ID NO: 6082 - RNA, 19 nt, Artificial Sequence
  RNA Oligomer
ucaagacaguguuugacga

SEQ ID NO: 6083 - RNA, 19 nt, Artificial Sequence
  RNA Oligomer
agaagaagcugacucccau

SEQ ID NO: 6084 - RNA, 19 nt, Artificial Sequence
  RNA Oligomer
uagauggaaaaccggugaa

SEQ ID NO: 6085 - RNA, 19 nt, Artificial Sequence
  RNA Oligomer
guagauggaaaaccgguga

SEQ ID NO: 6086 - RNA, 19 nt, Artificial Sequence
  RNA Oligomer
cacugucacuugaccaaua

SEQ ID NO: 6087 - RNA, 19 nt, Artificial Sequence
  RNA Oligomer
cccaaauugggcauuuaau

SEQ ID NO: 6088 - RNA, 19 nt, Artificial Sequence
  RNA Oligomer
ccgaaugaagcguugccau

SEQ ID NO: 6089 - RNA, 19 nt, Artificial Sequence
  RNA Oligomer
agccuucuuaaagccuuau

SEQ ID NO: 6090 - RNA, 19 nt, Artificial Sequence
  RNA Oligomer
aagaagaggaagagaaaau

SEQ ID NO: 6091 - RNA, 19 nt, Artificial Sequence
  RNA Oligomer
ugaaggagaagaagcugac

SEQ ID NO: 6092 - RNA, 19 nt, Artificial Sequence
  RNA Oligomer
cgauguucuguacaacuua

SEQ ID NO: 6093 - RNA, 19 nt, Artificial Sequence
  RNA Oligomer
cuaguaacuagguguaaaa

SEQ ID NO: 6094 - RNA, 19 nt, Artificial Sequence
  RNA Oligomer
ccaaauugggcauuuaauu

SEQ ID NO: 6095 - RNA, 19 nt, Artificial Sequence
  RNA Oligomer
gcucuuuggaucagucuuu

SEQ ID NO: 6096 - RNA, 19 nt, Artificial Sequence
  RNA Oligomer
gagcacugaacuuugcaaa

SEQ ID NO: 6097 - RNA, 19 nt, Artificial Sequence
  RNA Oligomer
cagauuaagaguugccaaa

SEQ ID NO: 6098 - RNA, 19 nt, Artificial Sequence
  RNA Oligomer
caagccuucuuaaagccuu

SEQ ID NO: 6099 - RNA, 19 nt, Artificial Sequence
  RNA Oligomer
agagaaaaugccugcuguu

SEQ ID NO: 6100 - RNA, 19 nt, Artificial Sequence
  RNA Oligomer
agaagaggaagagaaaaug

SEQ ID NO: 6101 - RNA, 19 nt, Artificial Sequence
  RNA Oligomer
gaagaagaggaagagaaaa

SEQ ID NO: 6102 - RNA, 19 nt, Artificial Sequence
  RNA Oligomer
acgauguucuguacaacuu

SEQ ID NO: 6103 - RNA, 19 nt, Artificial Sequence
  RNA Oligomer
cugugcuagugcugacgau

SEQ ID NO: 6104 - RNA, 19 nt, Artificial Sequence
  RNA Oligomer
ugccuccuuguauuauaaa

SEQ ID NO: 6105 - RNA, 19 nt, Artificial Sequence
  RNA Oligomer
ccaaaauaccuucugaacu

SEQ ID NO: 6106 - RNA, 19 nt, Artificial Sequence
  RNA Oligomer
gccaaaauaccuucugaac

SEQ ID NO: 6107 - RNA, 19 nt, Artificial Sequence
  RNA Oligomer
agauuaagaguugccaaaa

SEQ ID NO: 6108 - RNA, 19 nt, Artificial Sequence
  RNA Oligomer
gaagagaaaaugccugcug

SEQ ID NO: 6109 - RNA, 19 nt, Artificial Sequence
  RNA Oligomer
cgaucgagaaacugaagga

SEQ ID NO: 6110 - RNA, 19 nt, Artificial Sequence
  RNA Oligomer
augccuccuuguauuauaa

SEQ ID NO: 6111 - RNA, 19 nt, Artificial Sequence
  RNA Oligomer
ccugucccuuggaaccuuu

SEQ ID NO: 6112 - RNA, 19 nt, Artificial Sequence
  RNA Oligomer
cgagaaacugaaggagaag

SEQ ID NO: 6113 - RNA, 19 nt, Artificial Sequence
  RNA Oligomer
agauggaaaaccggugaau

SEQ ID NO: 6114 - RNA, 19 nt, Artificial Sequence
  RNA Oligomer
gcuaaugcaauuagcauua

SEQ ID NO: 6115 - RNA, 19 nt, Artificial Sequence
  RNA Oligomer
ugauguuccuuugggucug

SEQ ID NO: 6116 - RNA, 19 nt, Artificial Sequence
  RNA Oligomer
gacacugucacuugaccaa

SEQ ID NO: 6117 - RNA, 19 nt, Artificial Sequence
  RNA Oligomer
gugugugugaucaaaggac

SEQ ID NO: 6118 - RNA, 19 nt, Artificial Sequence
  RNA Oligomer
gaccagcuuuugcggagau

SEQ ID NO: 6119 - RNA, 19 nt, Artificial Sequence
  RNA Oligomer
cguagcagcucagcucuuu

SEQ ID NO: 6120 - RNA, 19 nt, Artificial Sequence
  RNA Oligomer
ccauugaacucaccaguga

SEQ ID NO: 6121 - RNA, 19 nt, Artificial Sequence
  RNA Oligomer
gcguugccauugaacucac

SEQ ID NO: 6122 - RNA, 19 nt, Artificial Sequence
  RNA Oligomer
gcacugaacuuugcaaaga

SEQ ID NO: 6123 - RNA, 19 nt, Artificial Sequence
  RNA Oligomer
aagccuucuuaaagccuua

SEQ ID NO: 6124 - RNA, 19 nt, Artificial Sequence
  RNA Oligomer
ucauccuagugggaacuaa

SEQ ID NO: 6125 - RNA, 19 nt, Artificial Sequence
  RNA Oligomer
ucccuugugaguccugcau

SEQ ID NO: 6126 - RNA, 19 nt, Artificial Sequence
  RNA Oligomer
agcauuauguuuugcaugu

SEQ ID NO: 6127 - RNA, 19 nt, Artificial Sequence
  RNA Oligomer
gauguucuguacaacuuaa

SEQ ID NO: 6128 - RNA, 19 nt, Artificial Sequence
  RNA Oligomer
acugucacuugaccaauac

SEQ ID NO: 6129 - RNA, 19 nt, Artificial Sequence
  RNA Oligomer
ucagauuaagaguugccaa

SEQ ID NO: 6130 - RNA, 19 nt, Artificial Sequence
  RNA Oligomer
agguaaaacuugccuacug

SEQ ID NO: 6131 - RNA, 19 nt, Artificial Sequence
  RNA Oligomer
uccugucccuuggaaccuu

SEQ ID NO: 6132 - RNA, 19 nt, Artificial Sequence
  RNA Oligomer
ccaucauccuagugggaac

SEQ ID NO: 6133 - RNA, 19 nt, Artificial Sequence
  RNA Oligomer
uuaacucacuggcgagaau

SEQ ID NO: 6134 - RNA, 19 nt, Artificial Sequence
  RNA Oligomer
ugcuagugcugacgauguu

SEQ ID NO: 6135 - RNA, 19 nt, Artificial Sequence
  RNA Oligomer
acacugucacuugaccaau

SEQ ID NO: 6136 - RNA, 19 nt, Artificial Sequence
  RNA Oligomer
cgacacugucacuugacca

SEQ ID NO: 6137 - RNA, 19 nt, Artificial Sequence
  RNA Oligomer
ucacugucuugccagauua

SEQ ID NO: 6138 - RNA, 19 nt, Artificial Sequence
  RNA Oligomer
caaggaaugaaagugucac

SEQ ID NO: 6139 - RNA, 19 nt, Artificial Sequence
  RNA Oligomer
cuacugaucaguuacacaa

SEQ ID NO: 6140 - RNA, 19 nt, Artificial Sequence
  RNA Oligomer
gccuacugaucaguuacac

SEQ ID NO: 6141 - RNA, 19 nt, Artificial Sequence
  RNA Oligomer
gcagacacuugcucuccua

SEQ ID NO: 6142 - RNA, 19 nt, Artificial Sequence
  RNA Oligomer
uucagacucacauucuauu

SEQ ID NO: 6143 - RNA, 19 nt, Artificial Sequence
  RNA Oligomer
ccauuuuuugaaccaauca

SEQ ID NO: 6144 - RNA, 19 nt, Artificial Sequence
  RNA Oligomer
ucgcacucaaugccaacuu

SEQ ID NO: 6145 - RNA, 19 nt, Artificial Sequence
  RNA Oligomer
gucuagccauggcuaagga

SEQ ID NO: 6146 - RNA, 19 nt, Artificial Sequence
  RNA Oligomer
gaacuaaacuugaucuuag

SEQ ID NO: 6147 - RNA, 19 nt, Artificial Sequence
  RNA Oligomer
ccuagugggaacuaaacuu

SEQ ID NO: 6148 - RNA, 19 nt, Artificial Sequence
  RNA Oligomer
cuuuugcuaaugcaauuag

SEQ ID NO: 6149 - RNA, 19 nt, Artificial Sequence
  RNA Oligomer
ucuaguaacuagguguaaa

SEQ ID NO: 6150 - RNA, 19 nt, Artificial Sequence
  RNA Oligomer
ucugucaaaugcaguagau

SEQ ID NO: 6151 - RNA, 19 nt, Artificial Sequence
  RNA Oligomer
cagcuuuugcggagauuuu

SEQ ID NO: 6152 - RNA, 19 nt, Artificial Sequence
  RNA Oligomer
cuugccuacugaucaguua

SEQ ID NO: 6153 - RNA, 19 nt, Artificial Sequence
  RNA Oligomer
gccuuauuuuucaaaagcg

SEQ ID NO: 6154 - RNA, 19 nt, Artificial Sequence
  RNA Oligomer
gcccuaaaaugacaagccu

SEQ ID NO: 6155 - RNA, 19 nt, Artificial Sequence
  RNA Oligomer
ucagacucacauucuauua

SEQ ID NO: 6156 - RNA, 19 nt, Artificial Sequence
  RNA Oligomer
ugcuaaugcaauuagcauu

SEQ ID NO: 6157 - RNA, 19 nt, Artificial Sequence
  RNA Oligomer
gcuauuuccucuaaugaag

SEQ ID NO: 6158 - RNA, 19 nt, Artificial Sequence
  RNA Oligomer
uugaacagaacugcuauuu

SEQ ID NO: 6159 - RNA, 19 nt, Artificial Sequence
  RNA Oligomer
ugaccagcuuuugcggaga

SEQ ID NO: 6160 - RNA, 19 nt, Artificial Sequence
  RNA Oligomer
cucuuuggaucagucuuug

SEQ ID NO: 6161 - RNA, 19 nt, Artificial Sequence
  RNA Oligomer
ugacaagccuucuuaaagc

SEQ ID NO: 6162 - RNA, 19 nt, Artificial Sequence
  RNA Oligomer
cccuaaaaugacaagccuu

SEQ ID NO: 6163 - RNA, 19 nt, Artificial Sequence
  RNA Oligomer
uaagaguucagacucacau

SEQ ID NO: 6164 - RNA, 19 nt, Artificial Sequence
  RNA Oligomer
cgcacucaaugccaacuuu

SEQ ID NO: 6165 - RNA, 19 nt, Artificial Sequence
  RNA Oligomer
cugacucccaucaccuauc

SEQ ID NO: 6166 - RNA, 19 nt, Artificial Sequence
  RNA Oligomer
gcugacucccaucaccuau

SEQ ID NO: 6167 - RNA, 19 nt, Artificial Sequence
  RNA Oligomer
ugaacagaacugcuauuuc

SEQ ID NO: 6168 - RNA, 19 nt, Artificial Sequence
  RNA Oligomer
ccagcuuuugcggagauuu

SEQ ID NO: 6169 - RNA, 19 nt, Artificial Sequence
  RNA Oligomer
gccauugaacucaccagug

SEQ ID NO: 6170 - RNA, 19 nt, Artificial Sequence
  RNA Oligomer
agcguugccauugaacuca

SEQ ID NO: 6171 - RNA, 19 nt, Artificial Sequence
  RNA Oligomer
ccuucgucuuugagaagac

SEQ ID NO: 6172 - RNA, 19 nt, Artificial Sequence
  RNA Oligomer
agaccuucgucuuugagaa

SEQ ID NO: 6173 - RNA, 19 nt, Artificial Sequence
  RNA Oligomer
gcaaagaccuucgucuuug

SEQ ID NO: 6174 - RNA, 19 nt, Artificial Sequence
  RNA Oligomer
agccuuauuuuucaaaagc

SEQ ID NO: 6175 - RNA, 19 nt, Artificial Sequence
  RNA Oligomer
gccauggcuaaggagauug

SEQ ID NO: 6176 - RNA, 19 nt, Artificial Sequence
  RNA Oligomer
agccauggcuaaggagauu

SEQ ID NO: 6177 - RNA, 19 nt, Artificial Sequence
  RNA Oligomer
cuagugggaacuaaacuug

SEQ ID NO: 6178 - RNA, 19 nt, Artificial Sequence
  RNA Oligomer
uucuuaacaucacugucuu

SEQ ID NO: 6179 - RNA, 19 nt, Artificial Sequence
  RNA Oligomer
accagcuuuugcggagauu

SEQ ID NO: 6180 - RNA, 19 nt, Artificial Sequence
  RNA Oligomer
gcgaguuuucugaccagcu

SEQ ID NO: 6181 - RNA, 19 nt, Artificial Sequence
  RNA Oligomer
ugccauugaacucaccagu

SEQ ID NO: 6182 - RNA, 19 nt, Artificial Sequence
  RNA Oligomer
ugaacuuugcaaagaccuu

SEQ ID NO: 6183 - RNA, 19 nt, Artificial Sequence
  RNA Oligomer
gcauuguugugccgagaac

SEQ ID NO: 6184 - RNA, 19 nt, Artificial Sequence
  RNA Oligomer
cugcauuguugugccgaga

SEQ ID NO: 6185 - RNA, 19 nt, Artificial Sequence
  RNA Oligomer
cuaaacuugaucuuaggga

SEQ ID NO: 6186 - RNA, 19 nt, Artificial Sequence
  RNA Oligomer
gacccuucagccacuacaa

SEQ ID NO: 6187 - RNA, 19 nt, Artificial Sequence
  RNA Oligomer
ugacgauguucuguacaac

SEQ ID NO: 6188 - RNA, 19 nt, Artificial Sequence
  RNA Oligomer
aucacugucuugccagauu

SEQ ID NO: 6189 - RNA, 19 nt, Artificial Sequence
  RNA Oligomer
ugagcaauaugccuccuug

SEQ ID NO: 6190 - RNA, 19 nt, Artificial Sequence
  RNA Oligomer
cagaacugcuauuuccucu

SEQ ID NO: 6191 - RNA, 19 nt, Artificial Sequence
  RNA Oligomer
gcacguguucccgacauaa

SEQ ID NO: 6192 - RNA, 19 nt, Artificial Sequence
  RNA Oligomer
agcacguguucccgacaua

SEQ ID NO: 6193 - RNA, 19 nt, Artificial Sequence
  RNA Oligomer
aguucagacucacauucua

SEQ ID NO: 6194 - RNA, 19 nt, Artificial Sequence
  RNA Oligomer
ccucuaaugaagaauucug

SEQ ID NO: 6195 - RNA, 19 nt, Artificial Sequence
  RNA Oligomer
ugaacucaccagugaguua

SEQ ID NO: 6196 - RNA, 19 nt, Artificial Sequence
  RNA Oligomer
acacuugcucuccuaugua

SEQ ID NO: 6197 - RNA, 19 nt, Artificial Sequence
  RNA Oligomer
accuucgucuuugagaaga

SEQ ID NO: 6198 - RNA, 19 nt, Artificial Sequence
  RNA Oligomer
caaagaccuucgucuuuga

SEQ ID NO: 6199 - RNA, 19 nt, Artificial Sequence
  RNA Oligomer
ugcaaagaccuucgucuuu

SEQ ID NO: 6200 - RNA, 19 nt, Artificial Sequence
  RNA Oligomer
agaguucagacucacauuc

SEQ ID NO: 6201 - RNA, 19 nt, Artificial Sequence
  RNA Oligomer
ugaucuuuugcuaaugcaa

SEQ ID NO: 6202 - RNA, 19 nt, Artificial Sequence
  RNA Oligomer
uaagugcuuuccuuaguuu

SEQ ID NO: 6203 - RNA, 19 nt, Artificial Sequence
  RNA Oligomer
agcaauaugccuccuugua

SEQ ID NO: 6204 - RNA, 19 nt, Artificial Sequence
  RNA Oligomer
cucuaaugaagaauucugu

SEQ ID NO: 6205 - RNA, 19 nt, Artificial Sequence
  RNA Oligomer
accagugaguuagcagcac

SEQ ID NO: 6206 - RNA, 19 nt, Artificial Sequence
  RNA Oligomer
ugccuacugaucaguuaca

SEQ ID NO: 6207 - RNA, 19 nt, Artificial Sequence
  RNA Oligomer
cgucuuugagaagacggua

SEQ ID NO: 6208 - RNA, 19 nt, Artificial Sequence
  RNA Oligomer
ucgucuuugagaagacggu

SEQ ID NO: 6209 - RNA, 19 nt, Artificial Sequence
  RNA Oligomer
ccuucgcacucaaugccaa

SEQ ID NO: 6210 - RNA, 19 nt, Artificial Sequence
  RNA Oligomer
agggucuagccauggcuaa

SEQ ID NO: 6211 - RNA, 19 nt, Artificial Sequence
  RNA Oligomer
gccagauuaccgacacugu

SEQ ID NO: 6212 - RNA, 19 nt, Artificial Sequence
  RNA Oligomer
accuucuuaacaucacugu

SEQ ID NO: 6213 - RNA, 19 nt, Artificial Sequence
  RNA Oligomer
cugagcaauaugccuccuu

SEQ ID NO: 6214 - RNA, 19 nt, Artificial Sequence
  RNA Oligomer
gaacagaacugcuauuucc

SEQ ID NO: 6215 - RNA, 19 nt, Artificial Sequence
  RNA Oligomer
guguucccgacauaacauu

SEQ ID NO: 6216 - RNA, 19 nt, Artificial Sequence
  RNA Oligomer
gaacucaccagugaguuag

SEQ ID NO: 6217 - RNA, 19 nt, Artificial Sequence
  RNA Oligomer
ugcagacacuugcucuccu

SEQ ID NO: 6218 - RNA, 19 nt, Artificial Sequence
  RNA Oligomer
gucuuugagaagacgguag

SEQ ID NO: 6219 - RNA, 19 nt, Artificial Sequence
  RNA Oligomer
agauuaccgacacugucac

SEQ ID NO: 6220 - RNA, 19 nt, Artificial Sequence
  RNA Oligomer
ccagauuaccgacacuguc

SEQ ID NO: 6221 - RNA, 19 nt, Artificial Sequence
  RNA Oligomer
uuccucuaaugaagaauuc

SEQ ID NO: 6222 - RNA, 19 nt, Artificial Sequence
  RNA Oligomer
gcagcucagcucuuuggau

SEQ ID NO: 6223 - RNA, 19 nt, Artificial Sequence
  RNA Oligomer
cguguucccgacauaacau

SEQ ID NO: 6224 - RNA, 19 nt, Artificial Sequence
  RNA Oligomer
ugcauuguugugccgagaa

SEQ ID NO: 6225 - RNA, 19 nt, Artificial Sequence
  RNA Oligomer
uugguccugucccuuggaa

SEQ ID NO: 6226 - RNA, 19 nt, Artificial Sequence
  RNA Oligomer
ugccagauuaccgacacug

SEQ ID NO: 6227 - RNA, 19 nt, Artificial Sequence
  RNA Oligomer
cagcucagcucuuuggauc

SEQ ID NO: 6228 - RNA, 19 nt, Artificial Sequence
  RNA Oligomer
uggagccuucgcacucaau

SEQ ID NO: 6229 - RNA, 19 nt, Artificial Sequence
  RNA Oligomer
acaucacugucuugccaga

SEQ ID NO: 6230 - RNA, 19 nt, Artificial Sequence
  RNA Oligomer
cuucuuaacaucacugucu

SEQ ID NO: 6231 - RNA, 19 nt, Artificial Sequence
  RNA Oligomer
cccaucauccuagugggaa

SEQ ID NO: 6232 - RNA, 19 nt, Artificial Sequence
  RNA Oligomer
gggaugauaaagacacgau

SEQ ID NO: 6233 - RNA, 19 nt, Artificial Sequence
  RNA Oligomer
uuggugcuguaaaauaccu

SEQ ID NO: 6234 - RNA, 19 nt, Artificial Sequence
  RNA Oligomer
uaaagagggucaguauugg

SEQ ID NO: 6235 - RNA, 19 nt, Artificial Sequence
  RNA Oligomer
aaauaaggcuuuaagaagg

SEQ ID NO: 6236 - RNA, 19 nt, Artificial Sequence
  RNA Oligomer
uuuuacagcaccaaucucc

SEQ ID NO: 6237 - RNA, 19 nt, Artificial Sequence
  RNA Oligomer
guuugcggauaggauaggg

SEQ ID NO: 6238 - RNA, 19 nt, Artificial Sequence
  RNA Oligomer
aaagaugaauuaaaugccc

SEQ ID NO: 6239 - RNA, 19 nt, Artificial Sequence
  RNA Oligomer
aagcuggucagaaaacucg

SEQ ID NO: 6240 - RNA, 19 nt, Artificial Sequence
  RNA Oligomer
aucaauguaaaaacacucc

SEQ ID NO: 6241 - RNA, 19 nt, Artificial Sequence
  RNA Oligomer
aaacacuccacaauucugc

SEQ ID NO: 6242 - RNA, 19 nt, Artificial Sequence
  RNA Oligomer
aacacaugauuuuuacacc

SEQ ID NO: 6243 - RNA, 19 nt, Artificial Sequence
  RNA Oligomer
uuagaggaaauagcaguuc

SEQ ID NO: 6244 - RNA, 19 nt, Artificial Sequence
  RNA Oligomer
aagaucaaguuuaguuccc

SEQ ID NO: 6245 - RNA, 19 nt, Artificial Sequence
  RNA Oligomer
aaagagggucaguauuggu

SEQ ID NO: 6246 - RNA, 19 nt, Artificial Sequence
  RNA Oligomer
aaaacucgcuaugaaauca

SEQ ID NO: 6247 - RNA, 19 nt, Artificial Sequence
  RNA Oligomer
aaacucgcuaugaaaucac

SEQ ID NO: 6248 - RNA, 19 nt, Artificial Sequence
  RNA Oligomer
uuacgcaucugagaacuac

SEQ ID NO: 6249 - RNA, 19 nt, Artificial Sequence
  RNA Oligomer
uguuugcggauaggauagg

SEQ ID NO: 6250 - RNA, 19 nt, Artificial Sequence
  RNA Oligomer
aacaucaauaggcaaagcg

SEQ ID NO: 6251 - RNA, 19 nt, Artificial Sequence
  RNA Oligomer
aaagcacuuuuacuaaucg

SEQ ID NO: 6252 - RNA, 19 nt, Artificial Sequence
  RNA Oligomer
auauugcucagucagaagg

SEQ ID NO: 6253 - RNA, 19 nt, Artificial Sequence
  RNA Oligomer
uauugcucagucagaaggg

SEQ ID NO: 6254 - RNA, 19 nt, Artificial Sequence
  RNA Oligomer
aaaucacaaagacugaucc

SEQ ID NO: 6255 - RNA, 19 nt, Artificial Sequence
  RNA Oligomer
caaaggaacaucaauaggc

SEQ ID NO: 6256 - RNA, 19 nt, Artificial Sequence
  RNA Oligomer
aaaggaacaucaauaggca

SEQ ID NO: 6257 - RNA, 19 nt, Artificial Sequence
  RNA Oligomer
aucgcuucgucaaacacug

SEQ ID NO: 6258 - RNA, 19 nt, Artificial Sequence
  RNA Oligomer
caacacaugauuuuuacac

SEQ ID NO: 6259 - RNA, 19 nt, Artificial Sequence
  RNA Oligomer
uguaagagaaaggaaaagc

SEQ ID NO: 6260 - RNA, 19 nt, Artificial Sequence
  RNA Oligomer
agcuuaagaaaacauuucc

SEQ ID NO: 6261 - RNA, 19 nt, Artificial Sequence
  RNA Oligomer
aaccuuucuuucaucaucu

SEQ ID NO: 6262 - RNA, 19 nt, Artificial Sequence
  RNA Oligomer
uuucuuucaucaucuacug

SEQ ID NO: 6263 - RNA, 19 nt, Artificial Sequence
  RNA Oligomer
uucuuucaucaucuacugc

SEQ ID NO: 6264 - RNA, 19 nt, Artificial Sequence
  RNA Oligomer
uucauuccuuguacaaugu

SEQ ID NO: 6265 - RNA, 19 nt, Artificial Sequence
  RNA Oligomer
uagaggaaauagcaguucu

SEQ ID NO: 6266 - RNA, 19 nt, Artificial Sequence
  RNA Oligomer
uaugaaaucacaaagacug

SEQ ID NO: 6267 - RNA, 19 nt, Artificial Sequence
  RNA Oligomer
uuaauagaaugugagucug

SEQ ID NO: 6268 - RNA, 19 nt, Artificial Sequence
  RNA Oligomer
uauuuuacagcaccaaucu

SEQ ID NO: 6269 - RNA, 19 nt, Artificial Sequence
  RNA Oligomer
aaaauucuguuguaguggc

SEQ ID NO: 6270 - RNA, 19 nt, Artificial Sequence
  RNA Oligomer
uagcacaguuuacagaacc

SEQ ID NO: 6271 - RNA, 19 nt, Artificial Sequence
  RNA Oligomer
uacagaaccucacagaccc

SEQ ID NO: 6272 - RNA, 19 nt, Artificial Sequence
  RNA Oligomer
gauuuuuacaccuaguuac

SEQ ID NO: 6273 - RNA, 19 nt, Artificial Sequence
  RNA Oligomer
aagaugaauuaaaugccca

SEQ ID NO: 6274 - RNA, 19 nt, Artificial Sequence
  RNA Oligomer
aacauuuccugauaauacc

SEQ ID NO: 6275 - RNA, 19 nt, Artificial Sequence
  RNA Oligomer
uuccugauaauaccaaccu

SEQ ID NO: 6276 - RNA, 19 nt, Artificial Sequence
  RNA Oligomer
acacuuucauuccuuguac

SEQ ID NO: 6277 - RNA, 19 nt, Artificial Sequence
  RNA Oligomer
auuagaggaaauagcaguu

SEQ ID NO: 6278 - RNA, 19 nt, Artificial Sequence
  RNA Oligomer
caucugagaacuacauagg

SEQ ID NO: 6279 - RNA, 19 nt, Artificial Sequence
  RNA Oligomer
auuuuggcaacucuuaauc

SEQ ID NO: 6280 - RNA, 19 nt, Artificial Sequence
  RNA Oligomer
auuuucaaaugaugcagga

SEQ ID NO: 6281 - RNA, 19 nt, Artificial Sequence
  RNA Oligomer
acaagggaaaagcaaauua

SEQ ID NO: 6282 - RNA, 19 nt, Artificial Sequence
  RNA Oligomer
uaaaaacacuccacaauuc

SEQ ID NO: 6283 - RNA, 19 nt, Artificial Sequence
  RNA Oligomer
aaaaauucuguuguagugg

SEQ ID NO: 6284 - RNA, 19 nt, Artificial Sequence
  RNA Oligomer
uuguacagaacaucgucag

SEQ ID NO: 6285 - RNA, 19 nt, Artificial Sequence
  RNA Oligomer
acacaugauuuuuacaccu

SEQ ID NO: 6286 - RNA, 19 nt, Artificial Sequence
  RNA Oligomer
acaugauuuuuacaccuag

SEQ ID NO: 6287 - RNA, 19 nt, Artificial Sequence
  RNA Oligomer
uagaaaacuaaggaaagca

SEQ ID NO: 6288 - RNA, 19 nt, Artificial Sequence
  RNA Oligomer
guaagagaaaggaaaagcu

SEQ ID NO: 6289 - RNA, 19 nt, Artificial Sequence
  RNA Oligomer
uuuccugauaauaccaacc

SEQ ID NO: 6290 - RNA, 19 nt, Artificial Sequence
  RNA Oligomer
uaauaccaaccuuucuuuc

SEQ ID NO: 6291 - RNA, 19 nt, Artificial Sequence
  RNA Oligomer
aucaucuacugcauuugac

SEQ ID NO: 6292 - RNA, 19 nt, Artificial Sequence
  RNA Oligomer
uucauuagaggaaauagca

SEQ ID NO: 6293 - RNA, 19 nt, Artificial Sequence
  RNA Oligomer
augaaaucacaaagacuga

SEQ ID NO: 6294 - RNA, 19 nt, Artificial Sequence
  RNA Oligomer
augcaguguaguucagaag

SEQ ID NO: 6295 - RNA, 19 nt, Artificial Sequence
  RNA Oligomer
gauugguucaaaaaauggu

SEQ ID NO: 6296 - RNA, 19 nt, Artificial Sequence
  RNA Oligomer
gcuucgucaaacacugucu

SEQ ID NO: 6297 - RNA, 19 nt, Artificial Sequence
  RNA Oligomer
uuuacagcaccaaucuccu

SEQ ID NO: 6298 - RNA, 19 nt, Artificial Sequence
  RNA Oligomer
uacagaacaucgucagcac

SEQ ID NO: 6299 - RNA, 19 nt, Artificial Sequence
  RNA Oligomer
aguuacuagaaaacuaagg

SEQ ID NO: 6300 - RNA, 19 nt, Artificial Sequence
  RNA Oligomer
aagcacuuuuacuaaucga

SEQ ID NO: 6301 - RNA, 19 nt, Artificial Sequence
  RNA Oligomer
aauacaaggaggcauauug

SEQ ID NO: 6302 - RNA, 19 nt, Artificial Sequence
  RNA Oligomer
auacaaggaggcauauugc

SEQ ID NO: 6303 - RNA, 19 nt, Artificial Sequence
  RNA Oligomer
auuuccugauaauaccaac

SEQ ID NO: 6304 - RNA, 19 nt, Artificial Sequence
  RNA Oligomer
aauaccaaccuuucuuuca

SEQ ID NO: 6305 - RNA, 19 nt, Artificial Sequence
  RNA Oligomer
ucuuucaucaucuacugca

SEQ ID NO: 6306 - RNA, 19 nt, Artificial Sequence
  RNA Oligomer
uuucauuccuuguacaaug

SEQ ID NO: 6307 - RNA, 19 nt, Artificial Sequence
  RNA Oligomer
cauuagaggaaauagcagu

SEQ ID NO: 6308 - RNA, 19 nt, Artificial Sequence
  RNA Oligomer
uucuguucaaaaucuccgc

SEQ ID NO: 6309 - RNA, 19 nt, Artificial Sequence
  RNA Oligomer
aacucgcuaugaaaucaca

SEQ ID NO: 6310 - RNA, 19 nt, Artificial Sequence
  RNA Oligomer
aucugagaacuacauagga

SEQ ID NO: 6311 - RNA, 19 nt, Artificial Sequence
  RNA Oligomer
ucugagaacuacauaggag

SEQ ID NO: 6312 - RNA, 19 nt, Artificial Sequence
  RNA Oligomer
uaagaaggcuugucauuuu

SEQ ID NO: 6313 - RNA, 19 nt, Artificial Sequence
  RNA Oligomer
ccuuaaaauuacugauugg

SEQ ID NO: 6314 - RNA, 19 nt, Artificial Sequence
  RNA Oligomer
auuuuacagcaccaaucuc

SEQ ID NO: 6315 - RNA, 19 nt, Artificial Sequence
  RNA Oligomer
ugaugcaggacucacaagg

SEQ ID NO: 6316 - RNA, 19 nt, Artificial Sequence
  RNA Oligomer
aaaaacacuccacaauucu

SEQ ID NO: 6317 - RNA, 19 nt, Artificial Sequence
  RNA Oligomer
aaauucuguuguaguggcu

SEQ ID NO: 6318 - RNA, 19 nt, Artificial Sequence
  RNA Oligomer
auucuguuguaguggcuga

SEQ ID NO: 6319 - RNA, 19 nt, Artificial Sequence
  RNA Oligomer
aguuuacagaaccucacag

SEQ ID NO: 6320 - RNA, 19 nt, Artificial Sequence
  RNA Oligomer
guuacuagaaaacuaagga

SEQ ID NO: 6321 - RNA, 19 nt, Artificial Sequence
  RNA Oligomer
cuuaagaaaacauuuccug

SEQ ID NO: 6322 - RNA, 19 nt, Artificial Sequence
  RNA Oligomer
cauuccuuguacaauguag

SEQ ID NO: 6323 - RNA, 19 nt, Artificial Sequence
  RNA Oligomer
ucauuagaggaaauagcag

SEQ ID NO: 6324 - RNA, 19 nt, Artificial Sequence
  RNA Oligomer
aaaagcuggucagaaaacu

SEQ ID NO: 6325 - RNA, 19 nt, Artificial Sequence
  RNA Oligomer
gucuuugcaaaguucagug

SEQ ID NO: 6326 - RNA, 19 nt, Artificial Sequence
  RNA Oligomer
aagaaggcuugucauuuua

SEQ ID NO: 6327 - RNA, 19 nt, Artificial Sequence
  RNA Oligomer
uacagcaccaaucuccuua

SEQ ID NO: 6328 - RNA, 19 nt, Artificial Sequence
  RNA Oligomer
ccaaucuccuuagccaugg

SEQ ID NO: 6329 - RNA, 19 nt, Artificial Sequence
  RNA Oligomer
agaucaaguuuaguuccca

SEQ ID NO: 6330 - RNA, 19 nt, Artificial Sequence
  RNA Oligomer
gaucaaguuuaguucccac

SEQ ID NO: 6331 - RNA, 19 nt, Artificial Sequence
  RNA Oligomer
uucaaaugaugcaggacuc

SEQ ID NO: 6332 - RNA, 19 nt, Artificial Sequence
  RNA Oligomer
aagucauacaugcaaaaca

SEQ ID NO: 6333 - RNA, 19 nt, Artificial Sequence
  RNA Oligomer
ucaauguaaaaacacucca

SEQ ID NO: 6334 - RNA, 19 nt, Artificial Sequence
  RNA Oligomer
agaacaucgucagcacuag

SEQ ID NO: 6335 - RNA, 19 nt, Artificial Sequence
  RNA Oligomer
guuuacagaaccucacaga

SEQ ID NO: 6336 - RNA, 19 nt, Artificial Sequence
  RNA Oligomer
uuuacagaaccucacagac

SEQ ID NO: 6337 - RNA, 19 nt, Artificial Sequence
  RNA Oligomer
uuacagaaccucacagacc

SEQ ID NO: 6338 - RNA, 19 nt, Artificial Sequence
  RNA Oligomer
gaacaucaauaggcaaagc

SEQ ID NO: 6339 - RNA, 19 nt, Artificial Sequence
  RNA Oligomer
agaaaggaaaagcuuaaga

SEQ ID NO: 6340 - RNA, 19 nt, Artificial Sequence
  RNA Oligomer
ucaucaucuacugcauuug

SEQ ID NO: 6341 - RNA, 19 nt, Artificial Sequence
  RNA Oligomer
uccuuguacaauguagugu

SEQ ID NO: 6342 - RNA, 19 nt, Artificial Sequence
  RNA Oligomer
aaagcuggucagaaaacuc

SEQ ID NO: 6343 - RNA, 19 nt, Artificial Sequence
  RNA Oligomer
uacaguacaauguuauguc

SEQ ID NO: 6344 - RNA, 19 nt, Artificial Sequence
  RNA Oligomer
acaguacaauguuaugucg

SEQ ID NO: 6345 - RNA, 19 nt, Artificial Sequence
  RNA Oligomer
aguacaauguuaugucggg

SEQ ID NO: 6346 - RNA, 19 nt, Artificial Sequence
  RNA Oligomer
gagaacuacauaggagagc

SEQ ID NO: 6347 - RNA, 19 nt, Artificial Sequence
  RNA Oligomer
aacaaugcaguguaguuca

SEQ ID NO: 6348 - RNA, 19 nt, Artificial Sequence
  RNA Oligomer
aaugcaguguaguucagaa

SEQ ID NO: 6349 - RNA, 19 nt, Artificial Sequence
  RNA Oligomer
gaaggcuugucauuuuagg

SEQ ID NO: 6350 - RNA, 19 nt, Artificial Sequence
  RNA Oligomer
agcaggcauuuucucuucc

SEQ ID NO: 6351 - RNA, 19 nt, Artificial Sequence
  RNA Oligomer
gaucaauguaaaaacacuc

SEQ ID NO: 6352 - RNA, 19 nt, Artificial Sequence
  RNA Oligomer
caauguaaaaacacuccac

SEQ ID NO: 6353 - RNA, 19 nt, Artificial Sequence
  RNA Oligomer
aauguaaaaacacuccaca

SEQ ID NO: 6354 - RNA, 19 nt, Artificial Sequence
  RNA Oligomer
aaaacacuccacaauucug

SEQ ID NO: 6355 - RNA, 19 nt, Artificial Sequence
  RNA Oligomer
guacagaacaucgucagca

SEQ ID NO: 6356 - RNA, 19 nt, Artificial Sequence
  RNA Oligomer
agcacaguuuacagaaccu

SEQ ID NO: 6357 - RNA, 19 nt, Artificial Sequence
  RNA Oligomer
acaguuuacagaaccucac

SEQ ID NO: 6358 - RNA, 19 nt, Artificial Sequence
  RNA Oligomer
cccaaaggaacaucaauag

SEQ ID NO: 6359 - RNA, 19 nt, Artificial Sequence
  RNA Oligomer
cuagaaaacuaaggaaagc

SEQ ID NO: 6360 - RNA, 19 nt, Artificial Sequence
  RNA Oligomer
agaaaacuaaggaaagcac

SEQ ID NO: 6361 - RNA, 19 nt, Artificial Sequence
  RNA Oligomer
agcacuuuuacuaaucgac

SEQ ID NO: 6362 - RNA, 19 nt, Artificial Sequence
  RNA Oligomer
gagaaaggaaaagcuuaag

SEQ ID NO: 6363 - RNA, 19 nt, Artificial Sequence
  RNA Oligomer
auaccaaccuuucuuucau

SEQ ID NO: 6364 - RNA, 19 nt, Artificial Sequence
  RNA Oligomer
uucaucaucuacugcauuu

SEQ ID NO: 6365 - RNA, 19 nt, Artificial Sequence
  RNA Oligomer
auuccuuguacaauguagu

SEQ ID NO: 6366 - RNA, 19 nt, Artificial Sequence
  RNA Oligomer
uuuguccuuugaucacaca

SEQ ID NO: 6367 - RNA, 19 nt, Artificial Sequence
  RNA Oligomer
gaaaucacaaagacugauc

SEQ ID NO: 6368 - RNA, 19 nt, Artificial Sequence
  RNA Oligomer
uucaauggcaacgcuucau

SEQ ID NO: 6369 - RNA, 19 nt, Artificial Sequence
  RNA Oligomer
gaaggucuuugcaaaguuc

SEQ ID NO: 6370 - RNA, 19 nt, Artificial Sequence
  RNA Oligomer
caacaaugcaguguaguuc

SEQ ID NO: 6371 - RNA, 19 nt, Artificial Sequence
  RNA Oligomer
acaaugcaguguaguucag

SEQ ID NO: 6372 - RNA, 19 nt, Artificial Sequence
  RNA Oligomer
gacauuuacaacagcaggc

SEQ ID NO: 6373 - RNA, 19 nt, Artificial Sequence
  RNA Oligomer
acagcaccaaucuccuuag

SEQ ID NO: 6374 - RNA, 19 nt, Artificial Sequence
  RNA Oligomer
aucccuaagaucaaguuua

SEQ ID NO: 6375 - RNA, 19 nt, Artificial Sequence
  RNA Oligomer
uuuucaaaugaugcaggac

SEQ ID NO: 6376 - RNA, 19 nt, Artificial Sequence
  RNA Oligomer
aaccucacagacccaaagg

SEQ ID NO: 6377 - RNA, 19 nt, Artificial Sequence
  RNA Oligomer
caauaggcaaagcgacuac

SEQ ID NO: 6378 - RNA, 19 nt, Artificial Sequence
  RNA Oligomer
uaaagcugcaacacaugau

SEQ ID NO: 6379 - RNA, 19 nt, Artificial Sequence
  RNA Oligomer
cauuuccugauaauaccaa

SEQ ID NO: 6380 - RNA, 19 nt, Artificial Sequence
  RNA Oligomer
uaccaaccuuucuuucauc

SEQ ID NO: 6381 - RNA, 19 nt, Artificial Sequence
  RNA Oligomer
accaaccuuucuuucauca

SEQ ID NO: 6382 - RNA, 19 nt, Artificial Sequence
  RNA Oligomer
uuccuuguacaauguagug

SEQ ID NO: 6383 - RNA, 19 nt, Artificial Sequence
  RNA Oligomer
uuguccuuugaucacacac

SEQ ID NO: 6384 - RNA, 19 nt, Artificial Sequence
  RNA Oligomer
guucuguucaaaaucuccg

SEQ ID NO: 6385 - RNA, 19 nt, Artificial Sequence
  RNA Oligomer
aaucacaaagacugaucca

SEQ ID NO: 6386 - RNA, 19 nt, Artificial Sequence
  RNA Oligomer
uacgcucacuccauuacag

SEQ ID NO: 6387 - RNA, 19 nt, Artificial Sequence
  RNA Oligomer
aacacgugcugcuaacuca

SEQ ID NO: 6388 - RNA, 19 nt, Artificial Sequence
  RNA Oligomer
aucaguaggcaaguuuuac

SEQ ID NO: 6389 - RNA, 19 nt, Artificial Sequence
  RNA Oligomer
gcgcuuuugaaaaauaagg

SEQ ID NO: 6390 - RNA, 19 nt, Artificial Sequence
  RNA Oligomer
acauuuacaacagcaggca

SEQ ID NO: 6391 - RNA, 19 nt, Artificial Sequence
  RNA Oligomer
uuuaucaucccuaagauca

SEQ ID NO: 6392 - RNA, 19 nt, Artificial Sequence
  RNA Oligomer
aacacuccacaauucugca

SEQ ID NO: 6393 - RNA, 19 nt, Artificial Sequence
  RNA Oligomer
uucugcaacugucaauuua

SEQ ID NO: 6394 - RNA, 19 nt, Artificial Sequence
  RNA Oligomer
cuguuguaguggcugaagg

SEQ ID NO: 6395 - RNA, 19 nt, Artificial Sequence
  RNA Oligomer
uguuguaguggcugaaggg

SEQ ID NO: 6396 - RNA, 19 nt, Artificial Sequence
  RNA Oligomer
agugaguuaaguuguacag

SEQ ID NO: 6397 - RNA, 19 nt, Artificial Sequence
  RNA Oligomer
agugauguuaagaagguuc

SEQ ID NO: 6398 - RNA, 19 nt, Artificial Sequence
  RNA Oligomer
gugauguuaagaagguuca

SEQ ID NO: 6399 - RNA, 19 nt, Artificial Sequence
  RNA Oligomer
auaaagcugcaacacauga

SEQ ID NO: 6400 - RNA, 19 nt, Artificial Sequence
  RNA Oligomer
ccuuugaucacacacaccc

SEQ ID NO: 6401 - RNA, 19 nt, Artificial Sequence
  RNA Oligomer
agaacuacauaggagagca

SEQ ID NO: 6402 - RNA, 19 nt, Artificial Sequence
  RNA Oligomer
acauaggagagcaaguguc

SEQ ID NO: 6403 - RNA, 19 nt, Artificial Sequence
  RNA Oligomer
aauaaggcuuuaagaaggc

SEQ ID NO: 6404 - RNA, 19 nt, Artificial Sequence
  RNA Oligomer
cugagacauuuacaacagc

SEQ ID NO: 6405 - RNA, 19 nt, Artificial Sequence
  RNA Oligomer
cagcaccaaucuccuuagc

SEQ ID NO: 6406 - RNA, 19 nt, Artificial Sequence
  RNA Oligomer
agcaccaaucuccuuagcc

SEQ ID NO: 6407 - RNA, 19 nt, Artificial Sequence
  RNA Oligomer
uaucaucccuaagaucaag

SEQ ID NO: 6408 - RNA, 19 nt, Artificial Sequence
  RNA Oligomer
aucaucccuaagaucaagu

SEQ ID NO: 6409 - RNA, 19 nt, Artificial Sequence
  RNA Oligomer
cauuagcaaaagaucaaug

SEQ ID NO: 6410 - RNA, 19 nt, Artificial Sequence
  RNA Oligomer
aauucuguuguaguggcug

SEQ ID NO: 6411 - RNA, 19 nt, Artificial Sequence
  RNA Oligomer
ucgccagugaguuaaguug

SEQ ID NO: 6412 - RNA, 19 nt, Artificial Sequence
  RNA Oligomer
uuuuauaauacaaggaggc

SEQ ID NO: 6413 - RNA, 19 nt, Artificial Sequence
  RNA Oligomer
gcuuaagaaaacauuuccu

SEQ ID NO: 6414 - RNA, 19 nt, Artificial Sequence
  RNA Oligomer
cacagcuaaacagaauucu

SEQ ID NO: 6415 - RNA, 19 nt, Artificial Sequence
  RNA Oligomer
aguucuguucaaaaucucc

SEQ ID NO: 6416 - RNA, 19 nt, Artificial Sequence
  RNA Oligomer
aucacaaagacugauccaa

SEQ ID NO: 6417 - RNA, 19 nt, Artificial Sequence
  RNA Oligomer
cuccauuacaguacaaugu

SEQ ID NO: 6418 - RNA, 19 nt, Artificial Sequence
  RNA Oligomer
caguacaauguuaugucgg

SEQ ID NO: 6419 - RNA, 19 nt, Artificial Sequence
  RNA Oligomer
acgugcugcuaacucacug

SEQ ID NO: 6420 - RNA, 19 nt, Artificial Sequence
  RNA Oligomer
cuacauaggagagcaagug

SEQ ID NO: 6421 - RNA, 19 nt, Artificial Sequence
  RNA Oligomer
ugagacauuuacaacagca

SEQ ID NO: 6422 - RNA, 19 nt, Artificial Sequence
  RNA Oligomer
aauaggcaaagcgacuaca

SEQ ID NO: 6423 - RNA, 19 nt, Artificial Sequence
  RNA Oligomer
ugcaacacaugauuuuuac

SEQ ID NO: 6424 - RNA, 19 nt, Artificial Sequence
  RNA Oligomer
cagcuaaacagaauucuuc

SEQ ID NO: 6425 - RNA, 19 nt, Artificial Sequence
  RNA Oligomer
caguucuguucaaaaucuc

SEQ ID NO: 6426 - RNA, 19 nt, Artificial Sequence
  RNA Oligomer
gacugauccaaagagcuga

SEQ ID NO: 6427 - RNA, 19 nt, Artificial Sequence
  RNA Oligomer
cugauccaaagagcugagc

SEQ ID NO: 6428 - RNA, 19 nt, Artificial Sequence
  RNA Oligomer
guacaauguuaugucggga

SEQ ID NO: 6429 - RNA, 19 nt, Artificial Sequence
  RNA Oligomer
auaggagagcaagugucug

SEQ ID NO: 6430 - RNA, 19 nt, Artificial Sequence
  RNA Oligomer
gagacauuuacaacagcag

SEQ ID NO: 6431 - RNA, 19 nt, Artificial Sequence
  RNA Oligomer
cuccagguauuuuacagca

SEQ ID NO: 6432 - RNA, 19 nt, Artificial Sequence
  RNA Oligomer
uccagguauuuuacagcac

SEQ ID NO: 6433 - RNA, 19 nt, Artificial Sequence
  RNA Oligomer
ucuguucaaaaucuccgca

SEQ ID NO: 6434 - RNA, 19 nt, Artificial Sequence
  RNA Oligomer
acugauccaaagagcugag

SEQ ID NO: 6435 - RNA, 19 nt, Artificial Sequence
  RNA Oligomer
uacaauguuaugucgggaa

SEQ ID NO: 6436 - RNA, 19 nt, Artificial Sequence
  RNA Oligomer
uucgucaaacacugucuug

SEQ ID NO: 6437 - RNA, 19 nt, Artificial Sequence
  RNA Oligomer
uacaugcaaaacauaaugc

SEQ ID NO: 6438 - RNA, 19 nt, Artificial Sequence
  RNA Oligomer
auaggcaaagcgacuacag

SEQ ID NO: 6439 - RNA, 19 nt, Artificial Sequence
  RNA Oligomer
cacacccacagcuaaacag

SEQ ID NO: 6440 - RNA, 19 nt, Artificial Sequence
  RNA Oligomer
uucaaaaucuccgcaaaag

SEQ ID NO: 6441 - RNA, 19 nt, Artificial Sequence
  RNA Oligomer
aagacugauccaaagagcu

SEQ ID NO: 6442 - RNA, 19 nt, Artificial Sequence
  RNA Oligomer
gcucacuccauuacaguac

SEQ ID NO: 6443 - RNA, 19 nt, Artificial Sequence
  RNA Oligomer
aauggcaacgcuucauucg

SEQ ID NO: 6444 - RNA, 19 nt, Artificial Sequence
  RNA Oligomer
uaguucagaagguauuuug

SEQ ID NO: 6445 - RNA, 19 nt, Artificial Sequence
  RNA Oligomer
aagguauuuuggcaacucu

SEQ ID NO: 6446 - RNA, 19 nt, Artificial Sequence
  RNA Oligomer
uaggcaaagcgacuacagg

SEQ ID NO: 6447 - RNA, 19 nt, Artificial Sequence
  RNA Oligomer
aagagggucaguauugguc

SEQ ID NO: 6448 - RNA, 19 nt, Artificial Sequence
  RNA Oligomer
agcuaaacagaauucuuca

SEQ ID NO: 6449 - RNA, 19 nt, Artificial Sequence
  RNA Oligomer
uucugcuuuacgcaucuga

SEQ ID NO: 6450 - RNA, 19 nt, Artificial Sequence
  RNA Oligomer
uucagaagguauuuuggca

SEQ ID NO: 6451 - RNA, 19 nt, Artificial Sequence
  RNA Oligomer
ucgucaaacacugucuuga

SEQ ID NO: 6452 - RNA, 19 nt, Artificial Sequence
  RNA Oligomer
augggagucagcuucuucu

SEQ ID NO: 6453 - RNA, 19 nt, Artificial Sequence
  RNA Oligomer
uucaccgguuuuccaucua

SEQ ID NO: 6454 - RNA, 19 nt, Artificial Sequence
  RNA Oligomer
ucaccgguuuuccaucuac

SEQ ID NO: 6455 - RNA, 19 nt, Artificial Sequence
  RNA Oligomer
uauuggucaagugacagug

SEQ ID NO: 6456 - RNA, 19 nt, Artificial Sequence
  RNA Oligomer
auuaaaugcccaauuuggg

SEQ ID NO: 6457 - RNA, 19 nt, Artificial Sequence
  RNA Oligomer
auggcaacgcuucauucgg

SEQ ID NO: 6458 - RNA, 19 nt, Artificial Sequence
  RNA Oligomer
auaaggcuuuaagaaggcu

SEQ ID NO: 6459 - RNA, 19 nt, Artificial Sequence
  RNA Oligomer
auuuucucuuccucuucuu

SEQ ID NO: 6460 - RNA, 19 nt, Artificial Sequence
  RNA Oligomer
gucagcuucuucuccuuca

SEQ ID NO: 6461 - RNA, 19 nt, Artificial Sequence
  RNA Oligomer
uaaguuguacagaacaucg

SEQ ID NO: 6462 - RNA, 19 nt, Artificial Sequence
  RNA Oligomer
uuuuacaccuaguuacuag

SEQ ID NO: 6463 - RNA, 19 nt, Artificial Sequence
  RNA Oligomer
aauuaaaugcccaauuugg

SEQ ID NO: 6464 - RNA, 19 nt, Artificial Sequence
  RNA Oligomer
aaagacugauccaaagagc

SEQ ID NO: 6465 - RNA, 19 nt, Artificial Sequence
  RNA Oligomer
uuugcaaaguucagugcuc

SEQ ID NO: 6466 - RNA, 19 nt, Artificial Sequence
  RNA Oligomer
uuuggcaacucuuaaucug

SEQ ID NO: 6467 - RNA, 19 nt, Artificial Sequence
  RNA Oligomer
aaggcuuuaagaaggcuug

SEQ ID NO: 6468 - RNA, 19 nt, Artificial Sequence
  RNA Oligomer
aacagcaggcauuuucucu

SEQ ID NO: 6469 - RNA, 19 nt, Artificial Sequence
  RNA Oligomer
cauuuucucuuccucuucu

SEQ ID NO: 6470 - RNA, 19 nt, Artificial Sequence
  RNA Oligomer
uuuucucuuccucuucuuc

SEQ ID NO: 6471 - RNA, 19 nt, Artificial Sequence
  RNA Oligomer
aaguuguacagaacaucgu

SEQ ID NO: 6472 - RNA, 19 nt, Artificial Sequence
  RNA Oligomer
aucgucagcacuagcacag

SEQ ID NO: 6473 - RNA, 19 nt, Artificial Sequence
  RNA Oligomer
uuuauaauacaaggaggca

SEQ ID NO: 6474 - RNA, 19 nt, Artificial Sequence
  RNA Oligomer
aguucagaagguauuuugg

SEQ ID NO: 6475 - RNA, 19 nt, Artificial Sequence
  RNA Oligomer
guucagaagguauuuuggc

SEQ ID NO: 6476 - RNA, 19 nt, Artificial Sequence
  RNA Oligomer
uuuuggcaacucuuaaucu

SEQ ID NO: 6477 - RNA, 19 nt, Artificial Sequence
  RNA Oligomer
cagcaggcauuuucucuuc

SEQ ID NO: 6478 - RNA, 19 nt, Artificial Sequence
  RNA Oligomer
uccuucaguuucucgaucg

SEQ ID NO: 6479 - RNA, 19 nt, Artificial Sequence
  RNA Oligomer
uuauaauacaaggaggcau

SEQ ID NO: 6480 - RNA, 19 nt, Artificial Sequence
  RNA Oligomer
aaagguuccaagggacagg

SEQ ID NO: 6481 - RNA, 19 nt, Artificial Sequence
  RNA Oligomer
cuucuccuucaguuucucg

SEQ ID NO: 6482 - RNA, 19 nt, Artificial Sequence
  RNA Oligomer
auucaccgguuuuccaucu

SEQ ID NO: 6483 - RNA, 19 nt, Artificial Sequence
  RNA Oligomer
uaaugcuaauugcauuagc

SEQ ID NO: 6484 - RNA, 19 nt, Artificial Sequence
  RNA Oligomer
cagacccaaaggaacauca

SEQ ID NO: 6485 - RNA, 19 nt, Artificial Sequence
  RNA Oligomer
uuggucaagugacaguguc

SEQ ID NO: 6486 - RNA, 19 nt, Artificial Sequence
  RNA Oligomer
guccuuugaucacacacac

SEQ ID NO: 6487 - RNA, 19 nt, Artificial Sequence
  RNA Oligomer
aucuccgcaaaagcugguc

SEQ ID NO: 6488 - RNA, 19 nt, Artificial Sequence
  RNA Oligomer
aaagagcugagcugcuacg

SEQ ID NO: 6489 - RNA, 19 nt, Artificial Sequence
  RNA Oligomer
ucacuggugaguucaaugg

SEQ ID NO: 6490 - RNA, 19 nt, Artificial Sequence
  RNA Oligomer
gugaguucaauggcaacgc

SEQ ID NO: 6491 - RNA, 19 nt, Artificial Sequence
  RNA Oligomer
ucuuugcaaaguucagugc

SEQ ID NO: 6492 - RNA, 19 nt, Artificial Sequence
  RNA Oligomer
uaaggcuuuaagaaggcuu

SEQ ID NO: 6493 - RNA, 19 nt, Artificial Sequence
  RNA Oligomer
uuaguucccacuaggauga

SEQ ID NO: 6494 - RNA, 19 nt, Artificial Sequence
  RNA Oligomer
augcaggacucacaaggga

SEQ ID NO: 6495 - RNA, 19 nt, Artificial Sequence
  RNA Oligomer
acaugcaaaacauaaugcu

SEQ ID NO: 6496 - RNA, 19 nt, Artificial Sequence
  RNA Oligomer
uuaaguuguacagaacauc

SEQ ID NO: 6497 - RNA, 19 nt, Artificial Sequence
  RNA Oligomer
guauuggucaagugacagu

SEQ ID NO: 6498 - RNA, 19 nt, Artificial Sequence
  RNA Oligomer
uuggcaacucuuaaucuga

SEQ ID NO: 6499 - RNA, 19 nt, Artificial Sequence
  RNA Oligomer
caguaggcaaguuuuaccu

SEQ ID NO: 6500 - RNA, 19 nt, Artificial Sequence
  RNA Oligomer
aagguuccaagggacagga

SEQ ID NO: 6501 - RNA, 19 nt, Artificial Sequence
  RNA Oligomer
guucccacuaggaugaugg

SEQ ID NO: 6502 - RNA, 19 nt, Artificial Sequence
  RNA Oligomer
auucucgccagugaguuaa

SEQ ID NO: 6503 - RNA, 19 nt, Artificial Sequence
  RNA Oligomer
aacaucgucagcacuagca

SEQ ID NO: 6504 - RNA, 19 nt, Artificial Sequence
  RNA Oligomer
auuggucaagugacagugu

SEQ ID NO: 6505 - RNA, 19 nt, Artificial Sequence
  RNA Oligomer
uggucaagugacagugucg

SEQ ID NO: 6506 - RNA, 19 nt, Artificial Sequence
  RNA Oligomer
uaaucuggcaagacaguga

SEQ ID NO: 6507 - RNA, 19 nt, Artificial Sequence
  RNA Oligomer
gugacacuuucauuccuug

SEQ ID NO: 6508 - RNA, 19 nt, Artificial Sequence
  RNA Oligomer
uuguguaacugaucaguag

SEQ ID NO: 6509 - RNA, 19 nt, Artificial Sequence
  RNA Oligomer
guguaacugaucaguaggc

SEQ ID NO: 6510 - RNA, 19 nt, Artificial Sequence
  RNA Oligomer
uaggagagcaagugucugc

SEQ ID NO: 6511 - RNA, 19 nt, Artificial Sequence
  RNA Oligomer
aauagaaugugagucugaa

SEQ ID NO: 6512 - RNA, 19 nt, Artificial Sequence
  RNA Oligomer
ugauugguucaaaaaaugg

SEQ ID NO: 6513 - RNA, 19 nt, Artificial Sequence
  RNA Oligomer
aaguuggcauugagugcga

SEQ ID NO: 6514 - RNA, 19 nt, Artificial Sequence
  RNA Oligomer
uccuuagccauggcuagac

SEQ ID NO: 6515 - RNA, 19 nt, Artificial Sequence
  RNA Oligomer
cuaagaucaaguuuaguuc

SEQ ID NO: 6516 - RNA, 19 nt, Artificial Sequence
  RNA Oligomer
aaguuuaguucccacuagg

SEQ ID NO: 6517 - RNA, 19 nt, Artificial Sequence
  RNA Oligomer
cuaauugcauuagcaaaag

SEQ ID NO: 6518 - RNA, 19 nt, Artificial Sequence
  RNA Oligomer
uuuacaccuaguuacuaga

SEQ ID NO: 6519 - RNA, 19 nt, Artificial Sequence
  RNA Oligomer
aucuacugcauuugacaga

SEQ ID NO: 6520 - RNA, 19 nt, Artificial Sequence
  RNA Oligomer
aaaaucuccgcaaaagcug

SEQ ID NO: 6521 - RNA, 19 nt, Artificial Sequence
  RNA Oligomer
uaacugaucaguaggcaag

SEQ ID NO: 6522 - RNA, 19 nt, Artificial Sequence
  RNA Oligomer
cgcuuuugaaaaauaaggc

SEQ ID NO: 6523 - RNA, 19 nt, Artificial Sequence
  RNA Oligomer
aggcuugucauuuuagggc

SEQ ID NO: 6524 - RNA, 19 nt, Artificial Sequence
  RNA Oligomer
uaauagaaugugagucuga

SEQ ID NO: 6525 - RNA, 19 nt, Artificial Sequence
  RNA Oligomer
aaugcuaauugcauuagca

SEQ ID NO: 6526 - RNA, 19 nt, Artificial Sequence
  RNA Oligomer
cuucauuagaggaaauagc

SEQ ID NO: 6527 - RNA, 19 nt, Artificial Sequence
  RNA Oligomer
aaauagcaguucuguucaa

SEQ ID NO: 6528 - RNA, 19 nt, Artificial Sequence
  RNA Oligomer
ucuccgcaaaagcugguca

SEQ ID NO: 6529 - RNA, 19 nt, Artificial Sequence
  RNA Oligomer
caaagacugauccaaagag

SEQ ID NO: 6530 - RNA, 19 nt, Artificial Sequence
  RNA Oligomer
gcuuuaagaaggcuuguca

SEQ ID NO: 6531 - RNA, 19 nt, Artificial Sequence
  RNA Oligomer
aaggcuugucauuuuaggg

SEQ ID NO: 6532 - RNA, 19 nt, Artificial Sequence
  RNA Oligomer
augugagucugaacucuua

SEQ ID NO: 6533 - RNA, 19 nt, Artificial Sequence
  RNA Oligomer
aaaguuggcauugagugcg

SEQ ID NO: 6534 - RNA, 19 nt, Artificial Sequence
  RNA Oligomer
gauaggugaugggagucag

SEQ ID NO: 6535 - RNA, 19 nt, Artificial Sequence
  RNA Oligomer
auaggugaugggagucagc

SEQ ID NO: 6536 - RNA, 19 nt, Artificial Sequence
  RNA Oligomer
gaaauagcaguucuguuca

SEQ ID NO: 6537 - RNA, 19 nt, Artificial Sequence
  RNA Oligomer
aaaucuccgcaaaagcugg

SEQ ID NO: 6538 - RNA, 19 nt, Artificial Sequence
  RNA Oligomer
cacuggugaguucaauggc

SEQ ID NO: 6539 - RNA, 19 nt, Artificial Sequence
  RNA Oligomer
ugaguucaauggcaacgcu

SEQ ID NO: 6540 - RNA, 19 nt, Artificial Sequence
  RNA Oligomer
gucuucucaaagacgaagg

SEQ ID NO: 6541 - RNA, 19 nt, Artificial Sequence
  RNA Oligomer
uucucaaagacgaaggucu

SEQ ID NO: 6542 - RNA, 19 nt, Artificial Sequence
  RNA Oligomer
caaagacgaaggucuuugc

SEQ ID NO: 6543 - RNA, 19 nt, Artificial Sequence
  RNA Oligomer
gcuuuugaaaaauaaggcu

SEQ ID NO: 6544 - RNA, 19 nt, Artificial Sequence
  RNA Oligomer
caaucuccuuagccauggc

SEQ ID NO: 6545 - RNA, 19 nt, Artificial Sequence
  RNA Oligomer
aaucuccuuagccauggcu

SEQ ID NO: 6546 - RNA, 19 nt, Artificial Sequence
  RNA Oligomer
caaguuuaguucccacuag

SEQ ID NO: 6547 - RNA, 19 nt, Artificial Sequence
  RNA Oligomer
aagacagugauguuaagaa

SEQ ID NO: 6548 - RNA, 19 nt, Artificial Sequence
  RNA Oligomer
aaucuccgcaaaagcuggu

SEQ ID NO: 6549 - RNA, 19 nt, Artificial Sequence
  RNA Oligomer
agcuggucagaaaacucgc

SEQ ID NO: 6550 - RNA, 19 nt, Artificial Sequence
  RNA Oligomer
acuggugaguucaauggca

SEQ ID NO: 6551 - RNA, 19 nt, Artificial Sequence
  RNA Oligomer
aaggucuuugcaaaguuca

SEQ ID NO: 6552 - RNA, 19 nt, Artificial Sequence
  RNA Oligomer
guucucggcacaacaaugc

SEQ ID NO: 6553 - RNA, 19 nt, Artificial Sequence
  RNA Oligomer
ucucggcacaacaaugcag

SEQ ID NO: 6554 - RNA, 19 nt, Artificial Sequence
  RNA Oligomer
ucccuaagaucaaguuuag

SEQ ID NO: 6555 - RNA, 19 nt, Artificial Sequence
  RNA Oligomer
uuguaguggcugaaggguc

SEQ ID NO: 6556 - RNA, 19 nt, Artificial Sequence
  RNA Oligomer
guuguacagaacaucguca

SEQ ID NO: 6557 - RNA, 19 nt, Artificial Sequence
  RNA Oligomer
aaucuggcaagacagugau

SEQ ID NO: 6558 - RNA, 19 nt, Artificial Sequence
  RNA Oligomer
caaggaggcauauugcuca

SEQ ID NO: 6559 - RNA, 19 nt, Artificial Sequence
  RNA Oligomer
agaggaaauagcaguucug

SEQ ID NO: 6560 - RNA, 19 nt, Artificial Sequence
  RNA Oligomer
uuaugucgggaacacgugc

SEQ ID NO: 6561 - RNA, 19 nt, Artificial Sequence
  RNA Oligomer
uaugucgggaacacgugcu

SEQ ID NO: 6562 - RNA, 19 nt, Artificial Sequence
  RNA Oligomer
uagaaugugagucugaacu

SEQ ID NO: 6563 - RNA, 19 nt, Artificial Sequence
  RNA Oligomer
cagaauucuucauuagagg

SEQ ID NO: 6564 - RNA, 19 nt, Artificial Sequence
  RNA Oligomer
uaacucacuggugaguuca

SEQ ID NO: 6565 - RNA, 19 nt, Artificial Sequence
  RNA Oligomer
uacauaggagagcaagugu

SEQ ID NO: 6566 - RNA, 19 nt, Artificial Sequence
  RNA Oligomer
ucuucucaaagacgaaggu

SEQ ID NO: 6567 - RNA, 19 nt, Artificial Sequence
  RNA Oligomer
ucaaagacgaaggucuuug

SEQ ID NO: 6568 - RNA, 19 nt, Artificial Sequence
  RNA Oligomer
aaagacgaaggucuuugca

SEQ ID NO: 6569 - RNA, 19 nt, Artificial Sequence
  RNA Oligomer
gaaugugagucugaacucu

SEQ ID NO: 6570 - RNA, 19 nt, Artificial Sequence
  RNA Oligomer
uugcauuagcaaaagauca

SEQ ID NO: 6571 - RNA, 19 nt, Artificial Sequence
  RNA Oligomer
aaacuaaggaaagcacuua

SEQ ID NO: 6572 - RNA, 19 nt, Artificial Sequence
  RNA Oligomer
uacaaggaggcauauugcu

SEQ ID NO: 6573 - RNA, 19 nt, Artificial Sequence
  RNA Oligomer
acagaauucuucauuagag

SEQ ID NO: 6574 - RNA, 19 nt, Artificial Sequence
  RNA Oligomer
gugcugcuaacucacuggu

SEQ ID NO: 6575 - RNA, 19 nt, Artificial Sequence
  RNA Oligomer
uguaacugaucaguaggca

SEQ ID NO: 6576 - RNA, 19 nt, Artificial Sequence
  RNA Oligomer
uaccgucuucucaaagacg

SEQ ID NO: 6577 - RNA, 19 nt, Artificial Sequence
  RNA Oligomer
accgucuucucaaagacga

SEQ ID NO: 6578 - RNA, 19 nt, Artificial Sequence
  RNA Oligomer
uuggcauugagugcgaagg

SEQ ID NO: 6579 - RNA, 19 nt, Artificial Sequence
  RNA Oligomer
uuagccauggcuagacccu

SEQ ID NO: 6580 - RNA, 19 nt, Artificial Sequence
  RNA Oligomer
acagugucgguaaucuggc

SEQ ID NO: 6581 - RNA, 19 nt, Artificial Sequence
  RNA Oligomer
acagugauguuaagaaggu

SEQ ID NO: 6582 - RNA, 19 nt, Artificial Sequence
  RNA Oligomer
aaggaggcauauugcucag

SEQ ID NO: 6583 - RNA, 19 nt, Artificial Sequence
  RNA Oligomer
ggaaauagcaguucuguuc

SEQ ID NO: 6584 - RNA, 19 nt, Artificial Sequence
  RNA Oligomer
aauguuaugucgggaacac

SEQ ID NO: 6585 - RNA, 19 nt, Artificial Sequence
  RNA Oligomer
cuaacucacuggugaguuc

SEQ ID NO: 6586 - RNA, 19 nt, Artificial Sequence
  RNA Oligomer
aggagagcaagugucugca

SEQ ID NO: 6587 - RNA, 19 nt, Artificial Sequence
  RNA Oligomer
cuaccgucuucucaaagac

SEQ ID NO: 6588 - RNA, 19 nt, Artificial Sequence
  RNA Oligomer
gugacagugucgguaaucu

SEQ ID NO: 6589 - RNA, 19 nt, Artificial Sequence
  RNA Oligomer
gacagugucgguaaucugg

SEQ ID NO: 6590 - RNA, 19 nt, Artificial Sequence
  RNA Oligomer
gaauucuucauuagaggaa

SEQ ID NO: 6591 - RNA, 19 nt, Artificial Sequence
  RNA Oligomer
auccaaagagcugagcugc

SEQ ID NO: 6592 - RNA, 19 nt, Artificial Sequence
  RNA Oligomer
auguuaugucgggaacacg

SEQ ID NO: 6593 - RNA, 19 nt, Artificial Sequence
  RNA Oligomer
uucucggcacaacaaugca

SEQ ID NO: 6594 - RNA, 19 nt, Artificial Sequence
  RNA Oligomer
uuccaagggacaggaccaa

SEQ ID NO: 6595 - RNA, 19 nt, Artificial Sequence
  RNA Oligomer
cagugucgguaaucuggca

SEQ ID NO: 6596 - RNA, 19 nt, Artificial Sequence
  RNA Oligomer
gauccaaagagcugagcug

SEQ ID NO: 6597 - RNA, 19 nt, Artificial Sequence
  RNA Oligomer
auugagugcgaaggcucca

SEQ ID NO: 6598 - RNA, 19 nt, Artificial Sequence
  RNA Oligomer
ucuggcaagacagugaugu

SEQ ID NO: 6599 - RNA, 19 nt, Artificial Sequence
  RNA Oligomer
agacagugauguuaagaag

SEQ ID NO: 6600 - RNA, 19 nt, Artificial Sequence
  RNA Oligomer
uucccacuaggaugauggg

SEQ ID NO: 6601 - RNA, 19 nt, Artificial Sequence
  RNA Oligomer
aucgugucuuuaucauccc

SEQ ID NO: 6602 - RNA, 19 nt, Artificial Sequence
  RNA Oligomer
agguauuuuacagcaccaa

SEQ ID NO: 6603 - RNA, 19 nt, Artificial Sequence
  RNA Oligomer
cccaauguuucguauaucu

SEQ ID NO: 6604 - RNA, 19 nt, Artificial Sequence
  RNA Oligomer
ccgacuaacaccacuggaa

SEQ ID NO: 6605 - RNA, 19 nt, Artificial Sequence
  RNA Oligomer
agaacccaauguuucguau

SEQ ID NO: 6606 - RNA, 19 nt, Artificial Sequence
  RNA Oligomer
ccauccuuauuccuccuca

SEQ ID NO: 6607 - RNA, 19 nt, Artificial Sequence
  RNA Oligomer
ggagaacccaauguuucgu

SEQ ID NO: 6608 - RNA, 19 nt, Artificial Sequence
  RNA Oligomer
agaacuuaaugcugcauuu

SEQ ID NO: 6609 - RNA, 19 nt, Artificial Sequence
  RNA Oligomer
ggagaacuuaaugcugcau

SEQ ID NO: 6610 - RNA, 19 nt, Artificial Sequence
  RNA Oligomer
acccaauguuucguauauc

SEQ ID NO: 6611 - RNA, 19 nt, Artificial Sequence
  RNA Oligomer
gagaaauauaucgcuuguu

SEQ ID NO: 6612 - RNA, 19 nt, Artificial Sequence
  RNA Oligomer
cugucuugaaggagaaaua

SEQ ID NO: 6613 - RNA, 19 nt, Artificial Sequence
  RNA Oligomer
caaaugucaaacuaccaaa

SEQ ID NO: 6614 - RNA, 19 nt, Artificial Sequence
  RNA Oligomer
ccaauguuucguauaucug

SEQ ID NO: 6615 - RNA, 19 nt, Artificial Sequence
  RNA Oligomer
gccagcugcacaggaaaaa

SEQ ID NO: 6616 - RNA, 19 nt, Artificial Sequence
  RNA Oligomer
acacaccugcacucuucaa

SEQ ID NO: 6617 - RNA, 19 nt, Artificial Sequence
  RNA Oligomer
ggacauuucaccucaggag

SEQ ID NO: 6618 - RNA, 19 nt, Artificial Sequence
  RNA Oligomer
gagaacuuaaugcugcauu

SEQ ID NO: 6619 - RNA, 19 nt, Artificial Sequence
  RNA Oligomer
agaaaguauugcaggacaa

SEQ ID NO: 6620 - RNA, 19 nt, Artificial Sequence
  RNA Oligomer
ccaucaagaaaguauugca

SEQ ID NO: 6621 - RNA, 19 nt, Artificial Sequence
  RNA Oligomer
gaaggagaaauauaucgcu

SEQ ID NO: 6622 - RNA, 19 nt, Artificial Sequence
  RNA Oligomer
gguauaucaagccaaacuu

SEQ ID NO: 6623 - RNA, 19 nt, Artificial Sequence
  RNA Oligomer
gucuugaaggagaaauaua

SEQ ID NO: 6624 - RNA, 19 nt, Artificial Sequence
  RNA Oligomer
cauccuuauuccuccucau

SEQ ID NO: 6625 - RNA, 19 nt, Artificial Sequence
  RNA Oligomer
gcacucuucaacuucacca

SEQ ID NO: 6626 - RNA, 19 nt, Artificial Sequence
  RNA Oligomer
cugugauuuaugucaaguu

SEQ ID NO: 6627 - RNA, 19 nt, Artificial Sequence
  RNA Oligomer
ucgccaucaagaaaguauu

SEQ ID NO: 6628 - RNA, 19 nt, Artificial Sequence
  RNA Oligomer
aggagaaauauaucgcuug

SEQ ID NO: 6629 - RNA, 19 nt, Artificial Sequence
  RNA Oligomer
cgaucugucuugaaggaga

SEQ ID NO: 6630 - RNA, 19 nt, Artificial Sequence
  RNA Oligomer
accauccuuauuccuccuc

SEQ ID NO: 6631 - RNA, 19 nt, Artificial Sequence
  RNA Oligomer
ucaagaacugucaaguaau

SEQ ID NO: 6632 - RNA, 19 nt, Artificial Sequence
  RNA Oligomer
ccugcacucuucaacuuca

SEQ ID NO: 6633 - RNA, 19 nt, Artificial Sequence
  RNA Oligomer
cgacuaacaccacuggaag

SEQ ID NO: 6634 - RNA, 19 nt, Artificial Sequence
  RNA Oligomer
ggauccugauacugcugua

SEQ ID NO: 6635 - RNA, 19 nt, Artificial Sequence
  RNA Oligomer
ucccugugauuuaugucaa

SEQ ID NO: 6636 - RNA, 19 nt, Artificial Sequence
  RNA Oligomer
aaggagaaauauaucgcuu

SEQ ID NO: 6637 - RNA, 19 nt, Artificial Sequence
  RNA Oligomer
cagcuauacagacacuaaa

SEQ ID NO: 6638 - RNA, 19 nt, Artificial Sequence
  RNA Oligomer
ugaaaguuagcagagacaa

SEQ ID NO: 6639 - RNA, 19 nt, Artificial Sequence
  RNA Oligomer
ggcuaccauccuuauuccu

SEQ ID NO: 6640 - RNA, 19 nt, Artificial Sequence
  RNA Oligomer
cccaaaugucaaacuacca

SEQ ID NO: 6641 - RNA, 19 nt, Artificial Sequence
  RNA Oligomer
ugaauuacgggacccaaau

SEQ ID NO: 6642 - RNA, 19 nt, Artificial Sequence
  RNA Oligomer
cugcauuuaucguuaaccu

SEQ ID NO: 6643 - RNA, 19 nt, Artificial Sequence
  RNA Oligomer
gcacauucauuuuuugaug

SEQ ID NO: 6644 - RNA, 19 nt, Artificial Sequence
  RNA Oligomer
gaacuuaaugcugcauuua

SEQ ID NO: 6645 - RNA, 19 nt, Artificial Sequence
  RNA Oligomer
acccaaacuacacagaauu

SEQ ID NO: 6646 - RNA, 19 nt, Artificial Sequence
  RNA Oligomer
gggagaacuuaaugcugca

SEQ ID NO: 6647 - RNA, 19 nt, Artificial Sequence
  RNA Oligomer
ugguagaaauaaucaaggu

SEQ ID NO: 6648 - RNA, 19 nt, Artificial Sequence
  RNA Oligomer
ucaguugguagaaauaauc

SEQ ID NO: 6649 - RNA, 19 nt, Artificial Sequence
  RNA Oligomer
ugagcuguuacuaggacaa

SEQ ID NO: 6650 - RNA, 19 nt, Artificial Sequence
  RNA Oligomer
caaguuguauauguaucag

SEQ ID NO: 6651 - RNA, 19 nt, Artificial Sequence
  RNA Oligomer
cuaucuuaaucuggugcug

SEQ ID NO: 6652 - RNA, 19 nt, Artificial Sequence
  RNA Oligomer
ggucuaucuuaaucuggug

SEQ ID NO: 6653 - RNA, 19 nt, Artificial Sequence
  RNA Oligomer
cgccaucaagaaaguauug

SEQ ID NO: 6654 - RNA, 19 nt, Artificial Sequence
  RNA Oligomer
gucgccaucaagaaaguau

SEQ ID NO: 6655 - RNA, 19 nt, Artificial Sequence
  RNA Oligomer
ggaaaaggugauucgcgaa

SEQ ID NO: 6656 - RNA, 19 nt, Artificial Sequence
  RNA Oligomer
gaccaauaaugcugcuucu

SEQ ID NO: 6657 - RNA, 19 nt, Artificial Sequence
  RNA Oligomer
ccuuauuccuccucaugcu

SEQ ID NO: 6658 - RNA, 19 nt, Artificial Sequence
  RNA Oligomer
cucuucaacuucaccacuc

SEQ ID NO: 6659 - RNA, 19 nt, Artificial Sequence
  RNA Oligomer
cugcacucuucaacuucac

SEQ ID NO: 6660 - RNA, 19 nt, Artificial Sequence
  RNA Oligomer
acaccaacugcccgacuaa

SEQ ID NO: 6661 - RNA, 19 nt, Artificial Sequence
  RNA Oligomer
gucaggaacaggacauuuc

SEQ ID NO: 6662 - RNA, 19 nt, Artificial Sequence
  RNA Oligomer
agggagcaaaucagagaaa

SEQ ID NO: 6663 - RNA, 19 nt, Artificial Sequence
  RNA Oligomer
gguagaaauaaucaagguc

SEQ ID NO: 6664 - RNA, 19 nt, Artificial Sequence
  RNA Oligomer
cuguauuaaaacucuguga

SEQ ID NO: 6665 - RNA, 19 nt, Artificial Sequence
  RNA Oligomer
gcuguauuaaaacucugug

SEQ ID NO: 6666 - RNA, 19 nt, Artificial Sequence
  RNA Oligomer
cgcucccugugauuuaugu

SEQ ID NO: 6667 - RNA, 19 nt, Artificial Sequence
  RNA Oligomer
aggucuaucuuaaucuggu

SEQ ID NO: 6668 - RNA, 19 nt, Artificial Sequence
  RNA Oligomer
caagaaaguauugcaggac

SEQ ID NO: 6669 - RNA, 19 nt, Artificial Sequence
  RNA Oligomer
ucaagaaaguauugcagga

SEQ ID NO: 6670 - RNA, 19 nt, Artificial Sequence
  RNA Oligomer
ucugucuugaaggagaaau

SEQ ID NO: 6671 - RNA, 19 nt, Artificial Sequence
  RNA Oligomer
ccagcugcacaggaaaaac

SEQ ID NO: 6672 - RNA, 19 nt, Artificial Sequence
  RNA Oligomer
agaccaauaaugcugcuuc

SEQ ID NO: 6673 - RNA, 19 nt, Artificial Sequence
  RNA Oligomer
ggacagaccaauaaugcug

SEQ ID NO: 6674 - RNA, 19 nt, Artificial Sequence
  RNA Oligomer
cauuuaucguuaaccuaac

SEQ ID NO: 6675 - RNA, 19 nt, Artificial Sequence
  RNA Oligomer
ugcauuuaucguuaaccua

SEQ ID NO: 6676 - RNA, 19 nt, Artificial Sequence
  RNA Oligomer
cuggaagcuugugcacauu

SEQ ID NO: 6677 - RNA, 19 nt, Artificial Sequence
  RNA Oligomer
ggauucgucaggaacagga

SEQ ID NO: 6678 - RNA, 19 nt, Artificial Sequence
  RNA Oligomer
ggauagugguguggaucag

SEQ ID NO: 6679 - RNA, 19 nt, Artificial Sequence
  RNA Oligomer
ugcuguauuaaaacucugu

SEQ ID NO: 6680 - RNA, 19 nt, Artificial Sequence
  RNA Oligomer
cugcuguauuaaaacucug

SEQ ID NO: 6681 - RNA, 19 nt, Artificial Sequence
  RNA Oligomer
uguauauguaucagcuguu

SEQ ID NO: 6682 - RNA, 19 nt, Artificial Sequence
  RNA Oligomer
gucaaguuguauauguauc

SEQ ID NO: 6683 - RNA, 19 nt, Artificial Sequence
  RNA Oligomer
cuauagucgagccaaacag

SEQ ID NO: 6684 - RNA, 19 nt, Artificial Sequence
  RNA Oligomer
cggaaacaguauacagagu

SEQ ID NO: 6685 - RNA, 19 nt, Artificial Sequence
  RNA Oligomer
ccagaucaugagaaagcua

SEQ ID NO: 6686 - RNA, 19 nt, Artificial Sequence
  RNA Oligomer
gccaucaagaaaguauugc

SEQ ID NO: 6687 - RNA, 19 nt, Artificial Sequence
  RNA Oligomer
uggucgccaucaagaaagu

SEQ ID NO: 6688 - RNA, 19 nt, Artificial Sequence
  RNA Oligomer
ugguauaucaagccaaacu

SEQ ID NO: 6689 - RNA, 19 nt, Artificial Sequence
  RNA Oligomer
cgcgaagagagugaucaug

SEQ ID NO: 6690 - RNA, 19 nt, Artificial Sequence
  RNA Oligomer
ccaacuccaccugaacagu

SEQ ID NO: 6691 - RNA, 19 nt, Artificial Sequence
  RNA Oligomer
cagaccaauaaugcugcuu

SEQ ID NO: 6692 - RNA, 19 nt, Artificial Sequence
  RNA Oligomer
caccacucaagaacuguca

SEQ ID NO: 6693 - RNA, 19 nt, Artificial Sequence
  RNA Oligomer
cacucuucaacuucaccac

SEQ ID NO: 6694 - RNA, 19 nt, Artificial Sequence
  RNA Oligomer
cuugugcacauucauuuuu

SEQ ID NO: 6695 - RNA, 19 nt, Artificial Sequence
  RNA Oligomer
ugcugcauuuaucguuaac

SEQ ID NO: 6696 - RNA, 19 nt, Artificial Sequence
  RNA Oligomer
uacaccaacugcccgacua

SEQ ID NO: 6697 - RNA, 19 nt, Artificial Sequence
  RNA Oligomer
caacaagggagcaaaucag

SEQ ID NO: 6698 - RNA, 19 nt, Artificial Sequence
  RNA Oligomer
guagaaauaaucaaggucc

SEQ ID NO: 6699 - RNA, 19 nt, Artificial Sequence
  RNA Oligomer
ucguauaucuguucucggu

SEQ ID NO: 6700 - RNA, 19 nt, Artificial Sequence
  RNA Oligomer
acugcuguauuaaaacucu

SEQ ID NO: 6701 - RNA, 19 nt, Artificial Sequence
  RNA Oligomer
gugauuuaugucaaguugu

SEQ ID NO: 6702 - RNA, 19 nt, Artificial Sequence
  RNA Oligomer
ccaguggugagaagaaaga

SEQ ID NO: 6703 - RNA, 19 nt, Artificial Sequence
  RNA Oligomer
agaaagcuagaucacugua

SEQ ID NO: 6704 - RNA, 19 nt, Artificial Sequence
  RNA Oligomer
ugcaggacaagagauuuaa

SEQ ID NO: 6705 - RNA, 19 nt, Artificial Sequence
  RNA Oligomer
ggaucauuuggugugguau

SEQ ID NO: 6706 - RNA, 19 nt, Artificial Sequence
  RNA Oligomer
ugauuggaaauggaucauu

SEQ ID NO: 6707 - RNA, 19 nt, Artificial Sequence
  RNA Oligomer
gaaaaggugauucgcgaag

SEQ ID NO: 6708 - RNA, 19 nt, Artificial Sequence
  RNA Oligomer
gcacaggaaaaaccaccag

SEQ ID NO: 6709 - RNA, 19 nt, Artificial Sequence
  RNA Oligomer
accacucaagaacugucaa

SEQ ID NO: 6710 - RNA, 19 nt, Artificial Sequence
  RNA Oligomer
gcuugugcacauucauuuu

SEQ ID NO: 6711 - RNA, 19 nt, Artificial Sequence
  RNA Oligomer
augcugcauuuaucguuaa

SEQ ID NO: 6712 - RNA, 19 nt, Artificial Sequence
  RNA Oligomer
ccgucugcuggaguauaca

SEQ ID NO: 6713 - RNA, 19 nt, Artificial Sequence
  RNA Oligomer
acuaaggauucgucaggaa

SEQ ID NO: 6714 - RNA, 19 nt, Artificial Sequence
  RNA Oligomer
guauuaaaacucugugacu

SEQ ID NO: 6715 - RNA, 19 nt, Artificial Sequence
  RNA Oligomer
agaagaaagaugaggucua

SEQ ID NO: 6716 - RNA, 19 nt, Artificial Sequence
  RNA Oligomer
ugcguuauuucuucuacuc

SEQ ID NO: 6717 - RNA, 19 nt, Artificial Sequence
  RNA Oligomer
cgauugcguuauuucuucu

SEQ ID NO: 6718 - RNA, 19 nt, Artificial Sequence
  RNA Oligomer
acuguaacauaguccgauu

SEQ ID NO: 6719 - RNA, 19 nt, Artificial Sequence
  RNA Oligomer
cacuguaacauaguccgau

SEQ ID NO: 6720 - RNA, 19 nt, Artificial Sequence
  RNA Oligomer
ucaugagaaagcuagauca

SEQ ID NO: 6721 - RNA, 19 nt, Artificial Sequence
  RNA Oligomer
aggacaagagauuuaagaa

SEQ ID NO: 6722 - RNA, 19 nt, Artificial Sequence
  RNA Oligomer
caggacaagagauuuaaga

SEQ ID NO: 6723 - RNA, 19 nt, Artificial Sequence
  RNA Oligomer
gcaggacaagagauuuaag

SEQ ID NO: 6724 - RNA, 19 nt, Artificial Sequence
  RNA Oligomer
ggucgccaucaagaaagua

SEQ ID NO: 6725 - RNA, 19 nt, Artificial Sequence
  RNA Oligomer
aucauuuggugugguauau

SEQ ID NO: 6726 - RNA, 19 nt, Artificial Sequence
  RNA Oligomer
gcuauacagacacuaaagu

SEQ ID NO: 6727 - RNA, 19 nt, Artificial Sequence
  RNA Oligomer
aggaaaaggugauucgcga

SEQ ID NO: 6728 - RNA, 19 nt, Artificial Sequence
  RNA Oligomer
ccaguuacuugagugucac

SEQ ID NO: 6729 - RNA, 19 nt, Artificial Sequence
  RNA Oligomer
gcugcauuuaucguuaacc

SEQ ID NO: 6730 - RNA, 19 nt, Artificial Sequence
  RNA Oligomer
acuuaaugcugcauuuauc

SEQ ID NO: 6731 - RNA, 19 nt, Artificial Sequence
  RNA Oligomer
aacccaaacuacacagaau

SEQ ID NO: 6732 - RNA, 19 nt, Artificial Sequence
  RNA Oligomer
gcugagcuguuacuaggac

SEQ ID NO: 6733 - RNA, 19 nt, Artificial Sequence
  RNA Oligomer
ccgaggagaacccaauguu

SEQ ID NO: 6734 - RNA, 19 nt, Artificial Sequence
  RNA Oligomer
aagaggacgaagucuuuuu

SEQ ID NO: 6735 - RNA, 19 nt, Artificial Sequence
  RNA Oligomer
cucccugugauuuauguca

SEQ ID NO: 6736 - RNA, 19 nt, Artificial Sequence
  RNA Oligomer
cuguaacauaguccgauug

SEQ ID NO: 6737 - RNA, 19 nt, Artificial Sequence
  RNA Oligomer
agaucacuguaacauaguc

SEQ ID NO: 6738 - RNA, 19 nt, Artificial Sequence
  RNA Oligomer
gauuggaaauggaucauuu

SEQ ID NO: 6739 - RNA, 19 nt, Artificial Sequence
  RNA Oligomer
ccgaucugucuugaaggag

SEQ ID NO: 6740 - RNA, 19 nt, Artificial Sequence
  RNA Oligomer
gaaaaaccaccaguuacuu

SEQ ID NO: 6741 - RNA, 19 nt, Artificial Sequence
  RNA Oligomer
ugguguggaucaguuggua

SEQ ID NO: 6742 - RNA, 19 nt, Artificial Sequence
  RNA Oligomer
auagugguguggaucaguu

SEQ ID NO: 6743 - RNA, 19 nt, Artificial Sequence
  RNA Oligomer
gggauagugguguggauca

SEQ ID NO: 6744 - RNA, 19 nt, Artificial Sequence
  RNA Oligomer
cugagcuguuacuaggaca

SEQ ID NO: 6745 - RNA, 19 nt, Artificial Sequence
  RNA Oligomer
ccggaaacaguauacagag

SEQ ID NO: 6746 - RNA, 19 nt, Artificial Sequence
  RNA Oligomer
uugcaggacaagagauuua

SEQ ID NO: 6747 - RNA, 19 nt, Artificial Sequence
  RNA Oligomer
acuuugugauucaggagaa

SEQ ID NO: 6748 - RNA, 19 nt, Artificial Sequence
  RNA Oligomer
gugauuggaaauggaucau

SEQ ID NO: 6749 - RNA, 19 nt, Artificial Sequence
  RNA Oligomer
ugacaacagugguggcaac

SEQ ID NO: 6750 - RNA, 19 nt, Artificial Sequence
  RNA Oligomer
gcagcaugaaaguuagcag

SEQ ID NO: 6751 - RNA, 19 nt, Artificial Sequence
  RNA Oligomer
ucgcgaagagagugaucau

SEQ ID NO: 6752 - RNA, 19 nt, Artificial Sequence
  RNA Oligomer
cgugccgaucugucuugaa

SEQ ID NO: 6753 - RNA, 19 nt, Artificial Sequence
  RNA Oligomer
agaugcuaauacuggagac

SEQ ID NO: 6754 - RNA, 19 nt, Artificial Sequence
  RNA Oligomer
ugugcacauucauuuuuug

SEQ ID NO: 6755 - RNA, 19 nt, Artificial Sequence
  RNA Oligomer
uaaugcugcauuuaucguu

SEQ ID NO: 6756 - RNA, 19 nt, Artificial Sequence
  RNA Oligomer
agcaaaucagagaaaugaa

SEQ ID NO: 6757 - RNA, 19 nt, Artificial Sequence
  RNA Oligomer
ggcugagcuguuacuagga

SEQ ID NO: 6758 - RNA, 19 nt, Artificial Sequence
  RNA Oligomer
cuaguauagauguaugguc

SEQ ID NO: 6759 - RNA, 19 nt, Artificial Sequence
  RNA Oligomer
ccucuuguuggauccugau

SEQ ID NO: 6760 - RNA, 19 nt, Artificial Sequence
  RNA Oligomer
acagaguugccagacacua

SEQ ID NO: 6761 - RNA, 19 nt, Artificial Sequence
  RNA Oligomer
gauugcguuauuucuucua

SEQ ID NO: 6762 - RNA, 19 nt, Artificial Sequence
  RNA Oligomer
gaucaugagaaagcuagau

SEQ ID NO: 6763 - RNA, 19 nt, Artificial Sequence
  RNA Oligomer
uccagaucaugagaaagcu

SEQ ID NO: 6764 - RNA, 19 nt, Artificial Sequence
  RNA Oligomer
guauugcaggacaagagau

SEQ ID NO: 6765 - RNA, 19 nt, Artificial Sequence
  RNA Oligomer
accaguuacuugaguguca

SEQ ID NO: 6766 - RNA, 19 nt, Artificial Sequence
  RNA Oligomer
ugcuaauacuggagaccgu

SEQ ID NO: 6767 - RNA, 19 nt, Artificial Sequence
  RNA Oligomer
cagaugcuaauacuggaga

SEQ ID NO: 6768 - RNA, 19 nt, Artificial Sequence
  RNA Oligomer
guguggaucaguugguaga

SEQ ID NO: 6769 - RNA, 19 nt, Artificial Sequence
  RNA Oligomer
gugguguggaucaguuggu

SEQ ID NO: 6770 - RNA, 19 nt, Artificial Sequence
  RNA Oligomer
guguguuggcugagcuguu

SEQ ID NO: 6771 - RNA, 19 nt, Artificial Sequence
  RNA Oligomer
uggauccugauacugcugu

SEQ ID NO: 6772 - RNA, 19 nt, Artificial Sequence
  RNA Oligomer
cucuuguuggauccugaua

SEQ ID NO: 6773 - RNA, 19 nt, Artificial Sequence
  RNA Oligomer
ugagaagaaagaugagguc

SEQ ID NO: 6774 - RNA, 19 nt, Artificial Sequence
  RNA Oligomer
uugcguuauuucuucuacu

SEQ ID NO: 6775 - RNA, 19 nt, Artificial Sequence
  RNA Oligomer
uccgauugcguuauuucuu

SEQ ID NO: 6776 - RNA, 19 nt, Artificial Sequence
  RNA Oligomer
cagaucaugagaaagcuag

SEQ ID NO: 6777 - RNA, 19 nt, Artificial Sequence
  RNA Oligomer
caaacuuugugauucagga

SEQ ID NO: 6778 - RNA, 19 nt, Artificial Sequence
  RNA Oligomer
gcaaggugacaacaguggu

SEQ ID NO: 6779 - RNA, 19 nt, Artificial Sequence
  RNA Oligomer
ugauucgcgaagagaguga

SEQ ID NO: 6780 - RNA, 19 nt, Artificial Sequence
  RNA Oligomer
cuuguuggauccugauacu

SEQ ID NO: 6781 - RNA, 19 nt, Artificial Sequence
  RNA Oligomer
gcguuauuucuucuacucc

SEQ ID NO: 6782 - RNA, 19 nt, Artificial Sequence
  RNA Oligomer
uaguccgauugcguuauuu

SEQ ID NO: 6783 - RNA, 19 nt, Artificial Sequence
  RNA Oligomer
caaggugacaacaguggug

SEQ ID NO: 6784 - RNA, 19 nt, Artificial Sequence
  RNA Oligomer
gggacccaaaugucaaacu

SEQ ID NO: 6785 - RNA, 19 nt, Artificial Sequence
  RNA Oligomer
gugagaagaaagaugaggu

SEQ ID NO: 6786 - RNA, 19 nt, Artificial Sequence
  RNA Oligomer
cauaguccgauugcguuau

SEQ ID NO: 6787 - RNA, 19 nt, Artificial Sequence
  RNA Oligomer
acauaguccgauugcguua

SEQ ID NO: 6788 - RNA, 19 nt, Artificial Sequence
  RNA Oligomer
cagcaugaaaguuagcaga

SEQ ID NO: 6789 - RNA, 19 nt, Artificial Sequence
  RNA Oligomer
ggaaauggaucauuuggug

SEQ ID NO: 6790 - RNA, 19 nt, Artificial Sequence
  RNA Oligomer
gcuucugcaucagcuucca

SEQ ID NO: 6791 - RNA, 19 nt, Artificial Sequence
  RNA Oligomer
ccucuggcuaccauccuua

SEQ ID NO: 6792 - RNA, 19 nt, Artificial Sequence
  RNA Oligomer
acgggacccaaaugucaaa

SEQ ID NO: 6793 - RNA, 19 nt, Artificial Sequence
  RNA Oligomer
acaggacauuucaccucag

SEQ ID NO: 6794 - RNA, 19 nt, Artificial Sequence
  RNA Oligomer
gacgaagucuuuuucuuuu

SEQ ID NO: 6795 - RNA, 19 nt, Artificial Sequence
  RNA Oligomer
ggacgaagucuuuuucuuu

SEQ ID NO: 6796 - RNA, 19 nt, Artificial Sequence
  RNA Oligomer
cuggcuaccauccuuauuc

SEQ ID NO: 6797 - RNA, 19 nt, Artificial Sequence
  RNA Oligomer
accucuggcuaccauccuu

SEQ ID NO: 6798 - RNA, 19 nt, Artificial Sequence
  RNA Oligomer
cgggacccaaaugucaaac

SEQ ID NO: 6799 - RNA, 19 nt, Artificial Sequence
  RNA Oligomer
cccucaaauuaaggcacau

SEQ ID NO: 6800 - RNA, 19 nt, Artificial Sequence
  RNA Oligomer
gccacaagaagucagcuau

SEQ ID NO: 6801 - RNA, 19 nt, Artificial Sequence
  RNA Oligomer
ggccacaagaagucagcua

SEQ ID NO: 6802 - RNA, 19 nt, Artificial Sequence
  RNA Oligomer
ggcagcaugaaaguuagca

SEQ ID NO: 6803 - RNA, 19 nt, Artificial Sequence
  RNA Oligomer
ccguggacagaccaauaau

SEQ ID NO: 6804 - RNA, 19 nt, Artificial Sequence
  RNA Oligomer
ucaccacucaagaacuguc

SEQ ID NO: 6805 - RNA, 19 nt, Artificial Sequence
  RNA Oligomer
acuggaagcuugugcacau

SEQ ID NO: 6806 - RNA, 19 nt, Artificial Sequence
  RNA Oligomer
cuaacaccacuggaagcuu

SEQ ID NO: 6807 - RNA, 19 nt, Artificial Sequence
  RNA Oligomer
ucccucaaauuaaggcaca

SEQ ID NO: 6808 - RNA, 19 nt, Artificial Sequence
  RNA Oligomer
ggacaaccaauauuuccag

SEQ ID NO: 6809 - RNA, 19 nt, Artificial Sequence
  RNA Oligomer
cuguuacuaggacaaccaa

SEQ ID NO: 6810 - RNA, 19 nt, Artificial Sequence
  RNA Oligomer
uccugauacugcuguauua

SEQ ID NO: 6811 - RNA, 19 nt, Artificial Sequence
  RNA Oligomer
aggacgaagucuuuuucuu

SEQ ID NO: 6812 - RNA, 19 nt, Artificial Sequence
  RNA Oligomer
agaguugccagacacuaua

SEQ ID NO: 6813 - RNA, 19 nt, Artificial Sequence
  RNA Oligomer
agccaaacuuugugauuca

SEQ ID NO: 6814 - RNA, 19 nt, Artificial Sequence
  RNA Oligomer
accguggacagaccaauaa

SEQ ID NO: 6815 - RNA, 19 nt, Artificial Sequence
  RNA Oligomer
cucuggcuaccauccuuau

SEQ ID NO: 6816 - RNA, 19 nt, Artificial Sequence
  RNA Oligomer
cguuauuucuucuacucca

SEQ ID NO: 6817 - RNA, 19 nt, Artificial Sequence
  RNA Oligomer
auccaccucuggcuaccau

SEQ ID NO: 6818 - RNA, 19 nt, Artificial Sequence
  RNA Oligomer
gucaaguaauccaccucug

SEQ ID NO: 6819 - RNA, 19 nt, Artificial Sequence
  RNA Oligomer
gaagcuugugcacauucau

SEQ ID NO: 6820 - RNA, 19 nt, Artificial Sequence
  RNA Oligomer
uacuaggacaaccaauauu

SEQ ID NO: 6821 - RNA, 19 nt, Artificial Sequence
  RNA Oligomer
cugauacugcuguauuaaa

SEQ ID NO: 6822 - RNA, 19 nt, Artificial Sequence
  RNA Oligomer
agcuccagaucaugagaaa

SEQ ID NO: 6823 - RNA, 19 nt, Artificial Sequence
  RNA Oligomer
uggaaauggaucauuuggu

SEQ ID NO: 6824 - RNA, 19 nt, Artificial Sequence
  RNA Oligomer
cagcuuuuggcagcaugaa

SEQ ID NO: 6825 - RNA, 19 nt, Artificial Sequence
  RNA Oligomer
caggaaaaaccaccaguua

SEQ ID NO: 6826 - RNA, 19 nt, Artificial Sequence
  RNA Oligomer
gcaucagcuuccaacucca

SEQ ID NO: 6827 - RNA, 19 nt, Artificial Sequence
  RNA Oligomer
cguggacagaccaauaaug

SEQ ID NO: 6828 - RNA, 19 nt, Artificial Sequence
  RNA Oligomer
uccuccucaugcucggauu

SEQ ID NO: 6829 - RNA, 19 nt, Artificial Sequence
  RNA Oligomer
ccacucaagaacugucaag

SEQ ID NO: 6830 - RNA, 19 nt, Artificial Sequence
  RNA Oligomer
ggcacauccuuggacuaag

SEQ ID NO: 6831 - RNA, 19 nt, Artificial Sequence
  RNA Oligomer
cucugugacuuuggaagug

SEQ ID NO: 6832 - RNA, 19 nt, Artificial Sequence
  RNA Oligomer
ccugauacugcuguauuaa

SEQ ID NO: 6833 - RNA, 19 nt, Artificial Sequence
  RNA Oligomer
gccaagaggacgaagucuu

SEQ ID NO: 6834 - RNA, 19 nt, Artificial Sequence
  RNA Oligomer
cccugugauuuaugucaag

SEQ ID NO: 6835 - RNA, 19 nt, Artificial Sequence
  RNA Oligomer
caagagauuuaagaaucga

SEQ ID NO: 6836 - RNA, 19 nt, Artificial Sequence
  RNA Oligomer
acaggaaaaaccaccaguu

SEQ ID NO: 6837 - RNA, 19 nt, Artificial Sequence
  RNA Oligomer
agcagcgucagaugcuaau

SEQ ID NO: 6838 - RNA, 19 nt, Artificial Sequence
  RNA Oligomer
ucgucaggaacaggacauu

SEQ ID NO: 6839 - RNA, 19 nt, Artificial Sequence
  RNA Oligomer
acagaauuuaaauucccuc

SEQ ID NO: 6840 - RNA, 19 nt, Artificial Sequence
  RNA Oligomer
cacagaauuuaaauucccu

SEQ ID NO: 6841 - RNA, 19 nt, Artificial Sequence
  RNA Oligomer
ugaacccaaacuacacaga

SEQ ID NO: 6842 - RNA, 19 nt, Artificial Sequence
  RNA Oligomer
gcuguuacuaggacaacca

SEQ ID NO: 6843 - RNA, 19 nt, Artificial Sequence
  RNA Oligomer
uccgaggagaacccaaugu

SEQ ID NO: 6844 - RNA, 19 nt, Artificial Sequence
  RNA Oligomer
gccagacacuauagucgag

SEQ ID NO: 6845 - RNA, 19 nt, Artificial Sequence
  RNA Oligomer
gcuggacuauguuccggaa

SEQ ID NO: 6846 - RNA, 19 nt, Artificial Sequence
  RNA Oligomer
gagcuccagaucaugagaa

SEQ ID NO: 6847 - RNA, 19 nt, Artificial Sequence
  RNA Oligomer
cuucagcuuuuggcagcau

SEQ ID NO: 6848 - RNA, 19 nt, Artificial Sequence
  RNA Oligomer
agaacugucaaguaaucca

SEQ ID NO: 6849 - RNA, 19 nt, Artificial Sequence
  RNA Oligomer
gagacacaccugcacucuu

SEQ ID NO: 6850 - RNA, 19 nt, Artificial Sequence
  RNA Oligomer
gaacaggacauuucaccuc

SEQ ID NO: 6851 - RNA, 19 nt, Artificial Sequence
  RNA Oligomer
guccugggaacuccaacaa

SEQ ID NO: 6852 - RNA, 19 nt, Artificial Sequence
  RNA Oligomer
cugugacuuuggaagugca

SEQ ID NO: 6853 - RNA, 19 nt, Artificial Sequence
  RNA Oligomer
ccaagaggacgaagucuuu

SEQ ID NO: 6854 - RNA, 19 nt, Artificial Sequence
  RNA Oligomer
cagaguugccagacacuau

SEQ ID NO: 6855 - RNA, 19 nt, Artificial Sequence
  RNA Oligomer
agagauuuaagaaucgaga

SEQ ID NO: 6856 - RNA, 19 nt, Artificial Sequence
  RNA Oligomer
gugugguauaucaagccaa

SEQ ID NO: 6857 - RNA, 19 nt, Artificial Sequence
  RNA Oligomer
gucagcuauacagacacua

SEQ ID NO: 6858 - RNA, 19 nt, Artificial Sequence
  RNA Oligomer
gaacugucaaguaauccac

SEQ ID NO: 6859 - RNA, 19 nt, Artificial Sequence
  RNA Oligomer
agcuugugcacauucauuu

SEQ ID NO: 6860 - RNA, 19 nt, Artificial Sequence
  RNA Oligomer
ggaguauacaccaacugcc

SEQ ID NO: 6861 - RNA, 19 nt, Artificial Sequence
  RNA Oligomer
gcuggaguauacaccaacu

SEQ ID NO: 6862 - RNA, 19 nt, Artificial Sequence
  RNA Oligomer
cugcuggaguauacaccaa

SEQ ID NO: 6863 - RNA, 19 nt, Artificial Sequence
  RNA Oligomer
cgucaggaacaggacauuu

SEQ ID NO: 6864 - RNA, 19 nt, Artificial Sequence
  RNA Oligomer
aggcacauccuuggacuaa

SEQ ID NO: 6865 - RNA, 19 nt, Artificial Sequence
  RNA Oligomer
ccucaaauuaaggcacauc

SEQ ID NO: 6866 - RNA, 19 nt, Artificial Sequence
  RNA Oligomer
aggacaaccaauauuucca

SEQ ID NO: 6867 - RNA, 19 nt, Artificial Sequence
  RNA Oligomer
gacaagagauuuaagaauc

SEQ ID NO: 6868 - RNA, 19 nt, Artificial Sequence
  RNA Oligomer
agacaggccacaagaaguc

SEQ ID NO: 6869 - RNA, 19 nt, Artificial Sequence
  RNA Oligomer
gcuuuuggcagcaugaaag

SEQ ID NO: 6870 - RNA, 19 nt, Artificial Sequence
  RNA Oligomer
agcuuuuggcagcaugaaa

SEQ ID NO: 6871 - RNA, 19 nt, Artificial Sequence
  RNA Oligomer
gcagcgucagaugcuaaua

SEQ ID NO: 6872 - RNA, 19 nt, Artificial Sequence
  RNA Oligomer
cggauucaagcagcugcuu

SEQ ID NO: 6873 - RNA, 19 nt, Artificial Sequence
  RNA Oligomer
uccucaugcucggauucaa

SEQ ID NO: 6874 - RNA, 19 nt, Artificial Sequence
  RNA Oligomer
cuggaguauacaccaacug

SEQ ID NO: 6875 - RNA, 19 nt, Artificial Sequence
  RNA Oligomer
ggaacaggacauuucaccu

SEQ ID NO: 6876 - RNA, 19 nt, Artificial Sequence
  RNA Oligomer
cuccaacaagggagcaaau

SEQ ID NO: 6877 - RNA, 19 nt, Artificial Sequence
  RNA Oligomer
ccugugauuuaugucaagu

SEQ ID NO: 6878 - RNA, 19 nt, Artificial Sequence
  RNA Oligomer
acagacgcucccugugauu

SEQ ID NO: 6879 - RNA, 19 nt, Artificial Sequence
  RNA Oligomer
ccagacacuauagucgagc

SEQ ID NO: 6880 - RNA, 19 nt, Artificial Sequence
  RNA Oligomer
cuggacuauguuccggaaa

SEQ ID NO: 6881 - RNA, 19 nt, Artificial Sequence
  RNA Oligomer
agaugaggucuaucuuaau

SEQ ID NO: 6882 - RNA, 19 nt, Artificial Sequence
  RNA Oligomer
agcuagaucacuguaacau

SEQ ID NO: 6883 - RNA, 19 nt, Artificial Sequence
  RNA Oligomer
cuggucgccaucaagaaag

SEQ ID NO: 6884 - RNA, 19 nt, Artificial Sequence
  RNA Oligomer
acacuaaagugauuggaaa

SEQ ID NO: 6885 - RNA, 19 nt, Artificial Sequence
  RNA Oligomer
uacagacacuaaagugauu

SEQ ID NO: 6886 - RNA, 19 nt, Artificial Sequence
  RNA Oligomer
uccaacuccaccugaacag

SEQ ID NO: 6887 - RNA, 19 nt, Artificial Sequence
  RNA Oligomer
gcugcuucugcaucagcuu

SEQ ID NO: 6888 - RNA, 19 nt, Artificial Sequence
  RNA Oligomer
caauaaugcugcuucugca

SEQ ID NO: 6889 - RNA, 19 nt, Artificial Sequence
  RNA Oligomer
cagaauuuaaauucccuca

SEQ ID NO: 6890 - RNA, 19 nt, Artificial Sequence
  RNA Oligomer
acuccaacaagggagcaaa

SEQ ID NO: 6891 - RNA, 19 nt, Artificial Sequence
  RNA Oligomer
agaggacgaagucuuuuuc

SEQ ID NO: 6892 - RNA, 19 nt, Artificial Sequence
  RNA Oligomer
ggacuauguuccggaaaca

SEQ ID NO: 6893 - RNA, 19 nt, Artificial Sequence
  RNA Oligomer
ugagaaagcuagaucacug

SEQ ID NO: 6894 - RNA, 19 nt, Artificial Sequence
  RNA Oligomer
agaaucgagagcuccagau

SEQ ID NO: 6895 - RNA, 19 nt, Artificial Sequence
  RNA Oligomer
ggugugguauaucaagcca

SEQ ID NO: 6896 - RNA, 19 nt, Artificial Sequence
  RNA Oligomer
gacacuaaagugauuggaa

SEQ ID NO: 6897 - RNA, 19 nt, Artificial Sequence
  RNA Oligomer
agacacuaaagugauugga

SEQ ID NO: 6898 - RNA, 19 nt, Artificial Sequence
  RNA Oligomer
ccaccaguuacuugagugu

SEQ ID NO: 6899 - RNA, 19 nt, Artificial Sequence
  RNA Oligomer
acagaccaauaaugcugcu

SEQ ID NO: 6900 - RNA, 19 nt, Artificial Sequence
  RNA Oligomer
gucagaugcuaauacugga

SEQ ID NO: 6901 - RNA, 19 nt, Artificial Sequence
  RNA Oligomer
acagcagcgucagaugcua

SEQ ID NO: 6902 - RNA, 19 nt, Artificial Sequence
  RNA Oligomer
ggauucaagcagcugcuuc

SEQ ID NO: 6903 - RNA, 19 nt, Artificial Sequence
  RNA Oligomer
cugucaaguaauccaccuc

SEQ ID NO: 6904 - RNA, 19 nt, Artificial Sequence
  RNA Oligomer
cacucaagaacugucaagu

SEQ ID NO: 6905 - RNA, 19 nt, Artificial Sequence
  RNA Oligomer
ugaugaauuacgggaccca

SEQ ID NO: 6906 - RNA, 19 nt, Artificial Sequence
  RNA Oligomer
ugcuggaguauacaccaac

SEQ ID NO: 6907 - RNA, 19 nt, Artificial Sequence
  RNA Oligomer
ggacuaaggauucgucagg

SEQ ID NO: 6908 - RNA, 19 nt, Artificial Sequence
  RNA Oligomer
gcacauccuuggacuaagg

SEQ ID NO: 6909 - RNA, 19 nt, Artificial Sequence
  RNA Oligomer
acaguauacagaguugcca

SEQ ID NO: 6910 - RNA, 19 nt, Artificial Sequence
  RNA Oligomer
cuccaguggugagaagaaa

SEQ ID NO: 6911 - RNA, 19 nt, Artificial Sequence
  RNA Oligomer
acaagagauuuaagaaucg

SEQ ID NO: 6912 - RNA, 19 nt, Artificial Sequence
  RNA Oligomer
ugauucaggagaacugguc

SEQ ID NO: 6913 - RNA, 19 nt, Artificial Sequence
  RNA Oligomer
gccaaacuuugugauucag

SEQ ID NO: 6914 - RNA, 19 nt, Artificial Sequence
  RNA Oligomer
cacaggaaaaaccaccagu

SEQ ID NO: 6915 - RNA, 19 nt, Artificial Sequence
  RNA Oligomer
ccaauaaugcugcuucugc

SEQ ID NO: 6916 - RNA, 19 nt, Artificial Sequence
  RNA Oligomer
agcgucagaugcuaauacu

SEQ ID NO: 6917 - RNA, 19 nt, Artificial Sequence
  RNA Oligomer
cagcgucagaugcuaauac

SEQ ID NO: 6918 - RNA, 19 nt, Artificial Sequence
  RNA Oligomer
ucggauucaagcagcugcu

SEQ ID NO: 6919 - RNA, 19 nt, Artificial Sequence
  RNA Oligomer
ugcucggauucaagcagcu

SEQ ID NO: 6920 - RNA, 19 nt, Artificial Sequence
  RNA Oligomer
agccgucugcuggaguaua

SEQ ID NO: 6921 - RNA, 19 nt, Artificial Sequence
  RNA Oligomer
gacuaaggauucgucagga

SEQ ID NO: 6922 - RNA, 19 nt, Artificial Sequence
  RNA Oligomer
acacagaauuuaaauuccc

SEQ ID NO: 6923 - RNA, 19 nt, Artificial Sequence
  RNA Oligomer
aucagagaaaugaacccaa

SEQ ID NO: 6924 - RNA, 19 nt, Artificial Sequence
  RNA Oligomer
caagaggacgaagucuuuu

SEQ ID NO: 6925 - RNA, 19 nt, Artificial Sequence
  RNA Oligomer
agacacuauagucgagcca

SEQ ID NO: 6926 - RNA, 19 nt, Artificial Sequence
  RNA Oligomer
aagaugaggucuaucuuaa

SEQ ID NO: 6927 - RNA, 19 nt, Artificial Sequence
  RNA Oligomer
cuacuccaguggugagaag

SEQ ID NO: 6928 - RNA, 19 nt, Artificial Sequence
  RNA Oligomer
agaccguggacagaccaau

SEQ ID NO: 6929 - RNA, 19 nt, Artificial Sequence
  RNA Oligomer
gaagugcaaagcagcuggu

SEQ ID NO: 6930 - RNA, 19 nt, Artificial Sequence
  RNA Oligomer
gaaagaugaggucuaucuu

SEQ ID NO: 6931 - RNA, 19 nt, Artificial Sequence
  RNA Oligomer
agaaagaugaggucuaucu

SEQ ID NO: 6932 - RNA, 19 nt, Artificial Sequence
  RNA Oligomer
ccuucagcuuuuggcagca

SEQ ID NO: 6933 - RNA, 19 nt, Artificial Sequence
  RNA Oligomer
gagugucacucagcaacac

SEQ ID NO: 6934 - RNA, 19 nt, Artificial Sequence
  RNA Oligomer
gcgucagaugcuaauacug

SEQ ID NO: 6935 - RNA, 19 nt, Artificial Sequence
  RNA Oligomer
gauccugauacugcuguau

SEQ ID NO: 6936 - RNA, 19 nt, Artificial Sequence
  RNA Oligomer
ucagcuguuccgaaguuua

SEQ ID NO: 6937 - RNA, 19 nt, Artificial Sequence
  RNA Oligomer
gacacuauagucgagccaa

SEQ ID NO: 6938 - RNA, 19 nt, Artificial Sequence
  RNA Oligomer
uggacuauguuccggaaac

SEQ ID NO: 6939 - RNA, 19 nt, Artificial Sequence
  RNA Oligomer
aucgagagcuccagaucau

SEQ ID NO: 6940 - RNA, 19 nt, Artificial Sequence
  RNA Oligomer
ucaagccaaacuuugugau

SEQ ID NO: 6941 - RNA, 19 nt, Artificial Sequence
  RNA Oligomer
cacuaaagugauuggaaau

SEQ ID NO: 6942 - RNA, 19 nt, Artificial Sequence
  RNA Oligomer
ugcugcuucugcaucagcu

SEQ ID NO: 6943 - RNA, 19 nt, Artificial Sequence
  RNA Oligomer
ucagaugcuaauacuggag

SEQ ID NO: 6944 - RNA, 19 nt, Artificial Sequence
  RNA Oligomer
ggcaauugcacuguguagc

SEQ ID NO: 6945 - RNA, 19 nt, Artificial Sequence
  RNA Oligomer
gaggcaauugcacugugua

SEQ ID NO: 6946 - RNA, 19 nt, Artificial Sequence
  RNA Oligomer
ccuuggacuaaggauucgu

SEQ ID NO: 6947 - RNA, 19 nt, Artificial Sequence
  RNA Oligomer
cauccuuggacuaaggauu

SEQ ID NO: 6948 - RNA, 19 nt, Artificial Sequence
  RNA Oligomer
acauccuuggacuaaggau

SEQ ID NO: 6949 - RNA, 19 nt, Artificial Sequence
  RNA Oligomer
cgaagucuuuuucuuuuuc

SEQ ID NO: 6950 - RNA, 19 nt, Artificial Sequence
  RNA Oligomer
uccggaaacaguauacaga

SEQ ID NO: 6951 - RNA, 19 nt, Artificial Sequence
  RNA Oligomer
acagacacuaaagugauug

SEQ ID NO: 6952 - RNA, 19 nt, Artificial Sequence
  RNA Oligomer
accaccaguuacuugagug

SEQ ID NO: 6953 - RNA, 19 nt, Artificial Sequence
  RNA Oligomer
aucagcuguuccgaaguuu

SEQ ID NO: 6954 - RNA, 19 nt, Artificial Sequence
  RNA Oligomer
ccaaacuuugugauucagg

SEQ ID NO: 6955 - RNA, 19 nt, Artificial Sequence
  RNA Oligomer
gcuuccaacuccaccugaa

SEQ ID NO: 6956 - RNA, 19 nt, Artificial Sequence
  RNA Oligomer
ucagcuuccaacuccaccu

SEQ ID NO: 6957 - RNA, 19 nt, Artificial Sequence
  RNA Oligomer
caaauuaaggcacauccuu

SEQ ID NO: 6958 - RNA, 19 nt, Artificial Sequence
  RNA Oligomer
ucaaauuaaggcacauccu

SEQ ID NO: 6959 - RNA, 19 nt, Artificial Sequence
  RNA Oligomer
caagccaaacuuugugauu

SEQ ID NO: 6960 - RNA, 19 nt, Artificial Sequence
  RNA Oligomer
uccagacaggccacaagaa

SEQ ID NO: 6961 - RNA, 19 nt, Artificial Sequence
  RNA Oligomer
agccagcugcacaggaaaa

SEQ ID NO: 6962 - RNA, 19 nt, Artificial Sequence
  RNA Oligomer
agagaaaugaacccaaacu

SEQ ID NO: 6963 - RNA, 19 nt, Artificial Sequence
  RNA Oligomer
cuauguuccggaaacagua

SEQ ID NO: 6964 - RNA, 19 nt, Artificial Sequence
  RNA Oligomer
ugacuuuggaagugcaaag

SEQ ID NO: 6965 - RNA, 19 nt, Artificial Sequence
  RNA Oligomer
agauauacgaaacauuggg

SEQ ID NO: 6966 - RNA, 19 nt, Artificial Sequence
  RNA Oligomer
uuccagugguguuagucgg

SEQ ID NO: 6967 - RNA, 19 nt, Artificial Sequence
  RNA Oligomer
auacgaaacauuggguucu

SEQ ID NO: 6968 - RNA, 19 nt, Artificial Sequence
  RNA Oligomer
ugaggaggaauaaggaugg

SEQ ID NO: 6969 - RNA, 19 nt, Artificial Sequence
  RNA Oligomer
acgaaacauuggguucucc

SEQ ID NO: 6970 - RNA, 19 nt, Artificial Sequence
  RNA Oligomer
aaaugcagcauuaaguucu

SEQ ID NO: 6971 - RNA, 19 nt, Artificial Sequence
  RNA Oligomer
augcagcauuaaguucucc

SEQ ID NO: 6972 - RNA, 19 nt, Artificial Sequence
  RNA Oligomer
gauauacgaaacauugggu

SEQ ID NO: 6973 - RNA, 19 nt, Artificial Sequence
  RNA Oligomer
aacaagcgauauauuucuc

SEQ ID NO: 6974 - RNA, 19 nt, Artificial Sequence
  RNA Oligomer
uauuucuccuucaagacag

SEQ ID NO: 6975 - RNA, 19 nt, Artificial Sequence
  RNA Oligomer
uuugguaguuugacauuug

SEQ ID NO: 6976 - RNA, 19 nt, Artificial Sequence
  RNA Oligomer
cagauauacgaaacauugg

SEQ ID NO: 6977 - RNA, 19 nt, Artificial Sequence
  RNA Oligomer
uuuuuccugugcagcuggc

SEQ ID NO: 6978 - RNA, 19 nt, Artificial Sequence
  RNA Oligomer
uugaagagugcaggugugu

SEQ ID NO: 6979 - RNA, 19 nt, Artificial Sequence
  RNA Oligomer
cuccugaggugaaaugucc

SEQ ID NO: 6980 - RNA, 19 nt, Artificial Sequence
  RNA Oligomer
aaugcagcauuaaguucuc

SEQ ID NO: 6981 - RNA, 19 nt, Artificial Sequence
  RNA Oligomer
uuguccugcaauacuuucu

SEQ ID NO: 6982 - RNA, 19 nt, Artificial Sequence
  RNA Oligomer
ugcaauacuuucuugaugg

SEQ ID NO: 6983 - RNA, 19 nt, Artificial Sequence
  RNA Oligomer
agcgauauauuucuccuuc

SEQ ID NO: 6984 - RNA, 19 nt, Artificial Sequence
  RNA Oligomer
aaguuuggcuugauauacc

SEQ ID NO: 6985 - RNA, 19 nt, Artificial Sequence
  RNA Oligomer
uauauuucuccuucaagac

SEQ ID NO: 6986 - RNA, 19 nt, Artificial Sequence
  RNA Oligomer
augaggaggaauaaggaug

SEQ ID NO: 6987 - RNA, 19 nt, Artificial Sequence
  RNA Oligomer
uggugaaguugaagagugc

SEQ ID NO: 6988 - RNA, 19 nt, Artificial Sequence
  RNA Oligomer
aacuugacauaaaucacag

SEQ ID NO: 6989 - RNA, 19 nt, Artificial Sequence
  RNA Oligomer
aauacuuucuugauggcga

SEQ ID NO: 6990 - RNA, 19 nt, Artificial Sequence
  RNA Oligomer
caagcgauauauuucuccu

SEQ ID NO: 6991 - RNA, 19 nt, Artificial Sequence
  RNA Oligomer
ucuccuucaagacagaucg

SEQ ID NO: 6992 - RNA, 19 nt, Artificial Sequence
  RNA Oligomer
gaggaggaauaaggauggu

SEQ ID NO: 6993 - RNA, 19 nt, Artificial Sequence
  RNA Oligomer
auuacuugacaguucuuga

SEQ ID NO: 6994 - RNA, 19 nt, Artificial Sequence
  RNA Oligomer
ugaaguugaagagugcagg

SEQ ID NO: 6995 - RNA, 19 nt, Artificial Sequence
  RNA Oligomer
cuuccagugguguuagucg

SEQ ID NO: 6996 - RNA, 19 nt, Artificial Sequence
  RNA Oligomer
uacagcaguaucaggaucc

SEQ ID NO: 6997 - RNA, 19 nt, Artificial Sequence
  RNA Oligomer
uugacauaaaucacaggga

SEQ ID NO: 6998 - RNA, 19 nt, Artificial Sequence
  RNA Oligomer
aagcgauauauuucuccuu

SEQ ID NO: 6999 - RNA, 19 nt, Artificial Sequence
  RNA Oligomer
uuuagugucuguauagcug

SEQ ID NO: 7000 - RNA, 19 nt, Artificial Sequence
  RNA Oligomer
uugucucugcuaacuuuca

SEQ ID NO: 7001 - RNA, 19 nt, Artificial Sequence
  RNA Oligomer
aggaauaaggaugguagcc

SEQ ID NO: 7002 - RNA, 19 nt, Artificial Sequence
  RNA Oligomer
ugguaguuugacauuuggg

SEQ ID NO: 7003 - RNA, 19 nt, Artificial Sequence
  RNA Oligomer
auuugggucccguaauuca

SEQ ID NO: 7004 - RNA, 19 nt, Artificial Sequence
  RNA Oligomer
agguuaacgauaaaugcag

SEQ ID NO: 7005 - RNA, 19 nt, Artificial Sequence
  RNA Oligomer
caucaaaaaaugaaugugc

SEQ ID NO: 7006 - RNA, 19 nt, Artificial Sequence
  RNA Oligomer
uaaaugcagcauuaaguuc

SEQ ID NO: 7007 - RNA, 19 nt, Artificial Sequence
  RNA Oligomer
aauucuguguaguuugggu

SEQ ID NO: 7008 - RNA, 19 nt, Artificial Sequence
  RNA Oligomer
ugcagcauuaaguucuccc

SEQ ID NO: 7009 - RNA, 19 nt, Artificial Sequence
  RNA Oligomer
accuugauuauuucuacca

SEQ ID NO: 7010 - RNA, 19 nt, Artificial Sequence
  RNA Oligomer
gauuauuucuaccaacuga

SEQ ID NO: 7011 - RNA, 19 nt, Artificial Sequence
  RNA Oligomer
uuguccuaguaacagcuca

SEQ ID NO: 7012 - RNA, 19 nt, Artificial Sequence
  RNA Oligomer
cugauacauauacaacuug

SEQ ID NO: 7013 - RNA, 19 nt, Artificial Sequence
  RNA Oligomer
cagcaccagauuaagauag

SEQ ID NO: 7014 - RNA, 19 nt, Artificial Sequence
  RNA Oligomer
caccagauuaagauagacc

SEQ ID NO: 7015 - RNA, 19 nt, Artificial Sequence
  RNA Oligomer
caauacuuucuugauggcg

SEQ ID NO: 7016 - RNA, 19 nt, Artificial Sequence
  RNA Oligomer
auacuuucuugauggcgac

SEQ ID NO: 7017 - RNA, 19 nt, Artificial Sequence
  RNA Oligomer
uucgcgaaucaccuuuucc

SEQ ID NO: 7018 - RNA, 19 nt, Artificial Sequence
  RNA Oligomer
agaagcagcauuauugguc

SEQ ID NO: 7019 - RNA, 19 nt, Artificial Sequence
  RNA Oligomer
agcaugaggaggaauaagg

SEQ ID NO: 7020 - RNA, 19 nt, Artificial Sequence
  RNA Oligomer
gaguggugaaguugaagag

SEQ ID NO: 7021 - RNA, 19 nt, Artificial Sequence
  RNA Oligomer
gugaaguugaagagugcag

SEQ ID NO: 7022 - RNA, 19 nt, Artificial Sequence
  RNA Oligomer
uuagucgggcaguuggugu

SEQ ID NO: 7023 - RNA, 19 nt, Artificial Sequence
  RNA Oligomer
gaaauguccuguuccugac

SEQ ID NO: 7024 - RNA, 19 nt, Artificial Sequence
  RNA Oligomer
uuucucugauuugcucccu

SEQ ID NO: 7025 - RNA, 19 nt, Artificial Sequence
  RNA Oligomer
gaccuugauuauuucuacc

SEQ ID NO: 7026 - RNA, 19 nt, Artificial Sequence
  RNA Oligomer
ucacagaguuuuaauacag

SEQ ID NO: 7027 - RNA, 19 nt, Artificial Sequence
  RNA Oligomer
cacagaguuuuaauacagc

SEQ ID NO: 7028 - RNA, 19 nt, Artificial Sequence
  RNA Oligomer
acauaaaucacagggagcg

SEQ ID NO: 7029 - RNA, 19 nt, Artificial Sequence
  RNA Oligomer
accagauuaagauagaccu

SEQ ID NO: 7030 - RNA, 19 nt, Artificial Sequence
  RNA Oligomer
guccugcaauacuuucuug

SEQ ID NO: 7031 - RNA, 19 nt, Artificial Sequence
  RNA Oligomer
uccugcaauacuuucuuga

SEQ ID NO: 7032 - RNA, 19 nt, Artificial Sequence
  RNA Oligomer
auuucuccuucaagacaga

SEQ ID NO: 7033 - RNA, 19 nt, Artificial Sequence
  RNA Oligomer
guuuuuccugugcagcugg

SEQ ID NO: 7034 - RNA, 19 nt, Artificial Sequence
  RNA Oligomer
gaagcagcauuauuggucu

SEQ ID NO: 7035 - RNA, 19 nt, Artificial Sequence
  RNA Oligomer
cagcauuauuggucugucc

SEQ ID NO: 7036 - RNA, 19 nt, Artificial Sequence
  RNA Oligomer
guuagguuaacgauaaaug

SEQ ID NO: 7037 - RNA, 19 nt, Artificial Sequence
  RNA Oligomer
uagguuaacgauaaaugca

SEQ ID NO: 7038 - RNA, 19 nt, Artificial Sequence
  RNA Oligomer
aaugugcacaagcuuccag

SEQ ID NO: 7039 - RNA, 19 nt, Artificial Sequence
  RNA Oligomer
uccuguuccugacgaaucc

SEQ ID NO: 7040 - RNA, 19 nt, Artificial Sequence
  RNA Oligomer
cugauccacaccacuaucc

SEQ ID NO: 7041 - RNA, 19 nt, Artificial Sequence
  RNA Oligomer
acagaguuuuaauacagca

SEQ ID NO: 7042 - RNA, 19 nt, Artificial Sequence
  RNA Oligomer
cagaguuuuaauacagcag

SEQ ID NO: 7043 - RNA, 19 nt, Artificial Sequence
  RNA Oligomer
aacagcugauacauauaca

SEQ ID NO: 7044 - RNA, 19 nt, Artificial Sequence
  RNA Oligomer
gauacauauacaacuugac

SEQ ID NO: 7045 - RNA, 19 nt, Artificial Sequence
  RNA Oligomer
cuguuuggcucgacuauag

SEQ ID NO: 7046 - RNA, 19 nt, Artificial Sequence
  RNA Oligomer
acucuguauacuguuuccg

SEQ ID NO: 7047 - RNA, 19 nt, Artificial Sequence
  RNA Oligomer
uagcuuucucaugaucugg

SEQ ID NO: 7048 - RNA, 19 nt, Artificial Sequence
  RNA Oligomer
gcaauacuuucuugauggc

SEQ ID NO: 7049 - RNA, 19 nt, Artificial Sequence
  RNA Oligomer
acuuucuugauggcgacca

SEQ ID NO: 7050 - RNA, 19 nt, Artificial Sequence
  RNA Oligomer
aguuuggcuugauauacca

SEQ ID NO: 7051 - RNA, 19 nt, Artificial Sequence
  RNA Oligomer
caugaucacucucuucgcg

SEQ ID NO: 7052 - RNA, 19 nt, Artificial Sequence
  RNA Oligomer
acuguucagguggaguugg

SEQ ID NO: 7053 - RNA, 19 nt, Artificial Sequence
  RNA Oligomer
aagcagcauuauuggucug

SEQ ID NO: 7054 - RNA, 19 nt, Artificial Sequence
  RNA Oligomer
ugacaguucuugaguggug

SEQ ID NO: 7055 - RNA, 19 nt, Artificial Sequence
  RNA Oligomer
guggugaaguugaagagug

SEQ ID NO: 7056 - RNA, 19 nt, Artificial Sequence
  RNA Oligomer
aaaaaugaaugugcacaag

SEQ ID NO: 7057 - RNA, 19 nt, Artificial Sequence
  RNA Oligomer
guuaacgauaaaugcagca

SEQ ID NO: 7058 - RNA, 19 nt, Artificial Sequence
  RNA Oligomer
uagucgggcaguuggugua

SEQ ID NO: 7059 - RNA, 19 nt, Artificial Sequence
  RNA Oligomer
cugauuugcucccuuguug

SEQ ID NO: 7060 - RNA, 19 nt, Artificial Sequence
  RNA Oligomer
ggaccuugauuauuucuac

SEQ ID NO: 7061 - RNA, 19 nt, Artificial Sequence
  RNA Oligomer
accgagaacagauauacga

SEQ ID NO: 7062 - RNA, 19 nt, Artificial Sequence
  RNA Oligomer
agaguuuuaauacagcagu

SEQ ID NO: 7063 - RNA, 19 nt, Artificial Sequence
  RNA Oligomer
acaacuugacauaaaucac

SEQ ID NO: 7064 - RNA, 19 nt, Artificial Sequence
  RNA Oligomer
ucuuucuucucaccacugg

SEQ ID NO: 7065 - RNA, 19 nt, Artificial Sequence
  RNA Oligomer
uacagugaucuagcuuucu

SEQ ID NO: 7066 - RNA, 19 nt, Artificial Sequence
  RNA Oligomer
uuaaaucucuuguccugca

SEQ ID NO: 7067 - RNA, 19 nt, Artificial Sequence
  RNA Oligomer
auaccacaccaaaugaucc

SEQ ID NO: 7068 - RNA, 19 nt, Artificial Sequence
  RNA Oligomer
aaugauccauuuccaauca

SEQ ID NO: 7069 - RNA, 19 nt, Artificial Sequence
  RNA Oligomer
cuucgcgaaucaccuuuuc

SEQ ID NO: 7070 - RNA, 19 nt, Artificial Sequence
  RNA Oligomer
cuggugguuuuuccugugc

SEQ ID NO: 7071 - RNA, 19 nt, Artificial Sequence
  RNA Oligomer
uugacaguucuugaguggu

SEQ ID NO: 7072 - RNA, 19 nt, Artificial Sequence
  RNA Oligomer
aaaaugaaugugcacaagc

SEQ ID NO: 7073 - RNA, 19 nt, Artificial Sequence
  RNA Oligomer
uuaacgauaaaugcagcau

SEQ ID NO: 7074 - RNA, 19 nt, Artificial Sequence
  RNA Oligomer
uguauacuccagcagacgg

SEQ ID NO: 7075 - RNA, 19 nt, Artificial Sequence
  RNA Oligomer
uuccugacgaauccuuagu

SEQ ID NO: 7076 - RNA, 19 nt, Artificial Sequence
  RNA Oligomer
agucacagaguuuuaauac

SEQ ID NO: 7077 - RNA, 19 nt, Artificial Sequence
  RNA Oligomer
uagaccucaucuuucuucu

SEQ ID NO: 7078 - RNA, 19 nt, Artificial Sequence
  RNA Oligomer
gaguagaagaaauaacgca

SEQ ID NO: 7079 - RNA, 19 nt, Artificial Sequence
  RNA Oligomer
agaagaaauaacgcaaucg

SEQ ID NO: 7080 - RNA, 19 nt, Artificial Sequence
  RNA Oligomer
aaucggacuauguuacagu

SEQ ID NO: 7081 - RNA, 19 nt, Artificial Sequence
  RNA Oligomer
aucggacuauguuacagug

SEQ ID NO: 7082 - RNA, 19 nt, Artificial Sequence
  RNA Oligomer
ugaucuagcuuucucauga

SEQ ID NO: 7083 - RNA, 19 nt, Artificial Sequence
  RNA Oligomer
uucuuaaaucucuuguccu

SEQ ID NO: 7084 - RNA, 19 nt, Artificial Sequence
  RNA Oligomer
ucuuaaaucucuuguccug

SEQ ID NO: 7085 - RNA, 19 nt, Artificial Sequence
  RNA Oligomer
cuuaaaucucuuguccugc

SEQ ID NO: 7086 - RNA, 19 nt, Artificial Sequence
  RNA Oligomer
uacuuucuugauggcgacc

SEQ ID NO: 7087 - RNA, 19 nt, Artificial Sequence
  RNA Oligomer
auauaccacaccaaaugau

SEQ ID NO: 7088 - RNA, 19 nt, Artificial Sequence
  RNA Oligomer
acuuuagugucuguauagc

SEQ ID NO: 7089 - RNA, 19 nt, Artificial Sequence
  RNA Oligomer
ucgcgaaucaccuuuuccu

SEQ ID NO: 7090 - RNA, 19 nt, Artificial Sequence
  RNA Oligomer
gugacacucaaguaacugg

SEQ ID NO: 7091 - RNA, 19 nt, Artificial Sequence
  RNA Oligomer
gguuaacgauaaaugcagc

SEQ ID NO: 7092 - RNA, 19 nt, Artificial Sequence
  RNA Oligomer
gauaaaugcagcauuaagu

SEQ ID NO: 7093 - RNA, 19 nt, Artificial Sequence
  RNA Oligomer
auucuguguaguuuggguu

SEQ ID NO: 7094 - RNA, 19 nt, Artificial Sequence
  RNA Oligomer
guccuaguaacagcucagc

SEQ ID NO: 7095 - RNA, 19 nt, Artificial Sequence
  RNA Oligomer
aacauuggguucuccucgg

SEQ ID NO: 7096 - RNA, 19 nt, Artificial Sequence
  RNA Oligomer
aaaaagacuucguccucuu

SEQ ID NO: 7097 - RNA, 19 nt, Artificial Sequence
  RNA Oligomer
ugacauaaaucacagggag

SEQ ID NO: 7098 - RNA, 19 nt, Artificial Sequence
  RNA Oligomer
caaucggacuauguuacag

SEQ ID NO: 7099 - RNA, 19 nt, Artificial Sequence
  RNA Oligomer
gacuauguuacagugaucu

SEQ ID NO: 7100 - RNA, 19 nt, Artificial Sequence
  RNA Oligomer
aaaugauccauuuccaauc

SEQ ID NO: 7101 - RNA, 19 nt, Artificial Sequence
  RNA Oligomer
cuccuucaagacagaucgg

SEQ ID NO: 7102 - RNA, 19 nt, Artificial Sequence
  RNA Oligomer
aaguaacuggugguuuuuc

SEQ ID NO: 7103 - RNA, 19 nt, Artificial Sequence
  RNA Oligomer
uaccaacugauccacacca

SEQ ID NO: 7104 - RNA, 19 nt, Artificial Sequence
  RNA Oligomer
aacugauccacaccacuau

SEQ ID NO: 7105 - RNA, 19 nt, Artificial Sequence
  RNA Oligomer
ugauccacaccacuauccc

SEQ ID NO: 7106 - RNA, 19 nt, Artificial Sequence
  RNA Oligomer
uguccuaguaacagcucag

SEQ ID NO: 7107 - RNA, 19 nt, Artificial Sequence
  RNA Oligomer
cucuguauacuguuuccgg

SEQ ID NO: 7108 - RNA, 19 nt, Artificial Sequence
  RNA Oligomer
uaaaucucuuguccugcaa

SEQ ID NO: 7109 - RNA, 19 nt, Artificial Sequence
  RNA Oligomer
uucuccugaaucacaaagu

SEQ ID NO: 7110 - RNA, 19 nt, Artificial Sequence
  RNA Oligomer
augauccauuuccaaucac

SEQ ID NO: 7111 - RNA, 19 nt, Artificial Sequence
  RNA Oligomer
guugccaccacuguuguca

SEQ ID NO: 7112 - RNA, 19 nt, Artificial Sequence
  RNA Oligomer
cugcuaacuuucaugcugc

SEQ ID NO: 7113 - RNA, 19 nt, Artificial Sequence
  RNA Oligomer
augaucacucucuucgcga

SEQ ID NO: 7114 - RNA, 19 nt, Artificial Sequence
  RNA Oligomer
uucaagacagaucggcacg

SEQ ID NO: 7115 - RNA, 19 nt, Artificial Sequence
  RNA Oligomer
gucuccaguauuagcaucu

SEQ ID NO: 7116 - RNA, 19 nt, Artificial Sequence
  RNA Oligomer
caaaaaaugaaugugcaca

SEQ ID NO: 7117 - RNA, 19 nt, Artificial Sequence
  RNA Oligomer
aacgauaaaugcagcauua

SEQ ID NO: 7118 - RNA, 19 nt, Artificial Sequence
  RNA Oligomer
uucauuucucugauuugcu

SEQ ID NO: 7119 - RNA, 19 nt, Artificial Sequence
  RNA Oligomer
uccuaguaacagcucagcc

SEQ ID NO: 7120 - RNA, 19 nt, Artificial Sequence
  RNA Oligomer
gaccauacaucuauacuag

SEQ ID NO: 7121 - RNA, 19 nt, Artificial Sequence
  RNA Oligomer
aucaggauccaacaagagg

SEQ ID NO: 7122 - RNA, 19 nt, Artificial Sequence
  RNA Oligomer
uagugucuggcaacucugu

SEQ ID NO: 7123 - RNA, 19 nt, Artificial Sequence
  RNA Oligomer
uagaagaaauaacgcaauc

SEQ ID NO: 7124 - RNA, 19 nt, Artificial Sequence
  RNA Oligomer
aucuagcuuucucaugauc

SEQ ID NO: 7125 - RNA, 19 nt, Artificial Sequence
  RNA Oligomer
agcuuucucaugaucugga

SEQ ID NO: 7126 - RNA, 19 nt, Artificial Sequence
  RNA Oligomer
aucucuuguccugcaauac

SEQ ID NO: 7127 - RNA, 19 nt, Artificial Sequence
  RNA Oligomer
ugacacucaaguaacuggu

SEQ ID NO: 7128 - RNA, 19 nt, Artificial Sequence
  RNA Oligomer
acggucuccaguauuagca

SEQ ID NO: 7129 - RNA, 19 nt, Artificial Sequence
  RNA Oligomer
ucuccaguauuagcaucug

SEQ ID NO: 7130 - RNA, 19 nt, Artificial Sequence
  RNA Oligomer
ucuaccaacugauccacac

SEQ ID NO: 7131 - RNA, 19 nt, Artificial Sequence
  RNA Oligomer
accaacugauccacaccac

SEQ ID NO: 7132 - RNA, 19 nt, Artificial Sequence
  RNA Oligomer
aacagcucagccaacacac

SEQ ID NO: 7133 - RNA, 19 nt, Artificial Sequence
  RNA Oligomer
acagcaguaucaggaucca

SEQ ID NO: 7134 - RNA, 19 nt, Artificial Sequence
  RNA Oligomer
uaucaggauccaacaagag

SEQ ID NO: 7135 - RNA, 19 nt, Artificial Sequence
  RNA Oligomer
gaccucaucuuucuucuca

SEQ ID NO: 7136 - RNA, 19 nt, Artificial Sequence
  RNA Oligomer
aguagaagaaauaacgcaa

SEQ ID NO: 7137 - RNA, 19 nt, Artificial Sequence
  RNA Oligomer
aagaaauaacgcaaucgga

SEQ ID NO: 7138 - RNA, 19 nt, Artificial Sequence
  RNA Oligomer
cuagcuuucucaugaucug

SEQ ID NO: 7139 - RNA, 19 nt, Artificial Sequence
  RNA Oligomer
uccugaaucacaaaguuug

SEQ ID NO: 7140 - RNA, 19 nt, Artificial Sequence
  RNA Oligomer
accacuguugucaccuugc

SEQ ID NO: 7141 - RNA, 19 nt, Artificial Sequence
  RNA Oligomer
ucacucucuucgcgaauca

SEQ ID NO: 7142 - RNA, 19 nt, Artificial Sequence
  RNA Oligomer
aguaucaggauccaacaag

SEQ ID NO: 7143 - RNA, 19 nt, Artificial Sequence
  RNA Oligomer
ggaguagaagaaauaacgc

SEQ ID NO: 7144 - RNA, 19 nt, Artificial Sequence
  RNA Oligomer
aaauaacgcaaucggacua

SEQ ID NO: 7145 - RNA, 19 nt, Artificial Sequence
  RNA Oligomer
caccacuguugucaccuug

SEQ ID NO: 7146 - RNA, 19 nt, Artificial Sequence
  RNA Oligomer
aguuugacauuuggguccc

SEQ ID NO: 7147 - RNA, 19 nt, Artificial Sequence
  RNA Oligomer
accucaucuuucuucucac

SEQ ID NO: 7148 - RNA, 19 nt, Artificial Sequence
  RNA Oligomer
auaacgcaaucggacuaug

SEQ ID NO: 7149 - RNA, 19 nt, Artificial Sequence
  RNA Oligomer
uaacgcaaucggacuaugu

SEQ ID NO: 7150 - RNA, 19 nt, Artificial Sequence
  RNA Oligomer
ucugcuaacuuucaugcug

SEQ ID NO: 7151 - RNA, 19 nt, Artificial Sequence
  RNA Oligomer
caccaaaugauccauuucc

SEQ ID NO: 7152 - RNA, 19 nt, Artificial Sequence
  RNA Oligomer
uggaagcugaugcagaagc

SEQ ID NO: 7153 - RNA, 19 nt, Artificial Sequence
  RNA Oligomer
uaaggaugguagccagagg

SEQ ID NO: 7154 - RNA, 19 nt, Artificial Sequence
  RNA Oligomer
uuugacauuugggucccgu

SEQ ID NO: 7155 - RNA, 19 nt, Artificial Sequence
  RNA Oligomer
cugaggugaaauguccugu

SEQ ID NO: 7156 - RNA, 19 nt, Artificial Sequence
  RNA Oligomer
aaaagaaaaagacuucguc

SEQ ID NO: 7157 - RNA, 19 nt, Artificial Sequence
  RNA Oligomer
aaagaaaaagacuucgucc

SEQ ID NO: 7158 - RNA, 19 nt, Artificial Sequence
  RNA Oligomer
gaauaaggaugguagccag

SEQ ID NO: 7159 - RNA, 19 nt, Artificial Sequence
  RNA Oligomer
aaggaugguagccagaggu

SEQ ID NO: 7160 - RNA, 19 nt, Artificial Sequence
  RNA Oligomer
guuugacauuugggucccg

SEQ ID NO: 7161 - RNA, 19 nt, Artificial Sequence
  RNA Oligomer
augugccuuaauuugaggg

SEQ ID NO: 7162 - RNA, 19 nt, Artificial Sequence
  RNA Oligomer
auagcugacuucuuguggc

SEQ ID NO: 7163 - RNA, 19 nt, Artificial Sequence
  RNA Oligomer
uagcugacuucuuguggcc

SEQ ID NO: 7164 - RNA, 19 nt, Artificial Sequence
  RNA Oligomer
ugcuaacuuucaugcugcc

SEQ ID NO: 7165 - RNA, 19 nt, Artificial Sequence
  RNA Oligomer
auuauuggucuguccacgg

SEQ ID NO: 7166 - RNA, 19 nt, Artificial Sequence
  RNA Oligomer
gacaguucuugagugguga

SEQ ID NO: 7167 - RNA, 19 nt, Artificial Sequence
  RNA Oligomer
augugcacaagcuuccagu

SEQ ID NO: 7168 - RNA, 19 nt, Artificial Sequence
  RNA Oligomer
aagcuuccagugguguuag

SEQ ID NO: 7169 - RNA, 19 nt, Artificial Sequence
  RNA Oligomer
ugugccuuaauuugaggga

SEQ ID NO: 7170 - RNA, 19 nt, Artificial Sequence
  RNA Oligomer
cuggaaauauugguugucc

SEQ ID NO: 7171 - RNA, 19 nt, Artificial Sequence
  RNA Oligomer
uugguuguccuaguaacag

SEQ ID NO: 7172 - RNA, 19 nt, Artificial Sequence
  RNA Oligomer
uaauacagcaguaucagga

SEQ ID NO: 7173 - RNA, 19 nt, Artificial Sequence
  RNA Oligomer
aagaaaaagacuucguccu

SEQ ID NO: 7174 - RNA, 19 nt, Artificial Sequence
  RNA Oligomer
uauagugucuggcaacucu

SEQ ID NO: 7175 - RNA, 19 nt, Artificial Sequence
  RNA Oligomer
ugaaucacaaaguuuggcu

SEQ ID NO: 7176 - RNA, 19 nt, Artificial Sequence
  RNA Oligomer
uuauuggucuguccacggu

SEQ ID NO: 7177 - RNA, 19 nt, Artificial Sequence
  RNA Oligomer
auaaggaugguagccagag

SEQ ID NO: 7178 - RNA, 19 nt, Artificial Sequence
  RNA Oligomer
uggaguagaagaaauaacg

SEQ ID NO: 7179 - RNA, 19 nt, Artificial Sequence
  RNA Oligomer
augguagccagagguggau

SEQ ID NO: 7180 - RNA, 19 nt, Artificial Sequence
  RNA Oligomer
cagagguggauuacuugac

SEQ ID NO: 7181 - RNA, 19 nt, Artificial Sequence
  RNA Oligomer
augaaugugcacaagcuuc

SEQ ID NO: 7182 - RNA, 19 nt, Artificial Sequence
  RNA Oligomer
aauauugguuguccuagua

SEQ ID NO: 7183 - RNA, 19 nt, Artificial Sequence
  RNA Oligomer
uuuaauacagcaguaucag

SEQ ID NO: 7184 - RNA, 19 nt, Artificial Sequence
  RNA Oligomer
uuucucaugaucuggagcu

SEQ ID NO: 7185 - RNA, 19 nt, Artificial Sequence
  RNA Oligomer
accaaaugauccauuucca

SEQ ID NO: 7186 - RNA, 19 nt, Artificial Sequence
  RNA Oligomer
uucaugcugccaaaagcug

SEQ ID NO: 7187 - RNA, 19 nt, Artificial Sequence
  RNA Oligomer
uaacuggugguuuuuccug

SEQ ID NO: 7188 - RNA, 19 nt, Artificial Sequence
  RNA Oligomer
uggaguuggaagcugaugc

SEQ ID NO: 7189 - RNA, 19 nt, Artificial Sequence
  RNA Oligomer
cauuauuggucuguccacg

SEQ ID NO: 7190 - RNA, 19 nt, Artificial Sequence
  RNA Oligomer
aauccgagcaugaggagga

SEQ ID NO: 7191 - RNA, 19 nt, Artificial Sequence
  RNA Oligomer
cuugacaguucuugagugg

SEQ ID NO: 7192 - RNA, 19 nt, Artificial Sequence
  RNA Oligomer
cuuaguccaaggaugugcc

SEQ ID NO: 7193 - RNA, 19 nt, Artificial Sequence
  RNA Oligomer
cacuuccaaagucacagag

SEQ ID NO: 7194 - RNA, 19 nt, Artificial Sequence
  RNA Oligomer
uuaauacagcaguaucagg

SEQ ID NO: 7195 - RNA, 19 nt, Artificial Sequence
  RNA Oligomer
aagacuucguccucuuggc

SEQ ID NO: 7196 - RNA, 19 nt, Artificial Sequence
  RNA Oligomer
cuugacauaaaucacaggg

SEQ ID NO: 7197 - RNA, 19 nt, Artificial Sequence
  RNA Oligomer
ucgauucuuaaaucucuug

SEQ ID NO: 7198 - RNA, 19 nt, Artificial Sequence
  RNA Oligomer
aacuggugguuuuuccugu

SEQ ID NO: 7199 - RNA, 19 nt, Artificial Sequence
  RNA Oligomer
auuagcaucugacgcugcu

SEQ ID NO: 7200 - RNA, 19 nt, Artificial Sequence
  RNA Oligomer
aauguccuguuccugacga

SEQ ID NO: 7201 - RNA, 19 nt, Artificial Sequence
  RNA Oligomer
gagggaauuuaaauucugu

SEQ ID NO: 7202 - RNA, 19 nt, Artificial Sequence
  RNA Oligomer
agggaauuuaaauucugug

SEQ ID NO: 7203 - RNA, 19 nt, Artificial Sequence
  RNA Oligomer
ucuguguaguuuggguuca

SEQ ID NO: 7204 - RNA, 19 nt, Artificial Sequence
  RNA Oligomer
ugguuguccuaguaacagc

SEQ ID NO: 7205 - RNA, 19 nt, Artificial Sequence
  RNA Oligomer
acauuggguucuccucgga

SEQ ID NO: 7206 - RNA, 19 nt, Artificial Sequence
  RNA Oligomer
cucgacuauagugucuggc

SEQ ID NO: 7207 - RNA, 19 nt, Artificial Sequence
  RNA Oligomer
uuccggaacauaguccagc

SEQ ID NO: 7208 - RNA, 19 nt, Artificial Sequence
  RNA Oligomer
uucucaugaucuggagcuc

SEQ ID NO: 7209 - RNA, 19 nt, Artificial Sequence
  RNA Oligomer
augcugccaaaagcugaag

SEQ ID NO: 7210 - RNA, 19 nt, Artificial Sequence
  RNA Oligomer
uggauuacuugacaguucu

SEQ ID NO: 7211 - RNA, 19 nt, Artificial Sequence
  RNA Oligomer
aagagugcaggugugucuc

SEQ ID NO: 7212 - RNA, 19 nt, Artificial Sequence
  RNA Oligomer
gaggugaaauguccuguuc

SEQ ID NO: 7213 - RNA, 19 nt, Artificial Sequence
  RNA Oligomer
uuguuggaguucccaggac

SEQ ID NO: 7214 - RNA, 19 nt, Artificial Sequence
  RNA Oligomer
ugcacuuccaaagucacag

SEQ ID NO: 7215 - RNA, 19 nt, Artificial Sequence
  RNA Oligomer
aaagacuucguccucuugg

SEQ ID NO: 7216 - RNA, 19 nt, Artificial Sequence
  RNA Oligomer
auagugucuggcaacucug

SEQ ID NO: 7217 - RNA, 19 nt, Artificial Sequence
  RNA Oligomer
ucucgauucuuaaaucucu

SEQ ID NO: 7218 - RNA, 19 nt, Artificial Sequence
  RNA Oligomer
uuggcuugauauaccacac

SEQ ID NO: 7219 - RNA, 19 nt, Artificial Sequence
  RNA Oligomer
uagugucuguauagcugac

SEQ ID NO: 7220 - RNA, 19 nt, Artificial Sequence
  RNA Oligomer
guggauuacuugacaguuc

SEQ ID NO: 7221 - RNA, 19 nt, Artificial Sequence
  RNA Oligomer
aaaugaaugugcacaagcu

SEQ ID NO: 7222 - RNA, 19 nt, Artificial Sequence
  RNA Oligomer
ggcaguugguguauacucc

SEQ ID NO: 7223 - RNA, 19 nt, Artificial Sequence
  RNA Oligomer
aguugguguauacuccagc

SEQ ID NO: 7224 - RNA, 19 nt, Artificial Sequence
  RNA Oligomer
uugguguauacuccagcag

SEQ ID NO: 7225 - RNA, 19 nt, Artificial Sequence
  RNA Oligomer
aaauguccuguuccugacg

SEQ ID NO: 7226 - RNA, 19 nt, Artificial Sequence
  RNA Oligomer
uuaguccaaggaugugccu

SEQ ID NO: 7227 - RNA, 19 nt, Artificial Sequence
  RNA Oligomer
gaugugccuuaauuugagg

SEQ ID NO: 7228 - RNA, 19 nt, Artificial Sequence
  RNA Oligomer
uggaaauauugguuguccu

SEQ ID NO: 7229 - RNA, 19 nt, Artificial Sequence
  RNA Oligomer
gauucuuaaaucucuuguc

SEQ ID NO: 7230 - RNA, 19 nt, Artificial Sequence
  RNA Oligomer
gacuucuuguggccugucu

SEQ ID NO: 7231 - RNA, 19 nt, Artificial Sequence
  RNA Oligomer
cuuucaugcugccaaaagc

SEQ ID NO: 7232 - RNA, 19 nt, Artificial Sequence
  RNA Oligomer
uuucaugcugccaaaagcu

SEQ ID NO: 7233 - RNA, 19 nt, Artificial Sequence
  RNA Oligomer
uauuagcaucugacgcugc

SEQ ID NO: 7234 - RNA, 19 nt, Artificial Sequence
  RNA Oligomer
aagcagcugcuugaauccg

SEQ ID NO: 7235 - RNA, 19 nt, Artificial Sequence
  RNA Oligomer
uugaauccgagcaugagga

SEQ ID NO: 7236 - RNA, 19 nt, Artificial Sequence
  RNA Oligomer
caguugguguauacuccag

SEQ ID NO: 7237 - RNA, 19 nt, Artificial Sequence
  RNA Oligomer
aggugaaauguccuguucc

SEQ ID NO: 7238 - RNA, 19 nt, Artificial Sequence
  RNA Oligomer
auuugcucccuuguuggag

SEQ ID NO: 7239 - RNA, 19 nt, Artificial Sequence
  RNA Oligomer
acuugacauaaaucacagg

SEQ ID NO: 7240 - RNA, 19 nt, Artificial Sequence
  RNA Oligomer
aaucacagggagcgucugu

SEQ ID NO: 7241 - RNA, 19 nt, Artificial Sequence
  RNA Oligomer
gcucgacuauagugucugg

SEQ ID NO: 7242 - RNA, 19 nt, Artificial Sequence
  RNA Oligomer
uuuccggaacauaguccag

SEQ ID NO: 7243 - RNA, 19 nt, Artificial Sequence
  RNA Oligomer
auuaagauagaccucaucu

SEQ ID NO: 7244 - RNA, 19 nt, Artificial Sequence
  RNA Oligomer
auguuacagugaucuagcu

SEQ ID NO: 7245 - RNA, 19 nt, Artificial Sequence
  RNA Oligomer
cuuucuugauggcgaccag

SEQ ID NO: 7246 - RNA, 19 nt, Artificial Sequence
  RNA Oligomer
uuuccaaucacuuuagugu

SEQ ID NO: 7247 - RNA, 19 nt, Artificial Sequence
  RNA Oligomer
aaucacuuuagugucugua

SEQ ID NO: 7248 - RNA, 19 nt, Artificial Sequence
  RNA Oligomer
cuguucagguggaguugga

SEQ ID NO: 7249 - RNA, 19 nt, Artificial Sequence
  RNA Oligomer
aagcugaugcagaagcagc

SEQ ID NO: 7250 - RNA, 19 nt, Artificial Sequence
  RNA Oligomer
ugcagaagcagcauuauug

SEQ ID NO: 7251 - RNA, 19 nt, Artificial Sequence
  RNA Oligomer
ugagggaauuuaaauucug

SEQ ID NO: 7252 - RNA, 19 nt, Artificial Sequence
  RNA Oligomer
uuugcucccuuguuggagu

SEQ ID NO: 7253 - RNA, 19 nt, Artificial Sequence
  RNA Oligomer
gaaaaagacuucguccucu

SEQ ID NO: 7254 - RNA, 19 nt, Artificial Sequence
  RNA Oligomer
uguuuccggaacauagucc

SEQ ID NO: 7255 - RNA, 19 nt, Artificial Sequence
  RNA Oligomer
cagugaucuagcuuucuca

SEQ ID NO: 7256 - RNA, 19 nt, Artificial Sequence
  RNA Oligomer
aucuggagcucucgauucu

SEQ ID NO: 7257 - RNA, 19 nt, Artificial Sequence
  RNA Oligomer
uggcuugauauaccacacc

SEQ ID NO: 7258 - RNA, 19 nt, Artificial Sequence
  RNA Oligomer
uuccaaucacuuuaguguc

SEQ ID NO: 7259 - RNA, 19 nt, Artificial Sequence
  RNA Oligomer
uccaaucacuuuagugucu

SEQ ID NO: 7260 - RNA, 19 nt, Artificial Sequence
  RNA Oligomer
acacucaaguaacuggugg

SEQ ID NO: 7261 - RNA, 19 nt, Artificial Sequence
  RNA Oligomer
agcagcauuauuggucugu

SEQ ID NO: 7262 - RNA, 19 nt, Artificial Sequence
  RNA Oligomer
uccaguauuagcaucugac

SEQ ID NO: 7263 - RNA, 19 nt, Artificial Sequence
  RNA Oligomer
uagcaucugacgcugcugu

SEQ ID NO: 7264 - RNA, 19 nt, Artificial Sequence
  RNA Oligomer
gaagcagcugcuugaaucc

SEQ ID NO: 7265 - RNA, 19 nt, Artificial Sequence
  RNA Oligomer
gagguggauuacuugacag

SEQ ID NO: 7266 - RNA, 19 nt, Artificial Sequence
  RNA Oligomer
acuugacaguucuugagug

SEQ ID NO: 7267 - RNA, 19 nt, Artificial Sequence
  RNA Oligomer
ugggucccguaauucauca

SEQ ID NO: 7268 - RNA, 19 nt, Artificial Sequence
  RNA Oligomer
guugguguauacuccagca

SEQ ID NO: 7269 - RNA, 19 nt, Artificial Sequence
  RNA Oligomer
ccugacgaauccuuagucc

SEQ ID NO: 7270 - RNA, 19 nt, Artificial Sequence
  RNA Oligomer
ccuuaguccaaggaugugc

SEQ ID NO: 7271 - RNA, 19 nt, Artificial Sequence
  RNA Oligomer
uggcaacucuguauacugu

SEQ ID NO: 7272 - RNA, 19 nt, Artificial Sequence
  RNA Oligomer
uuucuucucaccacuggag

SEQ ID NO: 7273 - RNA, 19 nt, Artificial Sequence
  RNA Oligomer
cgauucuuaaaucucuugu

SEQ ID NO: 7274 - RNA, 19 nt, Artificial Sequence
  RNA Oligomer
gaccaguucuccugaauca

SEQ ID NO: 7275 - RNA, 19 nt, Artificial Sequence
  RNA Oligomer
cugaaucacaaaguuuggc

SEQ ID NO: 7276 - RNA, 19 nt, Artificial Sequence
  RNA Oligomer
acuggugguuuuuccugug

SEQ ID NO: 7277 - RNA, 19 nt, Artificial Sequence
  RNA Oligomer
gcagaagcagcauuauugg

SEQ ID NO: 7278 - RNA, 19 nt, Artificial Sequence
  RNA Oligomer
aguauuagcaucugacgcu

SEQ ID NO: 7279 - RNA, 19 nt, Artificial Sequence
  RNA Oligomer
guauuagcaucugacgcug

SEQ ID NO: 7280 - RNA, 19 nt, Artificial Sequence
  RNA Oligomer
agcagcugcuugaauccga

SEQ ID NO: 7281 - RNA, 19 nt, Artificial Sequence
  RNA Oligomer
agcugcuugaauccgagca

SEQ ID NO: 7282 - RNA, 19 nt, Artificial Sequence
  RNA Oligomer
uauacuccagcagacggcu

SEQ ID NO: 7283 - RNA, 19 nt, Artificial Sequence
  RNA Oligomer
uccugacgaauccuuaguc

SEQ ID NO: 7284 - RNA, 19 nt, Artificial Sequence
  RNA Oligomer
gggaauuuaaauucugugu

SEQ ID NO: 7285 - RNA, 19 nt, Artificial Sequence
  RNA Oligomer
uuggguucauuucucugau

SEQ ID NO: 7286 - RNA, 19 nt, Artificial Sequence
  RNA Oligomer
aaaagacuucguccucuug

SEQ ID NO: 7287 - RNA, 19 nt, Artificial Sequence
  RNA Oligomer
uggcucgacuauagugucu

SEQ ID NO: 7288 - RNA, 19 nt, Artificial Sequence
  RNA Oligomer
uuaagauagaccucaucuu

SEQ ID NO: 7289 - RNA, 19 nt, Artificial Sequence
  RNA Oligomer
cuucucaccacuggaguag

SEQ ID NO: 7290 - RNA, 19 nt, Artificial Sequence
  RNA Oligomer
auuggucuguccacggucu

SEQ ID NO: 7291 - RNA, 19 nt, Artificial Sequence
  RNA Oligomer
accagcugcuuugcacuuc

SEQ ID NO: 7292 - RNA, 19 nt, Artificial Sequence
  RNA Oligomer
aagauagaccucaucuuuc

SEQ ID NO: 7293 - RNA, 19 nt, Artificial Sequence
  RNA Oligomer
agauagaccucaucuuucu

SEQ ID NO: 7294 - RNA, 19 nt, Artificial Sequence
  RNA Oligomer
ugcugccaaaagcugaagg

SEQ ID NO: 7295 - RNA, 19 nt, Artificial Sequence
  RNA Oligomer
guguugcugagugacacuc

SEQ ID NO: 7296 - RNA, 19 nt, Artificial Sequence
  RNA Oligomer
caguauuagcaucugacgc

SEQ ID NO: 7297 - RNA, 19 nt, Artificial Sequence
  RNA Oligomer
auacagcaguaucaggauc

SEQ ID NO: 7298 - RNA, 19 nt, Artificial Sequence
  RNA Oligomer
uaaacuucggaacagcuga

SEQ ID NO: 7299 - RNA, 19 nt, Artificial Sequence
  RNA Oligomer
uuggcucgacuauaguguc

SEQ ID NO: 7300 - RNA, 19 nt, Artificial Sequence
  RNA Oligomer
guuuccggaacauagucca

SEQ ID NO: 7301 - RNA, 19 nt, Artificial Sequence
  RNA Oligomer
augaucuggagcucucgau

SEQ ID NO: 7302 - RNA, 19 nt, Artificial Sequence
  RNA Oligomer
aucacaaaguuuggcuuga

SEQ ID NO: 7303 - RNA, 19 nt, Artificial Sequence
  RNA Oligomer
auuuccaaucacuuuagug

SEQ ID NO: 7304 - RNA, 19 nt, Artificial Sequence
  RNA Oligomer
agcugaugcagaagcagca

SEQ ID NO: 7305 - RNA, 19 nt, Artificial Sequence
  RNA Oligomer
cuccaguauuagcaucuga

SEQ ID NO: 7306 - RNA, 19 nt, Artificial Sequence
  RNA Oligomer
gcuacacagugcaauugcc

SEQ ID NO: 7307 - RNA, 19 nt, Artificial Sequence
  RNA Oligomer
uacacagugcaauugccuc

SEQ ID NO: 7308 - RNA, 19 nt, Artificial Sequence
  RNA Oligomer
acgaauccuuaguccaagg

SEQ ID NO: 7309 - RNA, 19 nt, Artificial Sequence
  RNA Oligomer
aauccuuaguccaaggaug

SEQ ID NO: 7310 - RNA, 19 nt, Artificial Sequence
  RNA Oligomer
auccuuaguccaaggaugu

SEQ ID NO: 7311 - RNA, 19 nt, Artificial Sequence
  RNA Oligomer
gaaaaagaaaaagacuucg

SEQ ID NO: 7312 - RNA, 19 nt, Artificial Sequence
  RNA Oligomer
ucuguauacuguuuccgga

SEQ ID NO: 7313 - RNA, 19 nt, Artificial Sequence
  RNA Oligomer
caaucacuuuagugucugu

SEQ ID NO: 7314 - RNA, 19 nt, Artificial Sequence
  RNA Oligomer
cacucaaguaacugguggu

SEQ ID NO: 7315 - RNA, 19 nt, Artificial Sequence
  RNA Oligomer
aaacuucggaacagcugau

SEQ ID NO: 7316 - RNA, 19 nt, Artificial Sequence
  RNA Oligomer
ccugaaucacaaaguuugg

SEQ ID NO: 7317 - RNA, 19 nt, Artificial Sequence
  RNA Oligomer
uucagguggaguuggaagc

SEQ ID NO: 7318 - RNA, 19 nt, Artificial Sequence
  RNA Oligomer
agguggaguuggaagcuga

SEQ ID NO: 7319 - RNA, 19 nt, Artificial Sequence
  RNA Oligomer
aaggaugugccuuaauuug

SEQ ID NO: 7320 - RNA, 19 nt, Artificial Sequence
  RNA Oligomer
aggaugugccuuaauuuga

SEQ ID NO: 7321 - RNA, 19 nt, Artificial Sequence
  RNA Oligomer
aaucacaaaguuuggcuug

SEQ ID NO: 7322 - RNA, 19 nt, Artificial Sequence
  RNA Oligomer
uucuuguggccugucugga

SEQ ID NO: 7323 - RNA, 19 nt, Artificial Sequence
  RNA Oligomer
uuuuccugugcagcuggcu

SEQ ID NO: 7324 - RNA, 19 nt, Artificial Sequence
  RNA Oligomer
aguuuggguucauuucucu

SEQ ID NO: 7325 - RNA, 19 nt, Artificial Sequence
  RNA Oligomer
uacuguuuccggaacauag

SEQ ID NO: 7326 - RNA, 19 nt, Artificial Sequence
  RNA Oligomer
cuuugcacuuccaaaguca

SEQ ID NO: 7327 - RNA, 19 nt, Artificial Sequence
  RNA Oligomer
gaucaucuuuuccuacguu

SEQ ID NO: 7328 - RNA, 19 nt, Artificial Sequence
  RNA Oligomer
ugaucaucuuuuccuacgu

SEQ ID NO: 7329 - RNA, 19 nt, Artificial Sequence
  RNA Oligomer
ccagguuuaaacaucacuu

SEQ ID NO: 7330 - RNA, 19 nt, Artificial Sequence
  RNA Oligomer
acgugaucaucuuuuccua

SEQ ID NO: 7331 - RNA, 19 nt, Artificial Sequence
  RNA Oligomer
ugauaaaagucuucgggau

SEQ ID NO: 7332 - RNA, 19 nt, Artificial Sequence
  RNA Oligomer
cgauaauuuuucagaugug

SEQ ID NO: 7333 - RNA, 19 nt, Artificial Sequence
  RNA Oligomer
ggcgauaauuuuucagaug

SEQ ID NO: 7334 - RNA, 19 nt, Artificial Sequence
  RNA Oligomer
ccgaaaacuucacugugcu

SEQ ID NO: 7335 - RNA, 19 nt, Artificial Sequence
  RNA Oligomer
gcagacuacaccuucccuu

SEQ ID NO: 7336 - RNA, 19 nt, Artificial Sequence
  RNA Oligomer
aucaucuuuuccuacguuu

SEQ ID NO: 7337 - RNA, 19 nt, Artificial Sequence
  RNA Oligomer
gguucuuccacgugaucau

SEQ ID NO: 7338 - RNA, 19 nt, Artificial Sequence
  RNA Oligomer
gcgauaauuuuucagaugu

SEQ ID NO: 7339 - RNA, 19 nt, Artificial Sequence
  RNA Oligomer
aggcgauaauuuuucagau

SEQ ID NO: 7340 - RNA, 19 nt, Artificial Sequence
  RNA Oligomer
ucaagaacaauaucgacuu

SEQ ID NO: 7341 - RNA, 19 nt, Artificial Sequence
  RNA Oligomer
cgcucccauauuuaucccu

SEQ ID NO: 7342 - RNA, 19 nt, Artificial Sequence
  RNA Oligomer
cggaggaaaauuugacauu

SEQ ID NO: 7343 - RNA, 19 nt, Artificial Sequence
  RNA Oligomer
ccaguaugagacgaacaaa

SEQ ID NO: 7344 - RNA, 19 nt, Artificial Sequence
  RNA Oligomer
ucaucaagaacaauaucga

SEQ ID NO: 7345 - RNA, 19 nt, Artificial Sequence
  RNA Oligomer
gcagagcaaaggaauucag

SEQ ID NO: 7346 - RNA, 19 nt, Artificial Sequence
  RNA Oligomer
ccggaggaaaauuugacau

SEQ ID NO: 7347 - RNA, 19 nt, Artificial Sequence
  RNA Oligomer
gccgaaaacuucacugugc

SEQ ID NO: 7348 - RNA, 19 nt, Artificial Sequence
  RNA Oligomer
ucuuuuccuacguuugcuu

SEQ ID NO: 7349 - RNA, 19 nt, Artificial Sequence
  RNA Oligomer
cacgugaucaucuuuuccu

SEQ ID NO: 7350 - RNA, 19 nt, Artificial Sequence
  RNA Oligomer
ucuuccacgugaucaucuu

SEQ ID NO: 7351 - RNA, 19 nt, Artificial Sequence
  RNA Oligomer
agauacagcugcuuagaaa

SEQ ID NO: 7352 - RNA, 19 nt, Artificial Sequence
  RNA Oligomer
ccaaagccgacauuaaagu

SEQ ID NO: 7353 - RNA, 19 nt, Artificial Sequence
  RNA Oligomer
gccagguuuaaacaucacu

SEQ ID NO: 7354 - RNA, 19 nt, Artificial Sequence
  RNA Oligomer
uccaguaugagacgaacaa

SEQ ID NO: 7355 - RNA, 19 nt, Artificial Sequence
  RNA Oligomer
cgagguuguaaaaagggau

SEQ ID NO: 7356 - RNA, 19 nt, Artificial Sequence
  RNA Oligomer
ugacaaacuuucucaaaac

SEQ ID NO: 7357 - RNA, 19 nt, Artificial Sequence
  RNA Oligomer
uccacgugaucaucuuuuc

SEQ ID NO: 7358 - RNA, 19 nt, Artificial Sequence
  RNA Oligomer
uuccacgugaucaucuuuu

SEQ ID NO: 7359 - RNA, 19 nt, Artificial Sequence
  RNA Oligomer
ggaagaagugcgaguccau

SEQ ID NO: 7360 - RNA, 19 nt, Artificial Sequence
  RNA Oligomer
guguggucaacgaauacua

SEQ ID NO: 7361 - RNA, 19 nt, Artificial Sequence
  RNA Oligomer
gcucccauauuuaucccug

SEQ ID NO: 7362 - RNA, 19 nt, Artificial Sequence
  RNA Oligomer
agcaugaauuauggcacca

SEQ ID NO: 7363 - RNA, 19 nt, Artificial Sequence
  RNA Oligomer
caggcgauaauuuuucaga

SEQ ID NO: 7364 - RNA, 19 nt, Artificial Sequence
  RNA Oligomer
agaaacaggcgauaauuuu

SEQ ID NO: 7365 - RNA, 19 nt, Artificial Sequence
  RNA Oligomer
ccuuccacaagacucagaa

SEQ ID NO: 7366 - RNA, 19 nt, Artificial Sequence
  RNA Oligomer
cacaacuacaccacgagaa

SEQ ID NO: 7367 - RNA, 19 nt, Artificial Sequence
  RNA Oligomer
cgcagagcaaaggaauuca

SEQ ID NO: 7368 - RNA, 19 nt, Artificial Sequence
  RNA Oligomer
acaccgcagacuacaccuu

SEQ ID NO: 7369 - RNA, 19 nt, Artificial Sequence
  RNA Oligomer
ggagaauggagugaagaag

SEQ ID NO: 7370 - RNA, 19 nt, Artificial Sequence
  RNA Oligomer
uggcaccggaggaaaauuu

SEQ ID NO: 7371 - RNA, 19 nt, Artificial Sequence
  RNA Oligomer
acaggcgauaauuuuucag

SEQ ID NO: 7372 - RNA, 19 nt, Artificial Sequence
  RNA Oligomer
gaaacaggcgauaauuuuu

SEQ ID NO: 7373 - RNA, 19 nt, Artificial Sequence
  RNA Oligomer
cagguuuaaacaucacuug

SEQ ID NO: 7374 - RNA, 19 nt, Artificial Sequence
  RNA Oligomer
acaacuacaccacgagaaa

SEQ ID NO: 7375 - RNA, 19 nt, Artificial Sequence
  RNA Oligomer
agaacaauaucgacuuccc

SEQ ID NO: 7376 - RNA, 19 nt, Artificial Sequence
  RNA Oligomer
ccgcagagcaaaggaauuc

SEQ ID NO: 7377 - RNA, 19 nt, Artificial Sequence
  RNA Oligomer
gacaaacuuucucaaaaca

SEQ ID NO: 7378 - RNA, 19 nt, Artificial Sequence
  RNA Oligomer
ggcaguacaguggcuucaa

SEQ ID NO: 7379 - RNA, 19 nt, Artificial Sequence
  RNA Oligomer
ggagauacagcugcuuaga

SEQ ID NO: 7380 - RNA, 19 nt, Artificial Sequence
  RNA Oligomer
cauuaaaguauguguccuu

SEQ ID NO: 7381 - RNA, 19 nt, Artificial Sequence
  RNA Oligomer
cugucgcucccauauuuau

SEQ ID NO: 7382 - RNA, 19 nt, Artificial Sequence
  RNA Oligomer
agagcaugaauuauggcac

SEQ ID NO: 7383 - RNA, 19 nt, Artificial Sequence
  RNA Oligomer
ggaaaacaauguugagaaa

SEQ ID NO: 7384 - RNA, 19 nt, Artificial Sequence
  RNA Oligomer
caguaugagacgaacaaag

SEQ ID NO: 7385 - RNA, 19 nt, Artificial Sequence
  RNA Oligomer
acuucacugugcucaucaa

SEQ ID NO: 7386 - RNA, 19 nt, Artificial Sequence
  RNA Oligomer
ccgagguuguaaaaaggga

SEQ ID NO: 7387 - RNA, 19 nt, Artificial Sequence
  RNA Oligomer
ugaccgagguuguaaaaag

SEQ ID NO: 7388 - RNA, 19 nt, Artificial Sequence
  RNA Oligomer
gggaacucuuucuucguga

SEQ ID NO: 7389 - RNA, 19 nt, Artificial Sequence
  RNA Oligomer
cagacuacaccuucccuuu

SEQ ID NO: 7390 - RNA, 19 nt, Artificial Sequence
  RNA Oligomer
ucguggagaauggagugaa

SEQ ID NO: 7391 - RNA, 19 nt, Artificial Sequence
  RNA Oligomer
gagauacagcugcuuagaa

SEQ ID NO: 7392 - RNA, 19 nt, Artificial Sequence
  RNA Oligomer
agaggagauacagcugcuu

SEQ ID NO: 7393 - RNA, 19 nt, Artificial Sequence
  RNA Oligomer
ucacagauuuguccaggcu

SEQ ID NO: 7394 - RNA, 19 nt, Artificial Sequence
  RNA Oligomer
aaagccgacauuaaaguau

SEQ ID NO: 7395 - RNA, 19 nt, Artificial Sequence
  RNA Oligomer
gccaaagccgacauuaaag

SEQ ID NO: 7396 - RNA, 19 nt, Artificial Sequence
  RNA Oligomer
ccagcugguuguguacauc

SEQ ID NO: 7397 - RNA, 19 nt, Artificial Sequence
  RNA Oligomer
accuuccacaagacucaga

SEQ ID NO: 7398 - RNA, 19 nt, Artificial Sequence
  RNA Oligomer
guaccuuccacaagacuca

SEQ ID NO: 7399 - RNA, 19 nt, Artificial Sequence
  RNA Oligomer
ugaacagugccgaaaacuu

SEQ ID NO: 7400 - RNA, 19 nt, Artificial Sequence
  RNA Oligomer
cucuugaacagugccgaaa

SEQ ID NO: 7401 - RNA, 19 nt, Artificial Sequence
  RNA Oligomer
ucucaaaacagaaggccaa

SEQ ID NO: 7402 - RNA, 19 nt, Artificial Sequence
  RNA Oligomer
cguggagaauggagugaag

SEQ ID NO: 7403 - RNA, 19 nt, Artificial Sequence
  RNA Oligomer
ggagaucguggagaaugga

SEQ ID NO: 7404 - RNA, 19 nt, Artificial Sequence
  RNA Oligomer
cagaggugaaagaggagau

SEQ ID NO: 7405 - RNA, 19 nt, Artificial Sequence
  RNA Oligomer
gggauagcagaggugaaag

SEQ ID NO: 7406 - RNA, 19 nt, Artificial Sequence
  RNA Oligomer
uccuacguuugcuuugcuc

SEQ ID NO: 7407 - RNA, 19 nt, Artificial Sequence
  RNA Oligomer
ugcuuagaaaggaggcgac

SEQ ID NO: 7408 - RNA, 19 nt, Artificial Sequence
  RNA Oligomer
aggagauacagcugcuuag

SEQ ID NO: 7409 - RNA, 19 nt, Artificial Sequence
  RNA Oligomer
gcaccauuaagugguucuu

SEQ ID NO: 7410 - RNA, 19 nt, Artificial Sequence
  RNA Oligomer
agaagugcgaguccauugu

SEQ ID NO: 7411 - RNA, 19 nt, Artificial Sequence
  RNA Oligomer
gcaccggaggaaaauuuga

SEQ ID NO: 7412 - RNA, 19 nt, Artificial Sequence
  RNA Oligomer
ucaaaacagaaggccaaga

SEQ ID NO: 7413 - RNA, 19 nt, Artificial Sequence
  RNA Oligomer
gagugaagaaguuggugca

SEQ ID NO: 7414 - RNA, 19 nt, Artificial Sequence
  RNA Oligomer
ggagugaagaaguuggugc

SEQ ID NO: 7415 - RNA, 19 nt, Artificial Sequence
  RNA Oligomer
gcagaggugaaagaggaga

SEQ ID NO: 7416 - RNA, 19 nt, Artificial Sequence
  RNA Oligomer
acguuugcuuugcucuggu

SEQ ID NO: 7417 - RNA, 19 nt, Artificial Sequence
  RNA Oligomer
acagcugcuuagaaaggag

SEQ ID NO: 7418 - RNA, 19 nt, Artificial Sequence
  RNA Oligomer
gaggagauacagcugcuua

SEQ ID NO: 7419 - RNA, 19 nt, Artificial Sequence
  RNA Oligomer
uguucaucgacuuccucau

SEQ ID NO: 7420 - RNA, 19 nt, Artificial Sequence
  RNA Oligomer
accggaggaaaauuugaca

SEQ ID NO: 7421 - RNA, 19 nt, Artificial Sequence
  RNA Oligomer
ggcaccggaggaaaauuug

SEQ ID NO: 7422 - RNA, 19 nt, Artificial Sequence
  RNA Oligomer
cguuuugacauccugguuu

SEQ ID NO: 7423 - RNA, 19 nt, Artificial Sequence
  RNA Oligomer
acaauguugagaaacggac

SEQ ID NO: 7424 - RNA, 19 nt, Artificial Sequence
  RNA Oligomer
cugaccgagguuguaaaaa

SEQ ID NO: 7425 - RNA, 19 nt, Artificial Sequence
  RNA Oligomer
acaaacuuucucaaaacag

SEQ ID NO: 7426 - RNA, 19 nt, Artificial Sequence
  RNA Oligomer
uggagaauggagugaagaa

SEQ ID NO: 7427 - RNA, 19 nt, Artificial Sequence
  RNA Oligomer
ugagugacaagcuguacca

SEQ ID NO: 7428 - RNA, 19 nt, Artificial Sequence
  RNA Oligomer
uggugagugacaagcugua

SEQ ID NO: 7429 - RNA, 19 nt, Artificial Sequence
  RNA Oligomer
cguuugcuuugcucuggug

SEQ ID NO: 7430 - RNA, 19 nt, Artificial Sequence
  RNA Oligomer
agaugucaagggccaagaa

SEQ ID NO: 7431 - RNA, 19 nt, Artificial Sequence
  RNA Oligomer
acaggaagaagugcgaguc

SEQ ID NO: 7432 - RNA, 19 nt, Artificial Sequence
  RNA Oligomer
cuguguucaucgacuuccu

SEQ ID NO: 7433 - RNA, 19 nt, Artificial Sequence
  RNA Oligomer
cgcuguguucaucgacuuc

SEQ ID NO: 7434 - RNA, 19 nt, Artificial Sequence
  RNA Oligomer
guuguguacaucggcucaa

SEQ ID NO: 7435 - RNA, 19 nt, Artificial Sequence
  RNA Oligomer
ccguuuugacauccugguu

SEQ ID NO: 7436 - RNA, 19 nt, Artificial Sequence
  RNA Oligomer
cuugaacagugccgaaaac

SEQ ID NO: 7437 - RNA, 19 nt, Artificial Sequence
  RNA Oligomer
guuguaaaaagggauggau

SEQ ID NO: 7438 - RNA, 19 nt, Artificial Sequence
  RNA Oligomer
gguuguaaaaagggaugga

SEQ ID NO: 7439 - RNA, 19 nt, Artificial Sequence
  RNA Oligomer
cgugaugacaaacuuucuc

SEQ ID NO: 7440 - RNA, 19 nt, Artificial Sequence
  RNA Oligomer
cagaggagauacagcugcu

SEQ ID NO: 7441 - RNA, 19 nt, Artificial Sequence
  RNA Oligomer
cuacaaggaaaacaauguu

SEQ ID NO: 7442 - RNA, 19 nt, Artificial Sequence
  RNA Oligomer
caaagucacucggauccag

SEQ ID NO: 7443 - RNA, 19 nt, Artificial Sequence
  RNA Oligomer
gagguuguaaaaagggaug

SEQ ID NO: 7444 - RNA, 19 nt, Artificial Sequence
  RNA Oligomer
cugguuguguacaucggcu

SEQ ID NO: 7445 - RNA, 19 nt, Artificial Sequence
  RNA Oligomer
guuuugacauccugguuuu

SEQ ID NO: 7446 - RNA, 19 nt, Artificial Sequence
  RNA Oligomer
aggaaaacaauguugagaa

SEQ ID NO: 7447 - RNA, 19 nt, Artificial Sequence
  RNA Oligomer
cagugauguuuuccaguau

SEQ ID NO: 7448 - RNA, 19 nt, Artificial Sequence
  RNA Oligomer
acucuuucuucgugaugac

SEQ ID NO: 7449 - RNA, 19 nt, Artificial Sequence
  RNA Oligomer
gaacucuuucuucgugaug

SEQ ID NO: 7450 - RNA, 19 nt, Artificial Sequence
  RNA Oligomer
uaacugcugucgcucccau

SEQ ID NO: 7451 - RNA, 19 nt, Artificial Sequence
  RNA Oligomer
gcaugaauuauggcaccau

SEQ ID NO: 7452 - RNA, 19 nt, Artificial Sequence
  RNA Oligomer
acaaggaaaacaauguuga

SEQ ID NO: 7453 - RNA, 19 nt, Artificial Sequence
  RNA Oligomer
guacuacaaggaaaacaau

SEQ ID NO: 7454 - RNA, 19 nt, Artificial Sequence
  RNA Oligomer
ggcaccauuaagugguucu

SEQ ID NO: 7455 - RNA, 19 nt, Artificial Sequence
  RNA Oligomer
ggacucugauaaaagucuu

SEQ ID NO: 7456 - RNA, 19 nt, Artificial Sequence
  RNA Oligomer
aguacuacaaggaaaacaa

SEQ ID NO: 7457 - RNA, 19 nt, Artificial Sequence
  RNA Oligomer
gugauguuuuccaguauga

SEQ ID NO: 7458 - RNA, 19 nt, Artificial Sequence
  RNA Oligomer
uccguuuugacauccuggu

SEQ ID NO: 7459 - RNA, 19 nt, Artificial Sequence
  RNA Oligomer
gucuucgggauccguuuug

SEQ ID NO: 7460 - RNA, 19 nt, Artificial Sequence
  RNA Oligomer
ugaugacaaacuuucucaa

SEQ ID NO: 7461 - RNA, 19 nt, Artificial Sequence
  RNA Oligomer
gcagcugcagugauguuuu

SEQ ID NO: 7462 - RNA, 19 nt, Artificial Sequence
  RNA Oligomer
agaggagaucguggagaau

SEQ ID NO: 7463 - RNA, 19 nt, Artificial Sequence
  RNA Oligomer
cccauauuuaucccuggug

SEQ ID NO: 7464 - RNA, 19 nt, Artificial Sequence
  RNA Oligomer
ugcucaucaagaacaauau

SEQ ID NO: 7465 - RNA, 19 nt, Artificial Sequence
  RNA Oligomer
caaaacagaaggccaagag

SEQ ID NO: 7466 - RNA, 19 nt, Artificial Sequence
  RNA Oligomer
ugaagaaguuggugcacag

SEQ ID NO: 7467 - RNA, 19 nt, Artificial Sequence
  RNA Oligomer
ggagccaaagccgacauua

SEQ ID NO: 7468 - RNA, 19 nt, Artificial Sequence
  RNA Oligomer
caugaauuauggcaccauu

SEQ ID NO: 7469 - RNA, 19 nt, Artificial Sequence
  RNA Oligomer
ccaaguacuacaaggaaaa

SEQ ID NO: 7470 - RNA, 19 nt, Artificial Sequence
  RNA Oligomer
cgccaaguacuacaaggaa

SEQ ID NO: 7471 - RNA, 19 nt, Artificial Sequence
  RNA Oligomer
cggauccagagcaugaauu

SEQ ID NO: 7472 - RNA, 19 nt, Artificial Sequence
  RNA Oligomer
agugauguuuuccaguaug

SEQ ID NO: 7473 - RNA, 19 nt, Artificial Sequence
  RNA Oligomer
gugaagaaguuggugcaca

SEQ ID NO: 7474 - RNA, 19 nt, Artificial Sequence
  RNA Oligomer
aggugaaagaggagaucgu

SEQ ID NO: 7475 - RNA, 19 nt, Artificial Sequence
  RNA Oligomer
agaggugaaagaggagauc

SEQ ID NO: 7476 - RNA, 19 nt, Artificial Sequence
  RNA Oligomer
uguguccuuuguggaugaa

SEQ ID NO: 7477 - RNA, 19 nt, Artificial Sequence
  RNA Oligomer
uggagccaaagccgacauu

SEQ ID NO: 7478 - RNA, 19 nt, Artificial Sequence
  RNA Oligomer
uggcaccauuaagugguuc

SEQ ID NO: 7479 - RNA, 19 nt, Artificial Sequence
  RNA Oligomer
cggacucugauaaaagucu

SEQ ID NO: 7480 - RNA, 19 nt, Artificial Sequence
  RNA Oligomer
ugaaagaggagaucgugga

SEQ ID NO: 7481 - RNA, 19 nt, Artificial Sequence
  RNA Oligomer
ccaggacauggcugacuuu

SEQ ID NO: 7482 - RNA, 19 nt, Artificial Sequence
  RNA Oligomer
guguccuuuguggaugaau

SEQ ID NO: 7483 - RNA, 19 nt, Artificial Sequence
  RNA Oligomer
ccauuaagugguucuucca

SEQ ID NO: 7484 - RNA, 19 nt, Artificial Sequence
  RNA Oligomer
ccauauuuaucccuggugc

SEQ ID NO: 7485 - RNA, 19 nt, Artificial Sequence
  RNA Oligomer
cugcugucgcucccauauu

SEQ ID NO: 7486 - RNA, 19 nt, Artificial Sequence
  RNA Oligomer
agauacgccaaguacuaca

SEQ ID NO: 7487 - RNA, 19 nt, Artificial Sequence
  RNA Oligomer
cgaacaaagucacucggau

SEQ ID NO: 7488 - RNA, 19 nt, Artificial Sequence
  RNA Oligomer
gcaaaggaauucagaccgg

SEQ ID NO: 7489 - RNA, 19 nt, Artificial Sequence
  RNA Oligomer
gugaugacaaacuuucuca

SEQ ID NO: 7490 - RNA, 19 nt, Artificial Sequence
  RNA Oligomer
cagcugcagugauguuuuc

SEQ ID NO: 7491 - RNA, 19 nt, Artificial Sequence
  RNA Oligomer
gucaucaguucugugcaca

SEQ ID NO: 7492 - RNA, 19 nt, Artificial Sequence
  RNA Oligomer
acaagcuguaccagcggaa

SEQ ID NO: 7493 - RNA, 19 nt, Artificial Sequence
  RNA Oligomer
ucccauauuuaucccuggu

SEQ ID NO: 7494 - RNA, 19 nt, Artificial Sequence
  RNA Oligomer
gacacuuacuccaguaacu

SEQ ID NO: 7495 - RNA, 19 nt, Artificial Sequence
  RNA Oligomer
ugaauuauggcaccauuaa

SEQ ID NO: 7496 - RNA, 19 nt, Artificial Sequence
  RNA Oligomer
ccgcuguguucaucgacuu

SEQ ID NO: 7497 - RNA, 19 nt, Artificial Sequence
  RNA Oligomer
ucacucggauccagagcau

SEQ ID NO: 7498 - RNA, 19 nt, Artificial Sequence
  RNA Oligomer
ccugccagguuuaaacauc

SEQ ID NO: 7499 - RNA, 19 nt, Artificial Sequence
  RNA Oligomer
gaaacauccugccagguuu

SEQ ID NO: 7500 - RNA, 19 nt, Artificial Sequence
  RNA Oligomer
cugugcucaucaagaacaa

SEQ ID NO: 7501 - RNA, 19 nt, Artificial Sequence
  RNA Oligomer
cugcagugauguuuuccag

SEQ ID NO: 7502 - RNA, 19 nt, Artificial Sequence
  RNA Oligomer
gcugcagugauguuuucca

SEQ ID NO: 7503 - RNA, 19 nt, Artificial Sequence
  RNA Oligomer
ucaguucugugcacaccaa

SEQ ID NO: 7504 - RNA, 19 nt, Artificial Sequence
  RNA Oligomer
cgacauuaaaguauguguc

SEQ ID NO: 7505 - RNA, 19 nt, Artificial Sequence
  RNA Oligomer
cccuguguggucaacgaau

SEQ ID NO: 7506 - RNA, 19 nt, Artificial Sequence
  RNA Oligomer
gugucccauuuuccgacua

SEQ ID NO: 7507 - RNA, 19 nt, Artificial Sequence
  RNA Oligomer
gcucaucaagaacaauauc

SEQ ID NO: 7508 - RNA, 19 nt, Artificial Sequence
  RNA Oligomer
cgaaaacuucacugugcuc

SEQ ID NO: 7509 - RNA, 19 nt, Artificial Sequence
  RNA Oligomer
gaaccagaagaccugugaa

SEQ ID NO: 7510 - RNA, 19 nt, Artificial Sequence
  RNA Oligomer
caaaggaauucagaccgga

SEQ ID NO: 7511 - RNA, 19 nt, Artificial Sequence
  RNA Oligomer
ccgacauuaaaguaugugu

SEQ ID NO: 7512 - RNA, 19 nt, Artificial Sequence
  RNA Oligomer
auggcaccauuaagugguu

SEQ ID NO: 7513 - RNA, 19 nt, Artificial Sequence
  RNA Oligomer
ucgacacuuacuccaguaa

SEQ ID NO: 7514 - RNA, 19 nt, Artificial Sequence
  RNA Oligomer
gacucugauaaaagucuuc

SEQ ID NO: 7515 - RNA, 19 nt, Artificial Sequence
  RNA Oligomer
ucacuuguaccuuccacaa

SEQ ID NO: 7516 - RNA, 19 nt, Artificial Sequence
  RNA Oligomer
agaaacauccugccagguu

SEQ ID NO: 7517 - RNA, 19 nt, Artificial Sequence
  RNA Oligomer
ggaauucagaccggaaggu

SEQ ID NO: 7518 - RNA, 19 nt, Artificial Sequence
  RNA Oligomer
cccgcagagcaaaggaauu

SEQ ID NO: 7519 - RNA, 19 nt, Artificial Sequence
  RNA Oligomer
ucuucgugaugacaaacuu

SEQ ID NO: 7520 - RNA, 19 nt, Artificial Sequence
  RNA Oligomer
caagcuguaccagcggaaa

SEQ ID NO: 7521 - RNA, 19 nt, Artificial Sequence
  RNA Oligomer
caagaccugcgauggacuu

SEQ ID NO: 7522 - RNA, 19 nt, Artificial Sequence
  RNA Oligomer
agugguucuuccacgugau

SEQ ID NO: 7523 - RNA, 19 nt, Artificial Sequence
  RNA Oligomer
ccuuuguggaugaauccca

SEQ ID NO: 7524 - RNA, 19 nt, Artificial Sequence
  RNA Oligomer
gccgacauuaaaguaugug

SEQ ID NO: 7525 - RNA, 19 nt, Artificial Sequence
  RNA Oligomer
gcugucgcucccauauuua

SEQ ID NO: 7526 - RNA, 19 nt, Artificial Sequence
  RNA Oligomer
acauccugccagguuuaaa

SEQ ID NO: 7527 - RNA, 19 nt, Artificial Sequence
  RNA Oligomer
gaaaacuucacugugcuca

SEQ ID NO: 7528 - RNA, 19 nt, Artificial Sequence
  RNA Oligomer
caaacuuucucaaaacaga

SEQ ID NO: 7529 - RNA, 19 nt, Artificial Sequence
  RNA Oligomer
agaccugcgauggacuuca

SEQ ID NO: 7530 - RNA, 19 nt, Artificial Sequence
  RNA Oligomer
cgacacuuacuccaguaac

SEQ ID NO: 7531 - RNA, 19 nt, Artificial Sequence
  RNA Oligomer
cucggauccagagcaugaa

SEQ ID NO: 7532 - RNA, 19 nt, Artificial Sequence
  RNA Oligomer
ugccagguuuaaacaucac

SEQ ID NO: 7533 - RNA, 19 nt, Artificial Sequence
  RNA Oligomer
cugccagguuuaaacauca

SEQ ID NO: 7534 - RNA, 19 nt, Artificial Sequence
  RNA Oligomer
ccacaacuacaccacgaga

SEQ ID NO: 7535 - RNA, 19 nt, Artificial Sequence
  RNA Oligomer
gaagaccugugaagucucu

SEQ ID NO: 7536 - RNA, 19 nt, Artificial Sequence
  RNA Oligomer
ggugcacagugucuuugac

SEQ ID NO: 7537 - RNA, 19 nt, Artificial Sequence
  RNA Oligomer
agaaaggaggcgacuccua

SEQ ID NO: 7538 - RNA, 19 nt, Artificial Sequence
  RNA Oligomer
ccaagaagucccaagaccu

SEQ ID NO: 7539 - RNA, 19 nt, Artificial Sequence
  RNA Oligomer
acauuaaaguauguguccu

SEQ ID NO: 7540 - RNA, 19 nt, Artificial Sequence
  RNA Oligomer
agccgacauuaaaguaugu

SEQ ID NO: 7541 - RNA, 19 nt, Artificial Sequence
  RNA Oligomer
uccaguaacugcugucgcu

SEQ ID NO: 7542 - RNA, 19 nt, Artificial Sequence
  RNA Oligomer
uccagcugguuguguacau

SEQ ID NO: 7543 - RNA, 19 nt, Artificial Sequence
  RNA Oligomer
acauuauccagcugguugu

SEQ ID NO: 7544 - RNA, 19 nt, Artificial Sequence
  RNA Oligomer
ggauccguuuugacauccu

SEQ ID NO: 7545 - RNA, 19 nt, Artificial Sequence
  RNA Oligomer
gauacgccaaguacuacaa

SEQ ID NO: 7546 - RNA, 19 nt, Artificial Sequence
  RNA Oligomer
ucggauccagagcaugaau

SEQ ID NO: 7547 - RNA, 19 nt, Artificial Sequence
  RNA Oligomer
gugccgaaaacuucacugu

SEQ ID NO: 7548 - RNA, 19 nt, Artificial Sequence
  RNA Oligomer
ucaccaccucagagcuguu

SEQ ID NO: 7549 - RNA, 19 nt, Artificial Sequence
  RNA Oligomer
ggacuucacagauuugucc

SEQ ID NO: 7550 - RNA, 19 nt, Artificial Sequence
  RNA Oligomer
ugcgauggacuucacagau

SEQ ID NO: 7551 - RNA, 19 nt, Artificial Sequence
  RNA Oligomer
cugcgauggacuucacaga

SEQ ID NO: 7552 - RNA, 19 nt, Artificial Sequence
  RNA Oligomer
aguccauuguggagccaaa

SEQ ID NO: 7553 - RNA, 19 nt, Artificial Sequence
  RNA Oligomer
aucgacacuuacuccagua

SEQ ID NO: 7554 - RNA, 19 nt, Artificial Sequence
  RNA Oligomer
acauccugguuuuuggcac

SEQ ID NO: 7555 - RNA, 19 nt, Artificial Sequence
  RNA Oligomer
cgggauccguuuugacauc

SEQ ID NO: 7556 - RNA, 19 nt, Artificial Sequence
  RNA Oligomer
acgagaaacauccugccag

SEQ ID NO: 7557 - RNA, 19 nt, Artificial Sequence
  RNA Oligomer
acagugccgaaaacuucac

SEQ ID NO: 7558 - RNA, 19 nt, Artificial Sequence
  RNA Oligomer
cagaagaccugugaagucu

SEQ ID NO: 7559 - RNA, 19 nt, Artificial Sequence
  RNA Oligomer
ucagaccggaaggugugua

SEQ ID NO: 7560 - RNA, 19 nt, Artificial Sequence
  RNA Oligomer
cucugaccgagguuguaaa

SEQ ID NO: 7561 - RNA, 19 nt, Artificial Sequence
  RNA Oligomer
gugucuuugacaccgcaga

SEQ ID NO: 7562 - RNA, 19 nt, Artificial Sequence
  RNA Oligomer
ugcacagugucuuugacac

SEQ ID NO: 7563 - RNA, 19 nt, Artificial Sequence
  RNA Oligomer
agcggaaagagccugucau

SEQ ID NO: 7564 - RNA, 19 nt, Artificial Sequence
  RNA Oligomer
agcugugcugccggaaaaa

SEQ ID NO: 7565 - RNA, 19 nt, Artificial Sequence
  RNA Oligomer
guauguguccuuuguggau

SEQ ID NO: 7566 - RNA, 19 nt, Artificial Sequence
  RNA Oligomer
acgccaaguacuacaagga

SEQ ID NO: 7567 - RNA, 19 nt, Artificial Sequence
  RNA Oligomer
ccugcucucuugaacagug

SEQ ID NO: 7568 - RNA, 19 nt, Artificial Sequence
  RNA Oligomer
cuuucuucgugaugacaaa

SEQ ID NO: 7569 - RNA, 19 nt, Artificial Sequence
  RNA Oligomer
gucuuugacaccgcagacu

SEQ ID NO: 7570 - RNA, 19 nt, Artificial Sequence
  RNA Oligomer
uaaaguauguguccuuugu

SEQ ID NO: 7571 - RNA, 19 nt, Artificial Sequence
  RNA Oligomer
aggaagaagugcgagucca

SEQ ID NO: 7572 - RNA, 19 nt, Artificial Sequence
  RNA Oligomer
ggaaaauuugacauuaucc

SEQ ID NO: 7573 - RNA, 19 nt, Artificial Sequence
  RNA Oligomer
uccugccagguuuaaacau

SEQ ID NO: 7574 - RNA, 19 nt, Artificial Sequence
  RNA Oligomer
cagugucuuugacaccgca

SEQ ID NO: 7575 - RNA, 19 nt, Artificial Sequence
  RNA Oligomer
agcuguaccagcggaaaga

SEQ ID NO: 7576 - RNA, 19 nt, Artificial Sequence
  RNA Oligomer
cagagcuguucaggaagcu

SEQ ID NO: 7577 - RNA, 19 nt, Artificial Sequence
  RNA Oligomer
ccaucucaacucccugaga

SEQ ID NO: 7578 - RNA, 19 nt, Artificial Sequence
  RNA Oligomer
ggugaaccagcagcuacua

SEQ ID NO: 7579 - RNA, 19 nt, Artificial Sequence
  RNA Oligomer
acauuaggauggugaacca

SEQ ID NO: 7580 - RNA, 19 nt, Artificial Sequence
  RNA Oligomer
cuaggagacaucuuccgag

SEQ ID NO: 7581 - RNA, 19 nt, Artificial Sequence
  RNA Oligomer
gccugcucucuugaacagu

SEQ ID NO: 7582 - RNA, 19 nt, Artificial Sequence
  RNA Oligomer
ccacauuaggauggugaac

SEQ ID NO: 7583 - RNA, 19 nt, Artificial Sequence
  RNA Oligomer
ugucccauuuuccgacuag

SEQ ID NO: 7584 - RNA, 19 nt, Artificial Sequence
  RNA Oligomer
ccucugaccgagguuguaa

SEQ ID NO: 7585 - RNA, 19 nt, Artificial Sequence
  RNA Oligomer
uggugaaccagcagcuacu

SEQ ID NO: 7586 - RNA, 19 nt, Artificial Sequence
  RNA Oligomer
gggauccguuuugacaucc

SEQ ID NO: 7587 - RNA, 19 nt, Artificial Sequence
  RNA Oligomer
ugcaguuccuccugcucua

SEQ ID NO: 7588 - RNA, 19 nt, Artificial Sequence
  RNA Oligomer
ucccaucucaacucccuga

SEQ ID NO: 7589 - RNA, 19 nt, Artificial Sequence
  RNA Oligomer
ucgggauccguuuugacau

SEQ ID NO: 7590 - RNA, 19 nt, Artificial Sequence
  RNA Oligomer
ugacauuauccagcugguu

SEQ ID NO: 7591 - RNA, 19 nt, Artificial Sequence
  RNA Oligomer
gccugucaucaguucugug

SEQ ID NO: 7592 - RNA, 19 nt, Artificial Sequence
  RNA Oligomer
agccugucaucaguucugu

SEQ ID NO: 7593 - RNA, 19 nt, Artificial Sequence
  RNA Oligomer
gagccugucaucaguucug

SEQ ID NO: 7594 - RNA, 19 nt, Artificial Sequence
  RNA Oligomer
ugcagcugcagugauguuu

SEQ ID NO: 7595 - RNA, 19 nt, Artificial Sequence
  RNA Oligomer
cugcagcugcagugauguu

SEQ ID NO: 7596 - RNA, 19 nt, Artificial Sequence
  RNA Oligomer
cggaaagagccugucauca

SEQ ID NO: 7597 - RNA, 19 nt, Artificial Sequence
  RNA Oligomer
ccagacgccauuuaaaagu

SEQ ID NO: 7598 - RNA, 19 nt, Artificial Sequence
  RNA Oligomer
guggcucugauugcuuuau

SEQ ID NO: 7599 - RNA, 19 nt, Artificial Sequence
  RNA Oligomer
aacguaggaaaagaugauc

SEQ ID NO: 7600 - RNA, 19 nt, Artificial Sequence
  RNA Oligomer
acguaggaaaagaugauca

SEQ ID NO: 7601 - RNA, 19 nt, Artificial Sequence
  RNA Oligomer
aagugauguuuaaaccugg

SEQ ID NO: 7602 - RNA, 19 nt, Artificial Sequence
  RNA Oligomer
uaggaaaagaugaucacgu

SEQ ID NO: 7603 - RNA, 19 nt, Artificial Sequence
  RNA Oligomer
aucccgaagacuuuuauca

SEQ ID NO: 7604 - RNA, 19 nt, Artificial Sequence
  RNA Oligomer
cacaucugaaaaauuaucg

SEQ ID NO: 7605 - RNA, 19 nt, Artificial Sequence
  RNA Oligomer
caucugaaaaauuaucgcc

SEQ ID NO: 7606 - RNA, 19 nt, Artificial Sequence
  RNA Oligomer
agcacagugaaguuuucgg

SEQ ID NO: 7607 - RNA, 19 nt, Artificial Sequence
  RNA Oligomer
aagggaagguguagucugc

SEQ ID NO: 7608 - RNA, 19 nt, Artificial Sequence
  RNA Oligomer
aaacguaggaaaagaugau

SEQ ID NO: 7609 - RNA, 19 nt, Artificial Sequence
  RNA Oligomer
augaucacguggaagaacc

SEQ ID NO: 7610 - RNA, 19 nt, Artificial Sequence
  RNA Oligomer
acaucugaaaaauuaucgc

SEQ ID NO: 7611 - RNA, 19 nt, Artificial Sequence
  RNA Oligomer
aucugaaaaauuaucgccu

SEQ ID NO: 7612 - RNA, 19 nt, Artificial Sequence
  RNA Oligomer
aagucgauauuguucuuga

SEQ ID NO: 7613 - RNA, 19 nt, Artificial Sequence
  RNA Oligomer
agggauaaauaugggagcg

SEQ ID NO: 7614 - RNA, 19 nt, Artificial Sequence
  RNA Oligomer
aaugucaaauuuuccuccg

SEQ ID NO: 7615 - RNA, 19 nt, Artificial Sequence
  RNA Oligomer
uuuguucgucucauacugg

SEQ ID NO: 7616 - RNA, 19 nt, Artificial Sequence
  RNA Oligomer
ucgauauuguucuugauga

SEQ ID NO: 7617 - RNA, 19 nt, Artificial Sequence
  RNA Oligomer
cugaauuccuuugcucugc

SEQ ID NO: 7618 - RNA, 19 nt, Artificial Sequence
  RNA Oligomer
augucaaauuuuccuccgg

SEQ ID NO: 7619 - RNA, 19 nt, Artificial Sequence
  RNA Oligomer
gcacagugaaguuuucggc

SEQ ID NO: 7620 - RNA, 19 nt, Artificial Sequence
  RNA Oligomer
aagcaaacguaggaaaaga

SEQ ID NO: 7621 - RNA, 19 nt, Artificial Sequence
  RNA Oligomer
aggaaaagaugaucacgug

SEQ ID NO: 7622 - RNA, 19 nt, Artificial Sequence
  RNA Oligomer
aagaugaucacguggaaga

SEQ ID NO: 7623 - RNA, 19 nt, Artificial Sequence
  RNA Oligomer
uuucuaagcagcuguaucu

SEQ ID NO: 7624 - RNA, 19 nt, Artificial Sequence
  RNA Oligomer
acuuuaaugucggcuuugg

SEQ ID NO: 7625 - RNA, 19 nt, Artificial Sequence
  RNA Oligomer
agugauguuuaaaccuggc

SEQ ID NO: 7626 - RNA, 19 nt, Artificial Sequence
  RNA Oligomer
uuguucgucucauacugga

SEQ ID NO: 7627 - RNA, 19 nt, Artificial Sequence
  RNA Oligomer
aucccuuuuuacaaccucg

SEQ ID NO: 7628 - RNA, 19 nt, Artificial Sequence
  RNA Oligomer
guuuugagaaaguuuguca

SEQ ID NO: 7629 - RNA, 19 nt, Artificial Sequence
  RNA Oligomer
gaaaagaugaucacgugga

SEQ ID NO: 7630 - RNA, 19 nt, Artificial Sequence
  RNA Oligomer
aaaagaugaucacguggaa

SEQ ID NO: 7631 - RNA, 19 nt, Artificial Sequence
  RNA Oligomer
auggacucgcacuucuucc

SEQ ID NO: 7632 - RNA, 19 nt, Artificial Sequence
  RNA Oligomer
uaguauucguugaccacac

SEQ ID NO: 7633 - RNA, 19 nt, Artificial Sequence
  RNA Oligomer
cagggauaaauaugggagc

SEQ ID NO: 7634 - RNA, 19 nt, Artificial Sequence
  RNA Oligomer
uggugccauaauucaugcu

SEQ ID NO: 7635 - RNA, 19 nt, Artificial Sequence
  RNA Oligomer
ucugaaaaauuaucgccug

SEQ ID NO: 7636 - RNA, 19 nt, Artificial Sequence
  RNA Oligomer
aaaauuaucgccuguuucu

SEQ ID NO: 7637 - RNA, 19 nt, Artificial Sequence
  RNA Oligomer
uucugagucuuguggaagg

SEQ ID NO: 7638 - RNA, 19 nt, Artificial Sequence
  RNA Oligomer
uucucgugguguaguugug

SEQ ID NO: 7639 - RNA, 19 nt, Artificial Sequence
  RNA Oligomer
ugaauuccuuugcucugcg

SEQ ID NO: 7640 - RNA, 19 nt, Artificial Sequence
  RNA Oligomer
aagguguagucugcggugu

SEQ ID NO: 7641 - RNA, 19 nt, Artificial Sequence
  RNA Oligomer
cuucuucacuccauucucc

SEQ ID NO: 7642 - RNA, 19 nt, Artificial Sequence
  RNA Oligomer
aaauuuuccuccggugcca

SEQ ID NO: 7643 - RNA, 19 nt, Artificial Sequence
  RNA Oligomer
cugaaaaauuaucgccugu

SEQ ID NO: 7644 - RNA, 19 nt, Artificial Sequence
  RNA Oligomer
aaaaauuaucgccuguuuc

SEQ ID NO: 7645 - RNA, 19 nt, Artificial Sequence
  RNA Oligomer
caagugauguuuaaaccug

SEQ ID NO: 7646 - RNA, 19 nt, Artificial Sequence
  RNA Oligomer
uuucucgugguguaguugu

SEQ ID NO: 7647 - RNA, 19 nt, Artificial Sequence
  RNA Oligomer
gggaagucgauauuguucu

SEQ ID NO: 7648 - RNA, 19 nt, Artificial Sequence
  RNA Oligomer
gaauuccuuugcucugcgg

SEQ ID NO: 7649 - RNA, 19 nt, Artificial Sequence
  RNA Oligomer
uguuuugagaaaguuuguc

SEQ ID NO: 7650 - RNA, 19 nt, Artificial Sequence
  RNA Oligomer
uugaagccacuguacugcc

SEQ ID NO: 7651 - RNA, 19 nt, Artificial Sequence
  RNA Oligomer
ucuaagcagcuguaucucc

SEQ ID NO: 7652 - RNA, 19 nt, Artificial Sequence
  RNA Oligomer
aaggacacauacuuuaaug

SEQ ID NO: 7653 - RNA, 19 nt, Artificial Sequence
  RNA Oligomer
auaaauaugggagcgacag

SEQ ID NO: 7654 - RNA, 19 nt, Artificial Sequence
  RNA Oligomer
gugccauaauucaugcucu

SEQ ID NO: 7655 - RNA, 19 nt, Artificial Sequence
  RNA Oligomer
uuucucaacauuguuuucc

SEQ ID NO: 7656 - RNA, 19 nt, Artificial Sequence
  RNA Oligomer
cuuuguucgucucauacug

SEQ ID NO: 7657 - RNA, 19 nt, Artificial Sequence
  RNA Oligomer
uugaugagcacagugaagu

SEQ ID NO: 7658 - RNA, 19 nt, Artificial Sequence
  RNA Oligomer
ucccuuuuuacaaccucgg

SEQ ID NO: 7659 - RNA, 19 nt, Artificial Sequence
  RNA Oligomer
cuuuuuacaaccucgguca

SEQ ID NO: 7660 - RNA, 19 nt, Artificial Sequence
  RNA Oligomer
ucacgaagaaagaguuccc

SEQ ID NO: 7661 - RNA, 19 nt, Artificial Sequence
  RNA Oligomer
aaagggaagguguagucug

SEQ ID NO: 7662 - RNA, 19 nt, Artificial Sequence
  RNA Oligomer
uucacuccauucuccacga

SEQ ID NO: 7663 - RNA, 19 nt, Artificial Sequence
  RNA Oligomer
uucuaagcagcuguaucuc

SEQ ID NO: 7664 - RNA, 19 nt, Artificial Sequence
  RNA Oligomer
aagcagcuguaucuccucu

SEQ ID NO: 7665 - RNA, 19 nt, Artificial Sequence
  RNA Oligomer
agccuggacaaaucuguga

SEQ ID NO: 7666 - RNA, 19 nt, Artificial Sequence
  RNA Oligomer
auacuuuaaugucggcuuu

SEQ ID NO: 7667 - RNA, 19 nt, Artificial Sequence
  RNA Oligomer
cuuuaaugucggcuuuggc

SEQ ID NO: 7668 - RNA, 19 nt, Artificial Sequence
  RNA Oligomer
gauguacacaaccagcugg

SEQ ID NO: 7669 - RNA, 19 nt, Artificial Sequence
  RNA Oligomer
ucugagucuuguggaaggu

SEQ ID NO: 7670 - RNA, 19 nt, Artificial Sequence
  RNA Oligomer
ugagucuuguggaagguac

SEQ ID NO: 7671 - RNA, 19 nt, Artificial Sequence
  RNA Oligomer
aaguuuucggcacuguuca

SEQ ID NO: 7672 - RNA, 19 nt, Artificial Sequence
  RNA Oligomer
uuucggcacuguucaagag

SEQ ID NO: 7673 - RNA, 19 nt, Artificial Sequence
  RNA Oligomer
uuggccuucuguuuugaga

SEQ ID NO: 7674 - RNA, 19 nt, Artificial Sequence
  RNA Oligomer
cuucacuccauucuccacg

SEQ ID NO: 7675 - RNA, 19 nt, Artificial Sequence
  RNA Oligomer
uccauucuccacgaucucc

SEQ ID NO: 7676 - RNA, 19 nt, Artificial Sequence
  RNA Oligomer
aucuccucuuucaccucug

SEQ ID NO: 7677 - RNA, 19 nt, Artificial Sequence
  RNA Oligomer
cuuucaccucugcuauccc

SEQ ID NO: 7678 - RNA, 19 nt, Artificial Sequence
  RNA Oligomer
gagcaaagcaaacguagga

SEQ ID NO: 7679 - RNA, 19 nt, Artificial Sequence
  RNA Oligomer
gucgccuccuuucuaagca

SEQ ID NO: 7680 - RNA, 19 nt, Artificial Sequence
  RNA Oligomer
cuaagcagcuguaucuccu

SEQ ID NO: 7681 - RNA, 19 nt, Artificial Sequence
  RNA Oligomer
aagaaccacuuaauggugc

SEQ ID NO: 7682 - RNA, 19 nt, Artificial Sequence
  RNA Oligomer
acaauggacucgcacuucu

SEQ ID NO: 7683 - RNA, 19 nt, Artificial Sequence
  RNA Oligomer
ucaaauuuuccuccggugc

SEQ ID NO: 7684 - RNA, 19 nt, Artificial Sequence
  RNA Oligomer
ucuuggccuucuguuuuga

SEQ ID NO: 7685 - RNA, 19 nt, Artificial Sequence
  RNA Oligomer
ugcaccaacuucuucacuc

SEQ ID NO: 7686 - RNA, 19 nt, Artificial Sequence
  RNA Oligomer
gcaccaacuucuucacucc

SEQ ID NO: 7687 - RNA, 19 nt, Artificial Sequence
  RNA Oligomer
ucuccucuuucaccucugc

SEQ ID NO: 7688 - RNA, 19 nt, Artificial Sequence
  RNA Oligomer
accagagcaaagcaaacgu

SEQ ID NO: 7689 - RNA, 19 nt, Artificial Sequence
  RNA Oligomer
cuccuuucuaagcagcugu

SEQ ID NO: 7690 - RNA, 19 nt, Artificial Sequence
  RNA Oligomer
uaagcagcuguaucuccuc

SEQ ID NO: 7691 - RNA, 19 nt, Artificial Sequence
  RNA Oligomer
augaggaagucgaugaaca

SEQ ID NO: 7692 - RNA, 19 nt, Artificial Sequence
  RNA Oligomer
ugucaaauuuuccuccggu

SEQ ID NO: 7693 - RNA, 19 nt, Artificial Sequence
  RNA Oligomer
caaauuuuccuccggugcc

SEQ ID NO: 7694 - RNA, 19 nt, Artificial Sequence
  RNA Oligomer
aaaccaggaugucaaaacg

SEQ ID NO: 7695 - RNA, 19 nt, Artificial Sequence
  RNA Oligomer
guccguuucucaacauugu

SEQ ID NO: 7696 - RNA, 19 nt, Artificial Sequence
  RNA Oligomer
uuuuuacaaccucggucag

SEQ ID NO: 7697 - RNA, 19 nt, Artificial Sequence
  RNA Oligomer
cuguuuugagaaaguuugu

SEQ ID NO: 7698 - RNA, 19 nt, Artificial Sequence
  RNA Oligomer
uucuucacuccauucucca

SEQ ID NO: 7699 - RNA, 19 nt, Artificial Sequence
  RNA Oligomer
ugguacagcuugucacuca

SEQ ID NO: 7700 - RNA, 19 nt, Artificial Sequence
  RNA Oligomer
uacagcuugucacucacca

SEQ ID NO: 7701 - RNA, 19 nt, Artificial Sequence
  RNA Oligomer
caccagagcaaagcaaacg

SEQ ID NO: 7702 - RNA, 19 nt, Artificial Sequence
  RNA Oligomer
uucuuggcccuugacaucu

SEQ ID NO: 7703 - RNA, 19 nt, Artificial Sequence
  RNA Oligomer
gacucgcacuucuuccugu

SEQ ID NO: 7704 - RNA, 19 nt, Artificial Sequence
  RNA Oligomer
aggaagucgaugaacacag

SEQ ID NO: 7705 - RNA, 19 nt, Artificial Sequence
  RNA Oligomer
gaagucgaugaacacagcg

SEQ ID NO: 7706 - RNA, 19 nt, Artificial Sequence
  RNA Oligomer
uugagccgauguacacaac

SEQ ID NO: 7707 - RNA, 19 nt, Artificial Sequence
  RNA Oligomer
aaccaggaugucaaaacgg

SEQ ID NO: 7708 - RNA, 19 nt, Artificial Sequence
  RNA Oligomer
guuuucggcacuguucaag

SEQ ID NO: 7709 - RNA, 19 nt, Artificial Sequence
  RNA Oligomer
auccaucccuuuuuacaac

SEQ ID NO: 7710 - RNA, 19 nt, Artificial Sequence
  RNA Oligomer
uccaucccuuuuuacaacc

SEQ ID NO: 7711 - RNA, 19 nt, Artificial Sequence
  RNA Oligomer
gagaaaguuugucaucacg

SEQ ID NO: 7712 - RNA, 19 nt, Artificial Sequence
  RNA Oligomer
agcagcuguaucuccucug

SEQ ID NO: 7713 - RNA, 19 nt, Artificial Sequence
  RNA Oligomer
aacauuguuuuccuuguag

SEQ ID NO: 7714 - RNA, 19 nt, Artificial Sequence
  RNA Oligomer
cuggauccgagugacuuug

SEQ ID NO: 7715 - RNA, 19 nt, Artificial Sequence
  RNA Oligomer
caucccuuuuuacaaccuc

SEQ ID NO: 7716 - RNA, 19 nt, Artificial Sequence
  RNA Oligomer
agccgauguacacaaccag

SEQ ID NO: 7717 - RNA, 19 nt, Artificial Sequence
  RNA Oligomer
aaaaccaggaugucaaaac

SEQ ID NO: 7718 - RNA, 19 nt, Artificial Sequence
  RNA Oligomer
uucucaacauuguuuuccu

SEQ ID NO: 7719 - RNA, 19 nt, Artificial Sequence
  RNA Oligomer
auacuggaaaacaucacug

SEQ ID NO: 7720 - RNA, 19 nt, Artificial Sequence
  RNA Oligomer
gucaucacgaagaaagagu

SEQ ID NO: 7721 - RNA, 19 nt, Artificial Sequence
  RNA Oligomer
caucacgaagaaagaguuc

SEQ ID NO: 7722 - RNA, 19 nt, Artificial Sequence
  RNA Oligomer
augggagcgacagcaguua

SEQ ID NO: 7723 - RNA, 19 nt, Artificial Sequence
  RNA Oligomer
auggugccauaauucaugc

SEQ ID NO: 7724 - RNA, 19 nt, Artificial Sequence
  RNA Oligomer
ucaacauuguuuuccuugu

SEQ ID NO: 7725 - RNA, 19 nt, Artificial Sequence
  RNA Oligomer
auuguuuuccuuguaguac

SEQ ID NO: 7726 - RNA, 19 nt, Artificial Sequence
  RNA Oligomer
agaaccacuuaauggugcc

SEQ ID NO: 7727 - RNA, 19 nt, Artificial Sequence
  RNA Oligomer
aagacuuuuaucagagucc

SEQ ID NO: 7728 - RNA, 19 nt, Artificial Sequence
  RNA Oligomer
uuguuuuccuuguaguacu

SEQ ID NO: 7729 - RNA, 19 nt, Artificial Sequence
  RNA Oligomer
ucauacuggaaaacaucac

SEQ ID NO: 7730 - RNA, 19 nt, Artificial Sequence
  RNA Oligomer
accaggaugucaaaacgga

SEQ ID NO: 7731 - RNA, 19 nt, Artificial Sequence
  RNA Oligomer
caaaacggaucccgaagac

SEQ ID NO: 7732 - RNA, 19 nt, Artificial Sequence
  RNA Oligomer
uugagaaaguuugucauca

SEQ ID NO: 7733 - RNA, 19 nt, Artificial Sequence
  RNA Oligomer
aaaacaucacugcagcugc

SEQ ID NO: 7734 - RNA, 19 nt, Artificial Sequence
  RNA Oligomer
auucuccacgaucuccucu

SEQ ID NO: 7735 - RNA, 19 nt, Artificial Sequence
  RNA Oligomer
caccagggauaaauauggg

SEQ ID NO: 7736 - RNA, 19 nt, Artificial Sequence
  RNA Oligomer
auauuguucuugaugagca

SEQ ID NO: 7737 - RNA, 19 nt, Artificial Sequence
  RNA Oligomer
cucuuggccuucuguuuug

SEQ ID NO: 7738 - RNA, 19 nt, Artificial Sequence
  RNA Oligomer
cugugcaccaacuucuuca

SEQ ID NO: 7739 - RNA, 19 nt, Artificial Sequence
  RNA Oligomer
uaaugucggcuuuggcucc

SEQ ID NO: 7740 - RNA, 19 nt, Artificial Sequence
  RNA Oligomer
aauggugccauaauucaug

SEQ ID NO: 7741 - RNA, 19 nt, Artificial Sequence
  RNA Oligomer
uuuuccuuguaguacuugg

SEQ ID NO: 7742 - RNA, 19 nt, Artificial Sequence
  RNA Oligomer
uuccuuguaguacuuggcg

SEQ ID NO: 7743 - RNA, 19 nt, Artificial Sequence
  RNA Oligomer
aauucaugcucuggauccg

SEQ ID NO: 7744 - RNA, 19 nt, Artificial Sequence
  RNA Oligomer
cauacuggaaaacaucacu

SEQ ID NO: 7745 - RNA, 19 nt, Artificial Sequence
  RNA Oligomer
ugugcaccaacuucuucac

SEQ ID NO: 7746 - RNA, 19 nt, Artificial Sequence
  RNA Oligomer
acgaucuccucuuucaccu

SEQ ID NO: 7747 - RNA, 19 nt, Artificial Sequence
  RNA Oligomer
gaucuccucuuucaccucu

SEQ ID NO: 7748 - RNA, 19 nt, Artificial Sequence
  RNA Oligomer
uucauccacaaaggacaca

SEQ ID NO: 7749 - RNA, 19 nt, Artificial Sequence
  RNA Oligomer
aaugucggcuuuggcucca

SEQ ID NO: 7750 - RNA, 19 nt, Artificial Sequence
  RNA Oligomer
gaaccacuuaauggugcca

SEQ ID NO: 7751 - RNA, 19 nt, Artificial Sequence
  RNA Oligomer
agacuuuuaucagaguccg

SEQ ID NO: 7752 - RNA, 19 nt, Artificial Sequence
  RNA Oligomer
uccacgaucuccucuuuca

SEQ ID NO: 7753 - RNA, 19 nt, Artificial Sequence
  RNA Oligomer
aaagucagccauguccugg

SEQ ID NO: 7754 - RNA, 19 nt, Artificial Sequence
  RNA Oligomer
auucauccacaaaggacac

SEQ ID NO: 7755 - RNA, 19 nt, Artificial Sequence
  RNA Oligomer
uggaagaaccacuuaaugg

SEQ ID NO: 7756 - RNA, 19 nt, Artificial Sequence
  RNA Oligomer
gcaccagggauaaauaugg

SEQ ID NO: 7757 - RNA, 19 nt, Artificial Sequence
  RNA Oligomer
aauaugggagcgacagcag

SEQ ID NO: 7758 - RNA, 19 nt, Artificial Sequence
  RNA Oligomer
uguaguacuuggcguaucu

SEQ ID NO: 7759 - RNA, 19 nt, Artificial Sequence
  RNA Oligomer
auccgagugacuuuguucg

SEQ ID NO: 7760 - RNA, 19 nt, Artificial Sequence
  RNA Oligomer
ccggucugaauuccuuugc

SEQ ID NO: 7761 - RNA, 19 nt, Artificial Sequence
  RNA Oligomer
ugagaaaguuugucaucac

SEQ ID NO: 7762 - RNA, 19 nt, Artificial Sequence
  RNA Oligomer
gaaaacaucacugcagcug

SEQ ID NO: 7763 - RNA, 19 nt, Artificial Sequence
  RNA Oligomer
ugugcacagaacugaugac

SEQ ID NO: 7764 - RNA, 19 nt, Artificial Sequence
  RNA Oligomer
uuccgcugguacagcuugu

SEQ ID NO: 7765 - RNA, 19 nt, Artificial Sequence
  RNA Oligomer
accagggauaaauauggga

SEQ ID NO: 7766 - RNA, 19 nt, Artificial Sequence
  RNA Oligomer
aguuacuggaguaaguguc

SEQ ID NO: 7767 - RNA, 19 nt, Artificial Sequence
  RNA Oligomer
uuaauggugccauaauuca

SEQ ID NO: 7768 - RNA, 19 nt, Artificial Sequence
  RNA Oligomer
aagucgaugaacacagcgg

SEQ ID NO: 7769 - RNA, 19 nt, Artificial Sequence
  RNA Oligomer
augcucuggauccgaguga

SEQ ID NO: 7770 - RNA, 19 nt, Artificial Sequence
  RNA Oligomer
gauguuuaaaccuggcagg

SEQ ID NO: 7771 - RNA, 19 nt, Artificial Sequence
  RNA Oligomer
aaaccuggcaggauguuuc

SEQ ID NO: 7772 - RNA, 19 nt, Artificial Sequence
  RNA Oligomer
uuguucuugaugagcacag

SEQ ID NO: 7773 - RNA, 19 nt, Artificial Sequence
  RNA Oligomer
cuggaaaacaucacugcag

SEQ ID NO: 7774 - RNA, 19 nt, Artificial Sequence
  RNA Oligomer
uggaaaacaucacugcagc

SEQ ID NO: 7775 - RNA, 19 nt, Artificial Sequence
  RNA Oligomer
uuggugugcacagaacuga

SEQ ID NO: 7776 - RNA, 19 nt, Artificial Sequence
  RNA Oligomer
gacacauacuuuaaugucg

SEQ ID NO: 7777 - RNA, 19 nt, Artificial Sequence
  RNA Oligomer
auucguugaccacacaggg

SEQ ID NO: 7778 - RNA, 19 nt, Artificial Sequence
  RNA Oligomer
uagucggaaaaugggacac

SEQ ID NO: 7779 - RNA, 19 nt, Artificial Sequence
  RNA Oligomer
gauauuguucuugaugagc

SEQ ID NO: 7780 - RNA, 19 nt, Artificial Sequence
  RNA Oligomer
gagcacagugaaguuuucg

SEQ ID NO: 7781 - RNA, 19 nt, Artificial Sequence
  RNA Oligomer
uucacaggucuucugguuc

SEQ ID NO: 7782 - RNA, 19 nt, Artificial Sequence
  RNA Oligomer
uccggucugaauuccuuug

SEQ ID NO: 7783 - RNA, 19 nt, Artificial Sequence
  RNA Oligomer
acacauacuuuaaugucgg

SEQ ID NO: 7784 - RNA, 19 nt, Artificial Sequence
  RNA Oligomer
aaccacuuaauggugccau

SEQ ID NO: 7785 - RNA, 19 nt, Artificial Sequence
  RNA Oligomer
uuacuggaguaagugucga

SEQ ID NO: 7786 - RNA, 19 nt, Artificial Sequence
  RNA Oligomer
gaagacuuuuaucagaguc

SEQ ID NO: 7787 - RNA, 19 nt, Artificial Sequence
  RNA Oligomer
uuguggaagguacaaguga

SEQ ID NO: 7788 - RNA, 19 nt, Artificial Sequence
  RNA Oligomer
aaccuggcaggauguuucu

SEQ ID NO: 7789 - RNA, 19 nt, Artificial Sequence
  RNA Oligomer
accuuccggucugaauucc

SEQ ID NO: 7790 - RNA, 19 nt, Artificial Sequence
  RNA Oligomer
aauuccuuugcucugcggg

SEQ ID NO: 7791 - RNA, 19 nt, Artificial Sequence
  RNA Oligomer
aaguuugucaucacgaaga

SEQ ID NO: 7792 - RNA, 19 nt, Artificial Sequence
  RNA Oligomer
uuuccgcugguacagcuug

SEQ ID NO: 7793 - RNA, 19 nt, Artificial Sequence
  RNA Oligomer
aaguccaucgcaggucuug

SEQ ID NO: 7794 - RNA, 19 nt, Artificial Sequence
  RNA Oligomer
aucacguggaagaaccacu

SEQ ID NO: 7795 - RNA, 19 nt, Artificial Sequence
  RNA Oligomer
ugggauucauccacaaagg

SEQ ID NO: 7796 - RNA, 19 nt, Artificial Sequence
  RNA Oligomer
cacauacuuuaaugucggc

SEQ ID NO: 7797 - RNA, 19 nt, Artificial Sequence
  RNA Oligomer
uaaauaugggagcgacagc

SEQ ID NO: 7798 - RNA, 19 nt, Artificial Sequence
  RNA Oligomer
uuuaaaccuggcaggaugu

SEQ ID NO: 7799 - RNA, 19 nt, Artificial Sequence
  RNA Oligomer
ugagcacagugaaguuuuc

SEQ ID NO: 7800 - RNA, 19 nt, Artificial Sequence
  RNA Oligomer
ucuguuuugagaaaguuug

SEQ ID NO: 7801 - RNA, 19 nt, Artificial Sequence
  RNA Oligomer
ugaaguccaucgcaggucu

SEQ ID NO: 7802 - RNA, 19 nt, Artificial Sequence
  RNA Oligomer
guuacuggaguaagugucg

SEQ ID NO: 7803 - RNA, 19 nt, Artificial Sequence
  RNA Oligomer
uucaugcucuggauccgag

SEQ ID NO: 7804 - RNA, 19 nt, Artificial Sequence
  RNA Oligomer
gugauguuuaaaccuggca

SEQ ID NO: 7805 - RNA, 19 nt, Artificial Sequence
  RNA Oligomer
ugauguuuaaaccuggcag

SEQ ID NO: 7806 - RNA, 19 nt, Artificial Sequence
  RNA Oligomer
ucucgugguguaguugugg

SEQ ID NO: 7807 - RNA, 19 nt, Artificial Sequence
  RNA Oligomer
agagacuucacaggucuuc

SEQ ID NO: 7808 - RNA, 19 nt, Artificial Sequence
  RNA Oligomer
gucaaagacacugugcacc

SEQ ID NO: 7809 - RNA, 19 nt, Artificial Sequence
  RNA Oligomer
uaggagucgccuccuuucu

SEQ ID NO: 7810 - RNA, 19 nt, Artificial Sequence
  RNA Oligomer
aggucuugggacuucuugg

SEQ ID NO: 7811 - RNA, 19 nt, Artificial Sequence
  RNA Oligomer
aggacacauacuuuaaugu

SEQ ID NO: 7812 - RNA, 19 nt, Artificial Sequence
  RNA Oligomer
acauacuuuaaugucggcu

SEQ ID NO: 7813 - RNA, 19 nt, Artificial Sequence
  RNA Oligomer
agcgacagcaguuacugga

SEQ ID NO: 7814 - RNA, 19 nt, Artificial Sequence
  RNA Oligomer
auguacacaaccagcugga

SEQ ID NO: 7815 - RNA, 19 nt, Artificial Sequence
  RNA Oligomer
acaaccagcuggauaaugu

SEQ ID NO: 7816 - RNA, 19 nt, Artificial Sequence
  RNA Oligomer
aggaugucaaaacggaucc

SEQ ID NO: 7817 - RNA, 19 nt, Artificial Sequence
  RNA Oligomer
uuguaguacuuggcguauc

SEQ ID NO: 7818 - RNA, 19 nt, Artificial Sequence
  RNA Oligomer
auucaugcucuggauccga

SEQ ID NO: 7819 - RNA, 19 nt, Artificial Sequence
  RNA Oligomer
acagugaaguuuucggcac

SEQ ID NO: 7820 - RNA, 19 nt, Artificial Sequence
  RNA Oligomer
aacagcucugaggugguga

SEQ ID NO: 7821 - RNA, 19 nt, Artificial Sequence
  RNA Oligomer
ggacaaaucugugaagucc

SEQ ID NO: 7822 - RNA, 19 nt, Artificial Sequence
  RNA Oligomer
aucugugaaguccaucgca

SEQ ID NO: 7823 - RNA, 19 nt, Artificial Sequence
  RNA Oligomer
ucugugaaguccaucgcag

SEQ ID NO: 7824 - RNA, 19 nt, Artificial Sequence
  RNA Oligomer
uuuggcuccacaauggacu

SEQ ID NO: 7825 - RNA, 19 nt, Artificial Sequence
  RNA Oligomer
uacuggaguaagugucgau

SEQ ID NO: 7826 - RNA, 19 nt, Artificial Sequence
  RNA Oligomer
gugccaaaaaccaggaugu

SEQ ID NO: 7827 - RNA, 19 nt, Artificial Sequence
  RNA Oligomer
gaugucaaaacggaucccg

SEQ ID NO: 7828 - RNA, 19 nt, Artificial Sequence
  RNA Oligomer
cuggcaggauguuucucgu

SEQ ID NO: 7829 - RNA, 19 nt, Artificial Sequence
  RNA Oligomer
gugaaguuuucggcacugu

SEQ ID NO: 7830 - RNA, 19 nt, Artificial Sequence
  RNA Oligomer
agacuucacaggucuucug

SEQ ID NO: 7831 - RNA, 19 nt, Artificial Sequence
  RNA Oligomer
uacacaccuuccggucuga

SEQ ID NO: 7832 - RNA, 19 nt, Artificial Sequence
  RNA Oligomer
uuuacaaccucggucagag

SEQ ID NO: 7833 - RNA, 19 nt, Artificial Sequence
  RNA Oligomer
ucugcggugucaaagacac

SEQ ID NO: 7834 - RNA, 19 nt, Artificial Sequence
  RNA Oligomer
gugucaaagacacugugca

SEQ ID NO: 7835 - RNA, 19 nt, Artificial Sequence
  RNA Oligomer
augacaggcucuuuccgcu

SEQ ID NO: 7836 - RNA, 19 nt, Artificial Sequence
  RNA Oligomer
uuuuuccggcagcacagcu

SEQ ID NO: 7837 - RNA, 19 nt, Artificial Sequence
  RNA Oligomer
auccacaaaggacacauac

SEQ ID NO: 7838 - RNA, 19 nt, Artificial Sequence
  RNA Oligomer
uccuuguaguacuuggcgu

SEQ ID NO: 7839 - RNA, 19 nt, Artificial Sequence
  RNA Oligomer
cacuguucaagagagcagg

SEQ ID NO: 7840 - RNA, 19 nt, Artificial Sequence
  RNA Oligomer
uuugucaucacgaagaaag

SEQ ID NO: 7841 - RNA, 19 nt, Artificial Sequence
  RNA Oligomer
agucugcggugucaaagac

SEQ ID NO: 7842 - RNA, 19 nt, Artificial Sequence
  RNA Oligomer
acaaaggacacauacuuua

SEQ ID NO: 7843 - RNA, 19 nt, Artificial Sequence
  RNA Oligomer
uggacucgcacuucuuccu

SEQ ID NO: 7844 - RNA, 19 nt, Artificial Sequence
  RNA Oligomer
ggauaaugucaaauuuucc

SEQ ID NO: 7845 - RNA, 19 nt, Artificial Sequence
  RNA Oligomer
auguuuaaaccuggcagga

SEQ ID NO: 7846 - RNA, 19 nt, Artificial Sequence
  RNA Oligomer
ugcggugucaaagacacug

SEQ ID NO: 7847 - RNA, 19 nt, Artificial Sequence
  RNA Oligomer
ucuuuccgcugguacagcu

SEQ ID NO: 7848 - RNA, 19 nt, Artificial Sequence
  RNA Oligomer
agcuuccugaacagcucug

SEQ ID NO: 7849 - RNA, 19 nt, Artificial Sequence
  RNA Oligomer
ucucagggaguugagaugg

SEQ ID NO: 7850 - RNA, 19 nt, Artificial Sequence
  RNA Oligomer
uaguagcugcugguucacc

SEQ ID NO: 7851 - RNA, 19 nt, Artificial Sequence
  RNA Oligomer
ugguucaccauccuaaugu

SEQ ID NO: 7852 - RNA, 19 nt, Artificial Sequence
  RNA Oligomer
cucggaagaugucuccuag

SEQ ID NO: 7853 - RNA, 19 nt, Artificial Sequence
  RNA Oligomer
acuguucaagagagcaggc

SEQ ID NO: 7854 - RNA, 19 nt, Artificial Sequence
  RNA Oligomer
guucaccauccuaaugugg

SEQ ID NO: 7855 - RNA, 19 nt, Artificial Sequence
  RNA Oligomer
cuagucggaaaaugggaca

SEQ ID NO: 7856 - RNA, 19 nt, Artificial Sequence
  RNA Oligomer
uuacaaccucggucagagg

SEQ ID NO: 7857 - RNA, 19 nt, Artificial Sequence
  RNA Oligomer
aguagcugcugguucacca

SEQ ID NO: 7858 - RNA, 19 nt, Artificial Sequence
  RNA Oligomer
ggaugucaaaacggauccc

SEQ ID NO: 7859 - RNA, 19 nt, Artificial Sequence
  RNA Oligomer
uagagcaggaggaacugca

SEQ ID NO: 7860 - RNA, 19 nt, Artificial Sequence
  RNA Oligomer
ucagggaguugagauggga

SEQ ID NO: 7861 - RNA, 19 nt, Artificial Sequence
  RNA Oligomer
augucaaaacggaucccga

SEQ ID NO: 7862 - RNA, 19 nt, Artificial Sequence
  RNA Oligomer
aaccagcuggauaauguca

SEQ ID NO: 7863 - RNA, 19 nt, Artificial Sequence
  RNA Oligomer
cacagaacugaugacaggc

SEQ ID NO: 7864 - RNA, 19 nt, Artificial Sequence
  RNA Oligomer
acagaacugaugacaggcu

SEQ ID NO: 7865 - RNA, 19 nt, Artificial Sequence
  RNA Oligomer
cagaacugaugacaggcuc

SEQ ID NO: 7866 - RNA, 19 nt, Artificial Sequence
  RNA Oligomer
aaacaucacugcagcugca

SEQ ID NO: 7867 - RNA, 19 nt, Artificial Sequence
  RNA Oligomer
aacaucacugcagcugcag

SEQ ID NO: 7868 - RNA, 19 nt, Artificial Sequence
  RNA Oligomer
ugaugacaggcucuuuccg

SEQ ID NO: 7869 - RNA, 19 nt, Artificial Sequence
  RNA Oligomer
acuuuuaaauggcgucugg

SEQ ID NO: 7870 - RNA, 19 nt, Artificial Sequence
  RNA Oligomer
auaaagcaaucagagccac

SEQ ID NO: 7871 - RNA, 19 nt, Artificial Sequence
  RNA Oligomer
accugaacauccucuccua

SEQ ID NO: 7872 - RNA, 19 nt, Artificial Sequence
  RNA Oligomer
gcacauuuuuaccaucagu

SEQ ID NO: 7873 - RNA, 19 nt, Artificial Sequence
  RNA Oligomer
acaucacuaucucccugau

SEQ ID NO: 7874 - RNA, 19 nt, Artificial Sequence
  RNA Oligomer
cccgcagugagaucuucau

SEQ ID NO: 7875 - RNA, 19 nt, Artificial Sequence
  RNA Oligomer
gcaacagcagccucuucaa

SEQ ID NO: 7876 - RNA, 19 nt, Artificial Sequence
  RNA Oligomer
cugcacucaucuccaacaa

SEQ ID NO: 7877 - RNA, 19 nt, Artificial Sequence
  RNA Oligomer
gcguguucuuccaggagau

SEQ ID NO: 7878 - RNA, 19 nt, Artificial Sequence
  RNA Oligomer
ccacgauccaguacaacgu

SEQ ID NO: 7879 - RNA, 19 nt, Artificial Sequence
  RNA Oligomer
ggaugaugaaggacgucuu

SEQ ID NO: 7880 - RNA, 19 nt, Artificial Sequence
  RNA Oligomer
cacauuuuuaccaucagua

SEQ ID NO: 7881 - RNA, 19 nt, Artificial Sequence
  RNA Oligomer
cgaggacaucagcaauaag

SEQ ID NO: 7882 - RNA, 19 nt, Artificial Sequence
  RNA Oligomer
accuccucaucgccauguu

SEQ ID NO: 7883 - RNA, 19 nt, Artificial Sequence
  RNA Oligomer
caccugaacauccucuccu

SEQ ID NO: 7884 - RNA, 19 nt, Artificial Sequence
  RNA Oligomer
gccaaggacaugaaguuug

SEQ ID NO: 7885 - RNA, 19 nt, Artificial Sequence
  RNA Oligomer
ggagauguuugagaccuuc

SEQ ID NO: 7886 - RNA, 19 nt, Artificial Sequence
  RNA Oligomer
aggagauguuugagaccuu

SEQ ID NO: 7887 - RNA, 19 nt, Artificial Sequence
  RNA Oligomer
gcaaccacucucacuucau

SEQ ID NO: 7888 - RNA, 19 nt, Artificial Sequence
  RNA Oligomer
agaaggugaaaaaguacgu

SEQ ID NO: 7889 - RNA, 19 nt, Artificial Sequence
  RNA Oligomer
ggccuaugucugugaggaa

SEQ ID NO: 7890 - RNA, 19 nt, Artificial Sequence
  RNA Oligomer
cuuuugaaaacuugcugaa

SEQ ID NO: 7891 - RNA, 19 nt, Artificial Sequence
  RNA Oligomer
gcacaagcagcucaagaac

SEQ ID NO: 7892 - RNA, 19 nt, Artificial Sequence
  RNA Oligomer
accugcagcucuucaucaa

SEQ ID NO: 7893 - RNA, 19 nt, Artificial Sequence
  RNA Oligomer
gcguguauuuuguggaaag

SEQ ID NO: 7894 - RNA, 19 nt, Artificial Sequence
  RNA Oligomer
ucauugugaagcggaugau

SEQ ID NO: 7895 - RNA, 19 nt, Artificial Sequence
  RNA Oligomer
ucaucauugugaagcggau

SEQ ID NO: 7896 - RNA, 19 nt, Artificial Sequence
  RNA Oligomer
cgaagagagagcccagaaa

SEQ ID NO: 7897 - RNA, 19 nt, Artificial Sequence
  RNA Oligomer
gcagaccaaggaaagagga

SEQ ID NO: 7898 - RNA, 19 nt, Artificial Sequence
  RNA Oligomer
ggagcagaccaaggaaaga

SEQ ID NO: 7899 - RNA, 19 nt, Artificial Sequence
  RNA Oligomer
uguccacgauccaguacaa

SEQ ID NO: 7900 - RNA, 19 nt, Artificial Sequence
  RNA Oligomer
aucgaggacaucagcaaua

SEQ ID NO: 7901 - RNA, 19 nt, Artificial Sequence
  RNA Oligomer
agaucgaggacaucagcaa

SEQ ID NO: 7902 - RNA, 19 nt, Artificial Sequence
  RNA Oligomer
ccgacaguuccagcaaaag

SEQ ID NO: 7903 - RNA, 19 nt, Artificial Sequence
  RNA Oligomer
gccuuguacuucagugacu

SEQ ID NO: 7904 - RNA, 19 nt, Artificial Sequence
  RNA Oligomer
ggccaaggacaugaaguuu

SEQ ID NO: 7905 - RNA, 19 nt, Artificial Sequence
  RNA Oligomer
aggccaaggacaugaaguu

SEQ ID NO: 7906 - RNA, 19 nt, Artificial Sequence
  RNA Oligomer
ccauccgugaccuucucau

SEQ ID NO: 7907 - RNA, 19 nt, Artificial Sequence
  RNA Oligomer
cguggauuccugaaaacau

SEQ ID NO: 7908 - RNA, 19 nt, Artificial Sequence
  RNA Oligomer
guucguggauuccugaaaa

SEQ ID NO: 7909 - RNA, 19 nt, Artificial Sequence
  RNA Oligomer
gugagaucuucauggauga

SEQ ID NO: 7910 - RNA, 19 nt, Artificial Sequence
  RNA Oligomer
cuaucucccugauccagca

SEQ ID NO: 7911 - RNA, 19 nt, Artificial Sequence
  RNA Oligomer
cgaguacauacuggaugag

SEQ ID NO: 7912 - RNA, 19 nt, Artificial Sequence
  RNA Oligomer
ucggcaacaaugacaagca

SEQ ID NO: 7913 - RNA, 19 nt, Artificial Sequence
  RNA Oligomer
ugaaaaaguacguccgagu

SEQ ID NO: 7914 - RNA, 19 nt, Artificial Sequence
  RNA Oligomer
gaaggugaaaaaguacguc

SEQ ID NO: 7915 - RNA, 19 nt, Artificial Sequence
  RNA Oligomer
agcucccugucuucauuuu

SEQ ID NO: 7916 - RNA, 19 nt, Artificial Sequence
  RNA Oligomer
gccuaugucugugaggaag

SEQ ID NO: 7917 - RNA, 19 nt, Artificial Sequence
  RNA Oligomer
ggaguuccugaucuaugac

SEQ ID NO: 7918 - RNA, 19 nt, Artificial Sequence
  RNA Oligomer
uccucaucgccauguucaa

SEQ ID NO: 7919 - RNA, 19 nt, Artificial Sequence
  RNA Oligomer
ugcguguauuuuguggaaa

SEQ ID NO: 7920 - RNA, 19 nt, Artificial Sequence
  RNA Oligomer
agaucaucauugugaagcg

SEQ ID NO: 7921 - RNA, 19 nt, Artificial Sequence
  RNA Oligomer
agaagaaagaaugcgugua

SEQ ID NO: 7922 - RNA, 19 nt, Artificial Sequence
  RNA Oligomer
uggaggccaaggacaugaa

SEQ ID NO: 7923 - RNA, 19 nt, Artificial Sequence
  RNA Oligomer
ccuucucauuugggccauu

SEQ ID NO: 7924 - RNA, 19 nt, Artificial Sequence
  RNA Oligomer
ccuugcucuaccuguacga

SEQ ID NO: 7925 - RNA, 19 nt, Artificial Sequence
  RNA Oligomer
gcaguggaagccuucagau

SEQ ID NO: 7926 - RNA, 19 nt, Artificial Sequence
  RNA Oligomer
ccgcagugagaucuucaug

SEQ ID NO: 7927 - RNA, 19 nt, Artificial Sequence
  RNA Oligomer
ccaaaaagauccaagauau

SEQ ID NO: 7928 - RNA, 19 nt, Artificial Sequence
  RNA Oligomer
gucgaguggaccaaaaaga

SEQ ID NO: 7929 - RNA, 19 nt, Artificial Sequence
  RNA Oligomer
cuucacggaaagcaggauu

SEQ ID NO: 7930 - RNA, 19 nt, Artificial Sequence
  RNA Oligomer
cguugcacaccaucgacaa

SEQ ID NO: 7931 - RNA, 19 nt, Artificial Sequence
  RNA Oligomer
caaggaaagaggaggugug

SEQ ID NO: 7932 - RNA, 19 nt, Artificial Sequence
  RNA Oligomer
ggcaacaaugacaagcaag

SEQ ID NO: 7933 - RNA, 19 nt, Artificial Sequence
  RNA Oligomer
ccaagaacuucaacaugaa

SEQ ID NO: 7934 - RNA, 19 nt, Artificial Sequence
  RNA Oligomer
ugucuucauuuuccuaaac

SEQ ID NO: 7935 - RNA, 19 nt, Artificial Sequence
  RNA Oligomer
gcugaacucuaaccugcac

SEQ ID NO: 7936 - RNA, 19 nt, Artificial Sequence
  RNA Oligomer
gucuuuugaaaacuugcug

SEQ ID NO: 7937 - RNA, 19 nt, Artificial Sequence
  RNA Oligomer
acaucagcaauaagguuga

SEQ ID NO: 7938 - RNA, 19 nt, Artificial Sequence
  RNA Oligomer
acaagcuggagaagaacga

SEQ ID NO: 7939 - RNA, 19 nt, Artificial Sequence
  RNA Oligomer
cguguauuuuguggaaagu

SEQ ID NO: 7940 - RNA, 19 nt, Artificial Sequence
  RNA Oligomer
cggaugaugaaggacgucu

SEQ ID NO: 7941 - RNA, 19 nt, Artificial Sequence
  RNA Oligomer
agcggaugaugaaggacgu

SEQ ID NO: 7942 - RNA, 19 nt, Artificial Sequence
  RNA Oligomer
gggcccaagaucaucauug

SEQ ID NO: 7943 - RNA, 19 nt, Artificial Sequence
  RNA Oligomer
ccuuguacuucagugacuu

SEQ ID NO: 7944 - RNA, 19 nt, Artificial Sequence
  RNA Oligomer
guggauuccugaaaacauc

SEQ ID NO: 7945 - RNA, 19 nt, Artificial Sequence
  RNA Oligomer
ccaacaagccugaguuugu

SEQ ID NO: 7946 - RNA, 19 nt, Artificial Sequence
  RNA Oligomer
cagugagaucuucauggau

SEQ ID NO: 7947 - RNA, 19 nt, Artificial Sequence
  RNA Oligomer
cgcagugagaucuucaugg

SEQ ID NO: 7948 - RNA, 19 nt, Artificial Sequence
  RNA Oligomer
agccucaguucguggauuc

SEQ ID NO: 7949 - RNA, 19 nt, Artificial Sequence
  RNA Oligomer
ucgaguggaccaaaaagau

SEQ ID NO: 7950 - RNA, 19 nt, Artificial Sequence
  RNA Oligomer
ccaaggaaagaggaggugu

SEQ ID NO: 7951 - RNA, 19 nt, Artificial Sequence
  RNA Oligomer
ccaggcuggagaaguucau

SEQ ID NO: 7952 - RNA, 19 nt, Artificial Sequence
  RNA Oligomer
gugaaaaaguacguccgag

SEQ ID NO: 7953 - RNA, 19 nt, Artificial Sequence
  RNA Oligomer
ggugaaaaaguacguccga

SEQ ID NO: 7954 - RNA, 19 nt, Artificial Sequence
  RNA Oligomer
ucuucauuuuccuaaaccu

SEQ ID NO: 7955 - RNA, 19 nt, Artificial Sequence
  RNA Oligomer
gucuucauuuuccuaaacc

SEQ ID NO: 7956 - RNA, 19 nt, Artificial Sequence
  RNA Oligomer
ccuucugguuuggugucaa

SEQ ID NO: 7957 - RNA, 19 nt, Artificial Sequence
  RNA Oligomer
gacaaugccuggaucgaga

SEQ ID NO: 7958 - RNA, 19 nt, Artificial Sequence
  RNA Oligomer
acaaaggcuacauggauga

SEQ ID NO: 7959 - RNA, 19 nt, Artificial Sequence
  RNA Oligomer
uggagguguacaaaggcua

SEQ ID NO: 7960 - RNA, 19 nt, Artificial Sequence
  RNA Oligomer
cggcauggagguguacaaa

SEQ ID NO: 7961 - RNA, 19 nt, Artificial Sequence
  RNA Oligomer
agaagaucgaggacaucag

SEQ ID NO: 7962 - RNA, 19 nt, Artificial Sequence
  RNA Oligomer
uccuccuacucugccucua

SEQ ID NO: 7963 - RNA, 19 nt, Artificial Sequence
  RNA Oligomer
gcccaagaucaucauugug

SEQ ID NO: 7964 - RNA, 19 nt, Artificial Sequence
  RNA Oligomer
caagaagaaagaaugcgug

SEQ ID NO: 7965 - RNA, 19 nt, Artificial Sequence
  RNA Oligomer
aguucguggauuccugaaa

SEQ ID NO: 7966 - RNA, 19 nt, Artificial Sequence
  RNA Oligomer
agaucuucauggaugagug

SEQ ID NO: 7967 - RNA, 19 nt, Artificial Sequence
  RNA Oligomer
gagaucuucauggaugagu

SEQ ID NO: 7968 - RNA, 19 nt, Artificial Sequence
  RNA Oligomer
agcguguucuuccaggaga

SEQ ID NO: 7969 - RNA, 19 nt, Artificial Sequence
  RNA Oligomer
ugaucuaccaccucaugac

SEQ ID NO: 7970 - RNA, 19 nt, Artificial Sequence
  RNA Oligomer
caaauaaaguuccugacac

SEQ ID NO: 7971 - RNA, 19 nt, Artificial Sequence
  RNA Oligomer
gcuuuccacaaauaaaguu

SEQ ID NO: 7972 - RNA, 19 nt, Artificial Sequence
  RNA Oligomer
ggagguguacaaaggcuac

SEQ ID NO: 7973 - RNA, 19 nt, Artificial Sequence
  RNA Oligomer
gaaaguuccaaacugucug

SEQ ID NO: 7974 - RNA, 19 nt, Artificial Sequence
  RNA Oligomer
agcacacggaccagauuug

SEQ ID NO: 7975 - RNA, 19 nt, Artificial Sequence
  RNA Oligomer
guguauuuuguggaaaguu

SEQ ID NO: 7976 - RNA, 19 nt, Artificial Sequence
  RNA Oligomer
accacuccuaccucaccau

SEQ ID NO: 7977 - RNA, 19 nt, Artificial Sequence
  RNA Oligomer
agugcgggcugaugaagaa

SEQ ID NO: 7978 - RNA, 19 nt, Artificial Sequence
  RNA Oligomer
guggaagccuucagaucug

SEQ ID NO: 7979 - RNA, 19 nt, Artificial Sequence
  RNA Oligomer
aagccucaguucguggauu

SEQ ID NO: 7980 - RNA, 19 nt, Artificial Sequence
  RNA Oligomer
ggaaagcaggauugucgag

SEQ ID NO: 7981 - RNA, 19 nt, Artificial Sequence
  RNA Oligomer
cggaaagcaggauugucga

SEQ ID NO: 7982 - RNA, 19 nt, Artificial Sequence
  RNA Oligomer
uccaggagauguuugagac

SEQ ID NO: 7983 - RNA, 19 nt, Artificial Sequence
  RNA Oligomer
uguucuuccaggagauguu

SEQ ID NO: 7984 - RNA, 19 nt, Artificial Sequence
  RNA Oligomer
gaaguucauaucggagcag

SEQ ID NO: 7985 - RNA, 19 nt, Artificial Sequence
  RNA Oligomer
ggcuggagaaguucauauc

SEQ ID NO: 7986 - RNA, 19 nt, Artificial Sequence
  RNA Oligomer
acaaugacaagcaagaaag

SEQ ID NO: 7987 - RNA, 19 nt, Artificial Sequence
  RNA Oligomer
ccacucucacuucauccuc

SEQ ID NO: 7988 - RNA, 19 nt, Artificial Sequence
  RNA Oligomer
aacaaugacaagcaagaaa

SEQ ID NO: 7989 - RNA, 19 nt, Artificial Sequence
  RNA Oligomer
acaaggaaggcgagcucau

SEQ ID NO: 7990 - RNA, 19 nt, Artificial Sequence
  RNA Oligomer
aggccuaugucugugagga

SEQ ID NO: 7991 - RNA, 19 nt, Artificial Sequence
  RNA Oligomer
gagguguacaaaggcuaca

SEQ ID NO: 7992 - RNA, 19 nt, Artificial Sequence
  RNA Oligomer
ggcauggagguguacaaag

SEQ ID NO: 7993 - RNA, 19 nt, Artificial Sequence
  RNA Oligomer
gaagagcauaaagaagaug

SEQ ID NO: 7994 - RNA, 19 nt, Artificial Sequence
  RNA Oligomer
cuaugacccacccuuuuac

SEQ ID NO: 7995 - RNA, 19 nt, Artificial Sequence
  RNA Oligomer
acuccuaccucaccaucuu

SEQ ID NO: 7996 - RNA, 19 nt, Artificial Sequence
  RNA Oligomer
ggacgucuucuucuuccuc

SEQ ID NO: 7997 - RNA, 19 nt, Artificial Sequence
  RNA Oligomer
augcguguauuuuguggaa

SEQ ID NO: 7998 - RNA, 19 nt, Artificial Sequence
  RNA Oligomer
gcucuucuaugacccugac

SEQ ID NO: 7999 - RNA, 19 nt, Artificial Sequence
  RNA Oligomer
uccucuccuacuucgccuu

SEQ ID NO: 8000 - RNA, 19 nt, Artificial Sequence
  RNA Oligomer
ugagcguguucuuccagga

SEQ ID NO: 8001 - RNA, 19 nt, Artificial Sequence
  RNA Oligomer
agaaguucauaucggagca

SEQ ID NO: 8002 - RNA, 19 nt, Artificial Sequence
  RNA Oligomer
aggcuggagaaguucauau

SEQ ID NO: 8003 - RNA, 19 nt, Artificial Sequence
  RNA Oligomer
accacucucacuucauccu

SEQ ID NO: 8004 - RNA, 19 nt, Artificial Sequence
  RNA Oligomer
caaagaaacauguccagga

SEQ ID NO: 8005 - RNA, 19 nt, Artificial Sequence
  RNA Oligomer
gguuuggugucaacagcuc

SEQ ID NO: 8006 - RNA, 19 nt, Artificial Sequence
  RNA Oligomer
gggacccaaagaaacaugu

SEQ ID NO: 8007 - RNA, 19 nt, Artificial Sequence
  RNA Oligomer
cugaacaggcugaacucua

SEQ ID NO: 8008 - RNA, 19 nt, Artificial Sequence
  RNA Oligomer
uccaaacugucugaugcug

SEQ ID NO: 8009 - RNA, 19 nt, Artificial Sequence
  RNA Oligomer
ccauguucaacuacaccuu

SEQ ID NO: 8010 - RNA, 19 nt, Artificial Sequence
  RNA Oligomer
ucuaccugcucuucaccaa

SEQ ID NO: 8011 - RNA, 19 nt, Artificial Sequence
  RNA Oligomer
gacgucuucuucuuccucu

SEQ ID NO: 8012 - RNA, 19 nt, Artificial Sequence
  RNA Oligomer
uggaugaguggcaguggaa

SEQ ID NO: 8013 - RNA, 19 nt, Artificial Sequence
  RNA Oligomer
cugagccagaaggugaaaa

SEQ ID NO: 8014 - RNA, 19 nt, Artificial Sequence
  RNA Oligomer
cacaaauaaaguuccugac

SEQ ID NO: 8015 - RNA, 19 nt, Artificial Sequence
  RNA Oligomer
uguauuuuguggaaaguuc

SEQ ID NO: 8016 - RNA, 19 nt, Artificial Sequence
  RNA Oligomer
aggaguuugucaccuggga

SEQ ID NO: 8017 - RNA, 19 nt, Artificial Sequence
  RNA Oligomer
ggaagccuucagaucugca

SEQ ID NO: 8018 - RNA, 19 nt, Artificial Sequence
  RNA Oligomer
accaaaaagauccaagaua

SEQ ID NO: 8019 - RNA, 19 nt, Artificial Sequence
  RNA Oligomer
ggagaaguucauaucggag

SEQ ID NO: 8020 - RNA, 19 nt, Artificial Sequence
  RNA Oligomer
uggagaaguucauaucgga

SEQ ID NO: 8021 - RNA, 19 nt, Artificial Sequence
  RNA Oligomer
gugggacccaaagaaacau

SEQ ID NO: 8022 - RNA, 19 nt, Artificial Sequence
  RNA Oligomer
gugugucaguguggcuaca

SEQ ID NO: 8023 - RNA, 19 nt, Artificial Sequence
  RNA Oligomer
gcaauaagguugacgccau

SEQ ID NO: 8024 - RNA, 19 nt, Artificial Sequence
  RNA Oligomer
ucaucgccauguucaacua

SEQ ID NO: 8025 - RNA, 19 nt, Artificial Sequence
  RNA Oligomer
gucuaccacuccuaccuca

SEQ ID NO: 8026 - RNA, 19 nt, Artificial Sequence
  RNA Oligomer
acgaagagagagcccagaa

SEQ ID NO: 8027 - RNA, 19 nt, Artificial Sequence
  RNA Oligomer
ccgugaccuucucauuugg

SEQ ID NO: 8028 - RNA, 19 nt, Artificial Sequence
  RNA Oligomer
gaagccuucagaucugcac

SEQ ID NO: 8029 - RNA, 19 nt, Artificial Sequence
  RNA Oligomer
acccaaagaaacaugucca

SEQ ID NO: 8030 - RNA, 19 nt, Artificial Sequence
  RNA Oligomer
agcagaagaucgaggacau

SEQ ID NO: 8031 - RNA, 19 nt, Artificial Sequence
  RNA Oligomer
cggaccagauuuggaaguu

SEQ ID NO: 8032 - RNA, 19 nt, Artificial Sequence
  RNA Oligomer
gcagcugaaggaguuuguc

SEQ ID NO: 8033 - RNA, 19 nt, Artificial Sequence
  RNA Oligomer
ugcagcugaaggaguuugu

SEQ ID NO: 8034 - RNA, 19 nt, Artificial Sequence
  RNA Oligomer
gagguguggccaucaagau

SEQ ID NO: 8035 - RNA, 19 nt, Artificial Sequence
  RNA Oligomer
gggccaagaacuucaacau

SEQ ID NO: 8036 - RNA, 19 nt, Artificial Sequence
  RNA Oligomer
ccugagccagaaggugaaa

SEQ ID NO: 8037 - RNA, 19 nt, Artificial Sequence
  RNA Oligomer
gccugaaguucuccucgau

SEQ ID NO: 8038 - RNA, 19 nt, Artificial Sequence
  RNA Oligomer
ugggacccaaagaaacaug

SEQ ID NO: 8039 - RNA, 19 nt, Artificial Sequence
  RNA Oligomer
gccgucuuuugaaaacuug

SEQ ID NO: 8040 - RNA, 19 nt, Artificial Sequence
  RNA Oligomer
gccauguucaacuacaccu

SEQ ID NO: 8041 - RNA, 19 nt, Artificial Sequence
  RNA Oligomer
uccggcucaugcacauuuu

SEQ ID NO: 8042 - RNA, 19 nt, Artificial Sequence
  RNA Oligomer
agauguuugagaccuucac

SEQ ID NO: 8043 - RNA, 19 nt, Artificial Sequence
  RNA Oligomer
gcgugaucuaccaccucau

SEQ ID NO: 8044 - RNA, 19 nt, Artificial Sequence
  RNA Oligomer
ggccgucuuuugaaaacuu

SEQ ID NO: 8045 - RNA, 19 nt, Artificial Sequence
  RNA Oligomer
ccaacauccugcugcucaa

SEQ ID NO: 8046 - RNA, 19 nt, Artificial Sequence
  RNA Oligomer
ggauugucgaguggaccaa

SEQ ID NO: 8047 - RNA, 19 nt, Artificial Sequence
  RNA Oligomer
ugagccagaaggugaaaaa

SEQ ID NO: 8048 - RNA, 19 nt, Artificial Sequence
  RNA Oligomer
gcagaagaucgaggacauc

SEQ ID NO: 8049 - RNA, 19 nt, Artificial Sequence
  RNA Oligomer
gaaccgacaguuccagcaa

SEQ ID NO: 8050 - RNA, 19 nt, Artificial Sequence
  RNA Oligomer
cuccggcucaugcacauuu

SEQ ID NO: 8051 - RNA, 19 nt, Artificial Sequence
  RNA Oligomer
acaucaagaagaaagaaug

SEQ ID NO: 8052 - RNA, 19 nt, Artificial Sequence
  RNA Oligomer
gaaaacaucaagaagaaag

SEQ ID NO: 8053 - RNA, 19 nt, Artificial Sequence
  RNA Oligomer
ugcucuaccuguacgagaa

SEQ ID NO: 8054 - RNA, 19 nt, Artificial Sequence
  RNA Oligomer
cugaguuugugaagcucuu

SEQ ID NO: 8055 - RNA, 19 nt, Artificial Sequence
  RNA Oligomer
ccacuuccaggaccagaau

SEQ ID NO: 8056 - RNA, 19 nt, Artificial Sequence
  RNA Oligomer
gcacuggccgucuuuugaa

SEQ ID NO: 8057 - RNA, 19 nt, Artificial Sequence
  RNA Oligomer
accgacaguuccagcaaaa

SEQ ID NO: 8058 - RNA, 19 nt, Artificial Sequence
  RNA Oligomer
acgucuucuucuuccucuu

SEQ ID NO: 8059 - RNA, 19 nt, Artificial Sequence
  RNA Oligomer
ucaagaagaaagaaugcgu

SEQ ID NO: 8060 - RNA, 19 nt, Artificial Sequence
  RNA Oligomer
caaaaagauccaagauauc

SEQ ID NO: 8061 - RNA, 19 nt, Artificial Sequence
  RNA Oligomer
ugaccugccuagacagcaa

SEQ ID NO: 8062 - RNA, 19 nt, Artificial Sequence
  RNA Oligomer
cgcggcugaagagcauuuu

SEQ ID NO: 8063 - RNA, 19 nt, Artificial Sequence
  RNA Oligomer
cacuggccgucuuuugaaa

SEQ ID NO: 8064 - RNA, 19 nt, Artificial Sequence
  RNA Oligomer
gagcagaagaucgaggaca

SEQ ID NO: 8065 - RNA, 19 nt, Artificial Sequence
  RNA Oligomer
ucaccaacauccugcugcu

SEQ ID NO: 8066 - RNA, 19 nt, Artificial Sequence
  RNA Oligomer
gcgcaaucuugcucuucgu

SEQ ID NO: 8067 - RNA, 19 nt, Artificial Sequence
  RNA Oligomer
ggauuccugaaaacaucaa

SEQ ID NO: 8068 - RNA, 19 nt, Artificial Sequence
  RNA Oligomer
acguggauguggccaucuu

SEQ ID NO: 8069 - RNA, 19 nt, Artificial Sequence
  RNA Oligomer
acauggaugacccgaggaa

SEQ ID NO: 8070 - RNA, 19 nt, Artificial Sequence
  RNA Oligomer
gguguacaaaggcuacaug

SEQ ID NO: 8071 - RNA, 19 nt, Artificial Sequence
  RNA Oligomer
ucugcaggaagagcauaaa

SEQ ID NO: 8072 - RNA, 19 nt, Artificial Sequence
  RNA Oligomer
ccaguacaacgugguggau

SEQ ID NO: 8073 - RNA, 19 nt, Artificial Sequence
  RNA Oligomer
gugugaacuucaacccgga

SEQ ID NO: 8074 - RNA, 19 nt, Artificial Sequence
  RNA Oligomer
ccauccucauccacaacga

SEQ ID NO: 8075 - RNA, 19 nt, Artificial Sequence
  RNA Oligomer
ugaugaaggacgucuucuu

SEQ ID NO: 8076 - RNA, 19 nt, Artificial Sequence
  RNA Oligomer
ggacaucacuaucucccug

SEQ ID NO: 8077 - RNA, 19 nt, Artificial Sequence
  RNA Oligomer
acacggacaaugccuggau

SEQ ID NO: 8078 - RNA, 19 nt, Artificial Sequence
  RNA Oligomer
cgauccaguacaacguggu

SEQ ID NO: 8079 - RNA, 19 nt, Artificial Sequence
  RNA Oligomer
gacggaguuccugaucuau

SEQ ID NO: 8080 - RNA, 19 nt, Artificial Sequence
  RNA Oligomer
caauaagguugacgccaug

SEQ ID NO: 8081 - RNA, 19 nt, Artificial Sequence
  RNA Oligomer
accuccagaaccgacaguu

SEQ ID NO: 8082 - RNA, 19 nt, Artificial Sequence
  RNA Oligomer
aggagaacuaccuccagaa

SEQ ID NO: 8083 - RNA, 19 nt, Artificial Sequence
  RNA Oligomer
acggaccagauuuggaagu

SEQ ID NO: 8084 - RNA, 19 nt, Artificial Sequence
  RNA Oligomer
ucgccauguucaacuacac

SEQ ID NO: 8085 - RNA, 19 nt, Artificial Sequence
  RNA Oligomer
cucaugcacauuuuuacca

SEQ ID NO: 8086 - RNA, 19 nt, Artificial Sequence
  RNA Oligomer
ccggcucaugcacauuuuu

SEQ ID NO: 8087 - RNA, 19 nt, Artificial Sequence
  RNA Oligomer
gaagaaggcagccuuguac

SEQ ID NO: 8088 - RNA, 19 nt, Artificial Sequence
  RNA Oligomer
ugaugaagaaggcagccuu

SEQ ID NO: 8089 - RNA, 19 nt, Artificial Sequence
  RNA Oligomer
ccaucuaccucuggcucuu

SEQ ID NO: 8090 - RNA, 19 nt, Artificial Sequence
  RNA Oligomer
cgaugacagcugcacucau

SEQ ID NO: 8091 - RNA, 19 nt, Artificial Sequence
  RNA Oligomer
ggaccaaaaagauccaaga

SEQ ID NO: 8092 - RNA, 19 nt, Artificial Sequence
  RNA Oligomer
cccugauccagcagaaacu

SEQ ID NO: 8093 - RNA, 19 nt, Artificial Sequence
  RNA Oligomer
cgccgaguacauacuggau

SEQ ID NO: 8094 - RNA, 19 nt, Artificial Sequence
  RNA Oligomer
gaagagcauuuuccgcaga

SEQ ID NO: 8095 - RNA, 19 nt, Artificial Sequence
  RNA Oligomer
ccagaaggugaaaaaguac

SEQ ID NO: 8096 - RNA, 19 nt, Artificial Sequence
  RNA Oligomer
ccuuuggcgacaucgucuu

SEQ ID NO: 8097 - RNA, 19 nt, Artificial Sequence
  RNA Oligomer
gucuuccaccugacccaaa

SEQ ID NO: 8098 - RNA, 19 nt, Artificial Sequence
  RNA Oligomer
ggaacgugguaaaacccaa

SEQ ID NO: 8099 - RNA, 19 nt, Artificial Sequence
  RNA Oligomer
uccacuuccaggaccagaa

SEQ ID NO: 8100 - RNA, 19 nt, Artificial Sequence
  RNA Oligomer
uggugugucaguguggcua

SEQ ID NO: 8101 - RNA, 19 nt, Artificial Sequence
  RNA Oligomer
aaccgacaguuccagcaaa

SEQ ID NO: 8102 - RNA, 19 nt, Artificial Sequence
  RNA Oligomer
ggagaacuaccuccagaac

SEQ ID NO: 8103 - RNA, 19 nt, Artificial Sequence
  RNA Oligomer
agaggcacaagcagcucaa

SEQ ID NO: 8104 - RNA, 19 nt, Artificial Sequence
  RNA Oligomer
agccucuucaagagcugga

SEQ ID NO: 8105 - RNA, 19 nt, Artificial Sequence
  RNA Oligomer
acauccugcugcucaaccu

SEQ ID NO: 8106 - RNA, 19 nt, Artificial Sequence
  RNA Oligomer
ugcacauuuuuaccaucag

SEQ ID NO: 8107 - RNA, 19 nt, Artificial Sequence
  RNA Oligomer
cggcucaugcacauuuuua

SEQ ID NO: 8108 - RNA, 19 nt, Artificial Sequence
  RNA Oligomer
ucggcgcaaucuugcucuu

SEQ ID NO: 8109 - RNA, 19 nt, Artificial Sequence
  RNA Oligomer
uggucuuccaccugaacau

SEQ ID NO: 8110 - RNA, 19 nt, Artificial Sequence
  RNA Oligomer
gcagcaagauccugaagga

SEQ ID NO: 8111 - RNA, 19 nt, Artificial Sequence
  RNA Oligomer
acggagccaagaccacuuu

SEQ ID NO: 8112 - RNA, 19 nt, Artificial Sequence
  RNA Oligomer
ccuucacggaaagcaggau

SEQ ID NO: 8113 - RNA, 19 nt, Artificial Sequence
  RNA Oligomer
ucggagcagaccaaggaaa

SEQ ID NO: 8114 - RNA, 19 nt, Artificial Sequence
  RNA Oligomer
ucauaucggagcagaccaa

SEQ ID NO: 8115 - RNA, 19 nt, Artificial Sequence
  RNA Oligomer
ugccugaaguucuccucga

SEQ ID NO: 8116 - RNA, 19 nt, Artificial Sequence
  RNA Oligomer
cgugguaaaacccaagaca

SEQ ID NO: 8117 - RNA, 19 nt, Artificial Sequence
  RNA Oligomer
cacagugggacccaaagaa

SEQ ID NO: 8118 - RNA, 19 nt, Artificial Sequence
  RNA Oligomer
ugaucuaugacccacccuu

SEQ ID NO: 8119 - RNA, 19 nt, Artificial Sequence
  RNA Oligomer
ugcuauccugggagaucua

SEQ ID NO: 8120 - RNA, 19 nt, Artificial Sequence
  RNA Oligomer
augaccugaucgaggagua

SEQ ID NO: 8121 - RNA, 19 nt, Artificial Sequence
  RNA Oligomer
cucaucgccauguucaacu

SEQ ID NO: 8122 - RNA, 19 nt, Artificial Sequence
  RNA Oligomer
accugcucuucaccaacau

SEQ ID NO: 8123 - RNA, 19 nt, Artificial Sequence
  RNA Oligomer
cgucuucuucuuccucuuc

SEQ ID NO: 8124 - RNA, 19 nt, Artificial Sequence
  RNA Oligomer
cucuggacuucauccuguu

SEQ ID NO: 8125 - RNA, 19 nt, Artificial Sequence
  RNA Oligomer
ucauccucucucuggacuu

SEQ ID NO: 8126 - RNA, 19 nt, Artificial Sequence
  RNA Oligomer
acagcagccucuucaagag

SEQ ID NO: 8127 - RNA, 19 nt, Artificial Sequence
  RNA Oligomer
gcagccuuguacuucagug

SEQ ID NO: 8128 - RNA, 19 nt, Artificial Sequence
  RNA Oligomer
ggaaucaucugggcucaga

SEQ ID NO: 8129 - RNA, 19 nt, Artificial Sequence
  RNA Oligomer
gccaugugaccuucaccau

SEQ ID NO: 8130 - RNA, 19 nt, Artificial Sequence
  RNA Oligomer
gcugcacucaucuccaaca

SEQ ID NO: 8131 - RNA, 19 nt, Artificial Sequence
  RNA Oligomer
agcagaaacugagcguguu

SEQ ID NO: 8132 - RNA, 19 nt, Artificial Sequence
  RNA Oligomer
ucucccugauccagcagaa

SEQ ID NO: 8133 - RNA, 19 nt, Artificial Sequence
  RNA Oligomer
gacaucacuaucucccuga

SEQ ID NO: 8134 - RNA, 19 nt, Artificial Sequence
  RNA Oligomer
ccugucucggacaucacua

SEQ ID NO: 8135 - RNA, 19 nt, Artificial Sequence
  RNA Oligomer
acagcaaccacucucacuu

SEQ ID NO: 8136 - RNA, 19 nt, Artificial Sequence
  RNA Oligomer
ccuucggcaacaaugacaa

SEQ ID NO: 8137 - RNA, 19 nt, Artificial Sequence
  RNA Oligomer
cccuucggcaacaaugaca

SEQ ID NO: 8138 - RNA, 19 nt, Artificial Sequence
  RNA Oligomer
acgugguaaaacccaagac

SEQ ID NO: 8139 - RNA, 19 nt, Artificial Sequence
  RNA Oligomer
gaacgugguaaaacccaag

SEQ ID NO: 8140 - RNA, 19 nt, Artificial Sequence
  RNA Oligomer
cucaggccuaugucuguga

SEQ ID NO: 8141 - RNA, 19 nt, Artificial Sequence
  RNA Oligomer
gcuccaguccauagacguu

SEQ ID NO: 8142 - RNA, 19 nt, Artificial Sequence
  RNA Oligomer
gcaucccacucuaugcgaa

SEQ ID NO: 8143 - RNA, 19 nt, Artificial Sequence
  RNA Oligomer
agguguacaaaggcuacau

SEQ ID NO: 8144 - RNA, 19 nt, Artificial Sequence
  RNA Oligomer
cgucuuuugaaaacuugcu

SEQ ID NO: 8145 - RNA, 19 nt, Artificial Sequence
  RNA Oligomer
uccaguacaacguggugga

SEQ ID NO: 8146 - RNA, 19 nt, Artificial Sequence
  RNA Oligomer
ucuaccugaaggagaacua

SEQ ID NO: 8147 - RNA, 19 nt, Artificial Sequence
  RNA Oligomer
cugcuauccugggagaucu

SEQ ID NO: 8148 - RNA, 19 nt, Artificial Sequence
  RNA Oligomer
agcucuucaucaagagggu

SEQ ID NO: 8149 - RNA, 19 nt, Artificial Sequence
  RNA Oligomer
ucaaccuccucaucgccau

SEQ ID NO: 8150 - RNA, 19 nt, Artificial Sequence
  RNA Oligomer
ugaacuucaacccggagca

SEQ ID NO: 8151 - RNA, 19 nt, Artificial Sequence
  RNA Oligomer
agcagccucuucaagagcu

SEQ ID NO: 8152 - RNA, 19 nt, Artificial Sequence
  RNA Oligomer
ggcucaugcacauuuuuac

SEQ ID NO: 8153 - RNA, 19 nt, Artificial Sequence
  RNA Oligomer
agaaggcagccuuguacuu

SEQ ID NO: 8154 - RNA, 19 nt, Artificial Sequence
  RNA Oligomer
ugguggucuuccaccugaa

SEQ ID NO: 8155 - RNA, 19 nt, Artificial Sequence
  RNA Oligomer
acuucacgcagccgcuuua

SEQ ID NO: 8156 - RNA, 19 nt, Artificial Sequence
  RNA Oligomer
ugaaggaguuugucaccug

SEQ ID NO: 8157 - RNA, 19 nt, Artificial Sequence
  RNA Oligomer
gccugaguuugugaagcuc

SEQ ID NO: 8158 - RNA, 19 nt, Artificial Sequence
  RNA Oligomer
guggaccaaaaagauccaa

SEQ ID NO: 8159 - RNA, 19 nt, Artificial Sequence
  RNA Oligomer
cucccugauccagcagaaa

SEQ ID NO: 8160 - RNA, 19 nt, Artificial Sequence
  RNA Oligomer
agcaacagcagccucuuca

SEQ ID NO: 8161 - RNA, 19 nt, Artificial Sequence
  RNA Oligomer
cggacaucacuaucucccu

SEQ ID NO: 8162 - RNA, 19 nt, Artificial Sequence
  RNA Oligomer
cugucucggacaucacuau

SEQ ID NO: 8163 - RNA, 19 nt, Artificial Sequence
  RNA Oligomer
ccgaguacauacuggauga

SEQ ID NO: 8164 - RNA, 19 nt, Artificial Sequence
  RNA Oligomer
ugaagagcauuuuccgcag

SEQ ID NO: 8165 - RNA, 19 nt, Artificial Sequence
  RNA Oligomer
cugucaggauaaacuccgu

SEQ ID NO: 8166 - RNA, 19 nt, Artificial Sequence
  RNA Oligomer
acagugggacccaaagaaa

SEQ ID NO: 8167 - RNA, 19 nt, Artificial Sequence
  RNA Oligomer
uggagcugaacaggcugaa

SEQ ID NO: 8168 - RNA, 19 nt, Artificial Sequence
  RNA Oligomer
aggaccagaaugacgugga

SEQ ID NO: 8169 - RNA, 19 nt, Artificial Sequence
  RNA Oligomer
ccaucugcaggaagagcau

SEQ ID NO: 8170 - RNA, 19 nt, Artificial Sequence
  RNA Oligomer
accugaaggagaacuaccu

SEQ ID NO: 8171 - RNA, 19 nt, Artificial Sequence
  RNA Oligomer
cugcagcucuucaucaaga

SEQ ID NO: 8172 - RNA, 19 nt, Artificial Sequence
  RNA Oligomer
ucaccaucuucgggcagau

SEQ ID NO: 8173 - RNA, 19 nt, Artificial Sequence
  RNA Oligomer
ugaaggacgucuucuucuu

SEQ ID NO: 8174 - RNA, 19 nt, Artificial Sequence
  RNA Oligomer
uccucucucuggacuucau

SEQ ID NO: 8175 - RNA, 19 nt, Artificial Sequence
  RNA Oligomer
ggacaugaaguuugugucu

SEQ ID NO: 8176 - RNA, 19 nt, Artificial Sequence
  RNA Oligomer
ggugcagcugaaggaguuu

SEQ ID NO: 8177 - RNA, 19 nt, Artificial Sequence
  RNA Oligomer
agccugaguuugugaagcu

SEQ ID NO: 8178 - RNA, 19 nt, Artificial Sequence
  RNA Oligomer
gaccaaaaagauccaagau

SEQ ID NO: 8179 - RNA, 19 nt, Artificial Sequence
  RNA Oligomer
cgaguggaccaaaaagauc

SEQ ID NO: 8180 - RNA, 19 nt, Artificial Sequence
  RNA Oligomer
gcagaaacugagcguguuc

SEQ ID NO: 8181 - RNA, 19 nt, Artificial Sequence
  RNA Oligomer
gucucggacaucacuaucu

SEQ ID NO: 8182 - RNA, 19 nt, Artificial Sequence
  RNA Oligomer
gccgaguacauacuggaug

SEQ ID NO: 8183 - RNA, 19 nt, Artificial Sequence
  RNA Oligomer
cggcugaagagcauuuucc

SEQ ID NO: 8184 - RNA, 19 nt, Artificial Sequence
  RNA Oligomer
gcggcugaagagcauuuuc

SEQ ID NO: 8185 - RNA, 19 nt, Artificial Sequence
  RNA Oligomer
ggccaagaacuucaacaug

SEQ ID NO: 8186 - RNA, 19 nt, Artificial Sequence
  RNA Oligomer
ccaaucucuugaucucggu

SEQ ID NO: 8187 - RNA, 19 nt, Artificial Sequence
  RNA Oligomer
gccagaaggugaaaaagua

SEQ ID NO: 8188 - RNA, 19 nt, Artificial Sequence
  RNA Oligomer
ccacaaauaaaguuccuga

SEQ ID NO: 8189 - RNA, 19 nt, Artificial Sequence
  RNA Oligomer
acaggcugaacucuaaccu

SEQ ID NO: 8190 - RNA, 19 nt, Artificial Sequence
  RNA Oligomer
acacgcaugagcagcacuu

SEQ ID NO: 8191 - RNA, 19 nt, Artificial Sequence
  RNA Oligomer
uggccgucuuuugaaaacu

SEQ ID NO: 8192 - RNA, 19 nt, Artificial Sequence
  RNA Oligomer
agagcauaaagaagaugcu

SEQ ID NO: 8193 - RNA, 19 nt, Artificial Sequence
  RNA Oligomer
gcagcucaagaacaagcug

SEQ ID NO: 8194 - RNA, 19 nt, Artificial Sequence
  RNA Oligomer
ugcagcucuucaucaagag

SEQ ID NO: 8195 - RNA, 19 nt, Artificial Sequence
  RNA Oligomer
accugaucgaggaguacca

SEQ ID NO: 8196 - RNA, 19 nt, Artificial Sequence
  RNA Oligomer
ccagauuuggaaguuccag

SEQ ID NO: 8197 - RNA, 19 nt, Artificial Sequence
  RNA Oligomer
ucaugcacauuuuuaccau

SEQ ID NO: 8198 - RNA, 19 nt, Artificial Sequence
  RNA Oligomer
ggcagccuuguacuucagu

SEQ ID NO: 8199 - RNA, 19 nt, Artificial Sequence
  RNA Oligomer
aggcagccuuguacuucag

SEQ ID NO: 8200 - RNA, 19 nt, Artificial Sequence
  RNA Oligomer
acgucaagcucaacgugca

SEQ ID NO: 8201 - RNA, 19 nt, Artificial Sequence
  RNA Oligomer
ugaagcucuuccuggagaa

SEQ ID NO: 8202 - RNA, 19 nt, Artificial Sequence
  RNA Oligomer
acaagccugaguuugugaa

SEQ ID NO: 8203 - RNA, 19 nt, Artificial Sequence
  RNA Oligomer
cuccaacaagccugaguuu

SEQ ID NO: 8204 - RNA, 19 nt, Artificial Sequence
  RNA Oligomer
agaaacugagcguguucuu

SEQ ID NO: 8205 - RNA, 19 nt, Artificial Sequence
  RNA Oligomer
cuagacagcaaccacucuc

SEQ ID NO: 8206 - RNA, 19 nt, Artificial Sequence
  RNA Oligomer
ugguaaaacccaagacauu

SEQ ID NO: 8207 - RNA, 19 nt, Artificial Sequence
  RNA Oligomer
uccugacugucaggauaaa

SEQ ID NO: 8208 - RNA, 19 nt, Artificial Sequence
  RNA Oligomer
ggcugaacucuaaccugca

SEQ ID NO: 8209 - RNA, 19 nt, Artificial Sequence
  RNA Oligomer
ucaguguggcuacacgcau

SEQ ID NO: 8210 - RNA, 19 nt, Artificial Sequence
  RNA Oligomer
cuggccgucuuuugaaaac

SEQ ID NO: 8211 - RNA, 19 nt, Artificial Sequence
  RNA Oligomer
ugcaggaagagcauaaaga

SEQ ID NO: 8212 - RNA, 19 nt, Artificial Sequence
  RNA Oligomer
cuguccacgauccaguaca

SEQ ID NO: 8213 - RNA, 19 nt, Artificial Sequence
  RNA Oligomer
gacaguuccagcaaaagca

SEQ ID NO: 8214 - RNA, 19 nt, Artificial Sequence
  RNA Oligomer
ugaaggagaacuaccucca

SEQ ID NO: 8215 - RNA, 19 nt, Artificial Sequence
  RNA Oligomer
ggagaucuaccugaaggag

SEQ ID NO: 8216 - RNA, 19 nt, Artificial Sequence
  RNA Oligomer
ggaaaguuccaaacugucu

SEQ ID NO: 8217 - RNA, 19 nt, Artificial Sequence
  RNA Oligomer
cuggacuucauccuguucu

SEQ ID NO: 8218 - RNA, 19 nt, Artificial Sequence
  RNA Oligomer
acuucagugacuucuggaa

SEQ ID NO: 8219 - RNA, 19 nt, Artificial Sequence
  RNA Oligomer
ccugaaaacaucaagaaga

SEQ ID NO: 8220 - RNA, 19 nt, Artificial Sequence
  RNA Oligomer
uuccugaaaacaucaagaa

SEQ ID NO: 8221 - RNA, 19 nt, Artificial Sequence
  RNA Oligomer
accuucucauuugggccau

SEQ ID NO: 8222 - RNA, 19 nt, Artificial Sequence
  RNA Oligomer
ucuccaacaagccugaguu

SEQ ID NO: 8223 - RNA, 19 nt, Artificial Sequence
  RNA Oligomer
caggagauguuugagaccu

SEQ ID NO: 8224 - RNA, 19 nt, Artificial Sequence
  RNA Oligomer
agcaaccacucucacuuca

SEQ ID NO: 8225 - RNA, 19 nt, Artificial Sequence
  RNA Oligomer
ugccuagacagcaaccacu

SEQ ID NO: 8226 - RNA, 19 nt, Artificial Sequence
  RNA Oligomer
agcgugaucuaccaccuca

SEQ ID NO: 8227 - RNA, 19 nt, Artificial Sequence
  RNA Oligomer
cagcucccugucuucauuu

SEQ ID NO: 8228 - RNA, 19 nt, Artificial Sequence
  RNA Oligomer
cccaaagaaacauguccag

SEQ ID NO: 8229 - RNA, 19 nt, Artificial Sequence
  RNA Oligomer
gugguaaaacccaagacau

SEQ ID NO: 8230 - RNA, 19 nt, Artificial Sequence
  RNA Oligomer
caagagggccuccauguuu

SEQ ID NO: 8231 - RNA, 19 nt, Artificial Sequence
  RNA Oligomer
ucaggccuaugucugugag

SEQ ID NO: 8232 - RNA, 19 nt, Artificial Sequence
  RNA Oligomer
ccacucuaugcgaaccaca

SEQ ID NO: 8233 - RNA, 19 nt, Artificial Sequence
  RNA Oligomer
accagaaugacguggagcu

SEQ ID NO: 8234 - RNA, 19 nt, Artificial Sequence
  RNA Oligomer
agcucaagaacaagcugga

SEQ ID NO: 8235 - RNA, 19 nt, Artificial Sequence
  RNA Oligomer
ugcugcucaaccuccucau

SEQ ID NO: 8236 - RNA, 19 nt, Artificial Sequence
  RNA Oligomer
ucugccucuaccugcucuu

SEQ ID NO: 8237 - RNA, 19 nt, Artificial Sequence
  RNA Oligomer
gacaugaaguuugugucuc

SEQ ID NO: 8238 - RNA, 19 nt, Artificial Sequence
  RNA Oligomer
aggacaugaaguuuguguc

SEQ ID NO: 8239 - RNA, 19 nt, Artificial Sequence
  RNA Oligomer
ucccucuacaagcguuccu

SEQ ID NO: 8240 - RNA, 19 nt, Artificial Sequence
  RNA Oligomer
gaguuugucaccugggaca

SEQ ID NO: 8241 - RNA, 19 nt, Artificial Sequence
  RNA Oligomer
caacaagccugaguuugug

SEQ ID NO: 8242 - RNA, 19 nt, Artificial Sequence
  RNA Oligomer
ucaucuccaacaagccuga

SEQ ID NO: 8243 - RNA, 19 nt, Artificial Sequence
  RNA Oligomer
cucaguucguggauuccug

SEQ ID NO: 8244 - RNA, 19 nt, Artificial Sequence
  RNA Oligomer
uggaccaaaaagauccaag

SEQ ID NO: 8245 - RNA, 19 nt, Artificial Sequence
  RNA Oligomer
cagaaacugagcguguucu

SEQ ID NO: 8246 - RNA, 19 nt, Artificial Sequence
  RNA Oligomer
agauuccucugaggaccag

SEQ ID NO: 8247 - RNA, 19 nt, Artificial Sequence
  RNA Oligomer
ucugugcuuuccacaaaua

SEQ ID NO: 8248 - RNA, 19 nt, Artificial Sequence
  RNA Oligomer
cuucugugcuuuccacaaa

SEQ ID NO: 8249 - RNA, 19 nt, Artificial Sequence
  RNA Oligomer
ucauuggccugaggcaagu

SEQ ID NO: 8250 - RNA, 19 nt, Artificial Sequence
  RNA Oligomer
acaggcuacucagagcuga

SEQ ID NO: 8251 - RNA, 19 nt, Artificial Sequence
  RNA Oligomer
ucccacucuaugcgaacca

SEQ ID NO: 8252 - RNA, 19 nt, Artificial Sequence
  RNA Oligomer
cccuuuuacacggcagaga

SEQ ID NO: 8253 - RNA, 19 nt, Artificial Sequence
  RNA Oligomer
aggacgucuucuucuuccu

SEQ ID NO: 8254 - RNA, 19 nt, Artificial Sequence
  RNA Oligomer
gucauccucucucuggacu

SEQ ID NO: 8255 - RNA, 19 nt, Artificial Sequence
  RNA Oligomer
cgcaaucuugcucuucgug

SEQ ID NO: 8256 - RNA, 19 nt, Artificial Sequence
  RNA Oligomer
cucaucuccuucagggaga

SEQ ID NO: 8257 - RNA, 19 nt, Artificial Sequence
  RNA Oligomer
accacuuuggccacgagaa

SEQ ID NO: 8258 - RNA, 19 nt, Artificial Sequence
  RNA Oligomer
gugcuuuccacaaauaaag

SEQ ID NO: 8259 - RNA, 19 nt, Artificial Sequence
  RNA Oligomer
cugugcuuuccacaaauaa

SEQ ID NO: 8260 - RNA, 19 nt, Artificial Sequence
  RNA Oligomer
gggaacgugguaaaaccca

SEQ ID NO: 8261 - RNA, 19 nt, Artificial Sequence
  RNA Oligomer
cugacugucaggauaaacu

SEQ ID NO: 8262 - RNA, 19 nt, Artificial Sequence
  RNA Oligomer
cauccaccauggaggucau

SEQ ID NO: 8263 - RNA, 19 nt, Artificial Sequence
  RNA Oligomer
cacucuaugcgaaccacaa

SEQ ID NO: 8264 - RNA, 19 nt, Artificial Sequence
  RNA Oligomer
augcacauuuuuaccauca

SEQ ID NO: 8265 - RNA, 19 nt, Artificial Sequence
  RNA Oligomer
ugaagaaggcagccuugua

SEQ ID NO: 8266 - RNA, 19 nt, Artificial Sequence
  RNA Oligomer
uccugaaggaacuguccaa

SEQ ID NO: 8267 - RNA, 19 nt, Artificial Sequence
  RNA Oligomer
cccaaucucuugaucucgg

SEQ ID NO: 8268 - RNA, 19 nt, Artificial Sequence
  RNA Oligomer
uucugugcuuuccacaaau

SEQ ID NO: 8269 - RNA, 19 nt, Artificial Sequence
  RNA Oligomer
cuccugacugucaggauaa

SEQ ID NO: 8270 - RNA, 19 nt, Artificial Sequence
  RNA Oligomer
gagcugaacaggcugaacu

SEQ ID NO: 8271 - RNA, 19 nt, Artificial Sequence
  RNA Oligomer
gcaagauccugaaggaacu

SEQ ID NO: 8272 - RNA, 19 nt, Artificial Sequence
  RNA Oligomer
ccaugugaccuucaccaug

SEQ ID NO: 8273 - RNA, 19 nt, Artificial Sequence
  RNA Oligomer
cugaaggaguuugucaccu

SEQ ID NO: 8274 - RNA, 19 nt, Artificial Sequence
  RNA Oligomer
uccaagauaucguccggag

SEQ ID NO: 8275 - RNA, 19 nt, Artificial Sequence
  RNA Oligomer
cucacuucauccucgugga

SEQ ID NO: 8276 - RNA, 19 nt, Artificial Sequence
  RNA Oligomer
gcucuucugugcuuuccac

SEQ ID NO: 8277 - RNA, 19 nt, Artificial Sequence
  RNA Oligomer
ggacccaaagaaacauguc

SEQ ID NO: 8278 - RNA, 19 nt, Artificial Sequence
  RNA Oligomer
cucuaugcgaaccacaaga

SEQ ID NO: 8279 - RNA, 19 nt, Artificial Sequence
  RNA Oligomer
agaagaugcuggaagugcu

SEQ ID NO: 8280 - RNA, 19 nt, Artificial Sequence
  RNA Oligomer
aggccauccucauccacaa

SEQ ID NO: 8281 - RNA, 19 nt, Artificial Sequence
  RNA Oligomer
cagccuuguacuucaguga

SEQ ID NO: 8282 - RNA, 19 nt, Artificial Sequence
  RNA Oligomer
agcucuucuaugacccuga

SEQ ID NO: 8283 - RNA, 19 nt, Artificial Sequence
  RNA Oligomer
uggcucuucuccuuggugu

SEQ ID NO: 8284 - RNA, 19 nt, Artificial Sequence
  RNA Oligomer
gaccuucucauuugggcca

SEQ ID NO: 8285 - RNA, 19 nt, Artificial Sequence
  RNA Oligomer
uccacagcaagcugcagaa

SEQ ID NO: 8286 - RNA, 19 nt, Artificial Sequence
  RNA Oligomer
ugacaagcaagaaagccuc

SEQ ID NO: 8287 - RNA, 19 nt, Artificial Sequence
  RNA Oligomer
cacccuuuuacacggcaga

SEQ ID NO: 8288 - RNA, 19 nt, Artificial Sequence
  RNA Oligomer
gggagaucuaccugaagga

SEQ ID NO: 8289 - RNA, 19 nt, Artificial Sequence
  RNA Oligomer
uggacuucauccuguucug

SEQ ID NO: 8290 - RNA, 19 nt, Artificial Sequence
  RNA Oligomer
accucuggcucuucuccuu

SEQ ID NO: 8291 - RNA, 19 nt, Artificial Sequence
  RNA Oligomer
ugcucaugguggacuucca

SEQ ID NO: 8292 - RNA, 19 nt, Artificial Sequence
  RNA Oligomer
cugaaaacaucaagaagaa

SEQ ID NO: 8293 - RNA, 19 nt, Artificial Sequence
  RNA Oligomer
ccugcagcaagauccugaa

SEQ ID NO: 8294 - RNA, 19 nt, Artificial Sequence
  RNA Oligomer
uccacaaauaaaguuccug

SEQ ID NO: 8295 - RNA, 19 nt, Artificial Sequence
  RNA Oligomer
ucaacauggagccuugccu

SEQ ID NO: 8296 - RNA, 19 nt, Artificial Sequence
  RNA Oligomer
gcauaaagaagaugcugga

SEQ ID NO: 8297 - RNA, 19 nt, Artificial Sequence
  RNA Oligomer
uguggaaaguuccaaacug

SEQ ID NO: 8298 - RNA, 19 nt, Artificial Sequence
  RNA Oligomer
acgugcucaugguggacuu

SEQ ID NO: 8299 - RNA, 19 nt, Artificial Sequence
  RNA Oligomer
ucaucuccuucagggagaa

SEQ ID NO: 8300 - RNA, 19 nt, Artificial Sequence
  RNA Oligomer
gcacucaucuccaacaagc

SEQ ID NO: 8301 - RNA, 19 nt, Artificial Sequence
  RNA Oligomer
gaccaaggaaagaggaggu

SEQ ID NO: 8302 - RNA, 19 nt, Artificial Sequence
  RNA Oligomer
agcagcucaagaacaagcu

SEQ ID NO: 8303 - RNA, 19 nt, Artificial Sequence
  RNA Oligomer
acagcaagcugcagaaggu

SEQ ID NO: 8304 - RNA, 19 nt, Artificial Sequence
  RNA Oligomer
gugaagcucuuccuggaga

SEQ ID NO: 8305 - RNA, 19 nt, Artificial Sequence
  RNA Oligomer
cucaagaacaagcuggaga

SEQ ID NO: 8306 - RNA, 19 nt, Artificial Sequence
  RNA Oligomer
guggaaaguuccaaacugu

SEQ ID NO: 8307 - RNA, 19 nt, Artificial Sequence
  RNA Oligomer
ccugaaggaacuguccaag

SEQ ID NO: 8308 - RNA, 19 nt, Artificial Sequence
  RNA Oligomer
agauccugaaggaacuguc

SEQ ID NO: 8309 - RNA, 19 nt, Artificial Sequence
  RNA Oligomer
cagcaagauccugaaggaa

SEQ ID NO: 8310 - RNA, 19 nt, Artificial Sequence
  RNA Oligomer
caggaaucaucugggcuca

SEQ ID NO: 8311 - RNA, 19 nt, Artificial Sequence
  RNA Oligomer
caagcaagaaagccucagu

SEQ ID NO: 8312 - RNA, 19 nt, Artificial Sequence
  RNA Oligomer
aagcaagaaagccucaguu

SEQ ID NO: 8313 - RNA, 19 nt, Artificial Sequence
  RNA Oligomer
uaggagaggauguucaggu

SEQ ID NO: 8314 - RNA, 19 nt, Artificial Sequence
  RNA Oligomer
acugaugguaaaaaugugc

SEQ ID NO: 8315 - RNA, 19 nt, Artificial Sequence
  RNA Oligomer
aucagggagauagugaugu

SEQ ID NO: 8316 - RNA, 19 nt, Artificial Sequence
  RNA Oligomer
augaagaucucacugcggg

SEQ ID NO: 8317 - RNA, 19 nt, Artificial Sequence
  RNA Oligomer
uugaagaggcugcuguugc

SEQ ID NO: 8318 - RNA, 19 nt, Artificial Sequence
  RNA Oligomer
uuguuggagaugagugcag

SEQ ID NO: 8319 - RNA, 19 nt, Artificial Sequence
  RNA Oligomer
aucuccuggaagaacacgc

SEQ ID NO: 8320 - RNA, 19 nt, Artificial Sequence
  RNA Oligomer
acguuguacuggaucgugg

SEQ ID NO: 8321 - RNA, 19 nt, Artificial Sequence
  RNA Oligomer
aagacguccuucaucaucc

SEQ ID NO: 8322 - RNA, 19 nt, Artificial Sequence
  RNA Oligomer
uacugaugguaaaaaugug

SEQ ID NO: 8323 - RNA, 19 nt, Artificial Sequence
  RNA Oligomer
cuuauugcugauguccucg

SEQ ID NO: 8324 - RNA, 19 nt, Artificial Sequence
  RNA Oligomer
aacauggcgaugaggaggu

SEQ ID NO: 8325 - RNA, 19 nt, Artificial Sequence
  RNA Oligomer
aggagaggauguucaggug

SEQ ID NO: 8326 - RNA, 19 nt, Artificial Sequence
  RNA Oligomer
caaacuucauguccuuggc

SEQ ID NO: 8327 - RNA, 19 nt, Artificial Sequence
  RNA Oligomer
gaaggucucaaacaucucc

SEQ ID NO: 8328 - RNA, 19 nt, Artificial Sequence
  RNA Oligomer
aaggucucaaacaucuccu

SEQ ID NO: 8329 - RNA, 19 nt, Artificial Sequence
  RNA Oligomer
augaagugagagugguugc

SEQ ID NO: 8330 - RNA, 19 nt, Artificial Sequence
  RNA Oligomer
acguacuuuuucaccuucu

SEQ ID NO: 8331 - RNA, 19 nt, Artificial Sequence
  RNA Oligomer
uuccucacagacauaggcc

SEQ ID NO: 8332 - RNA, 19 nt, Artificial Sequence
  RNA Oligomer
uucagcaaguuuucaaaag

SEQ ID NO: 8333 - RNA, 19 nt, Artificial Sequence
  RNA Oligomer
guucuugagcugcuugugc

SEQ ID NO: 8334 - RNA, 19 nt, Artificial Sequence
  RNA Oligomer
uugaugaagagcugcaggu

SEQ ID NO: 8335 - RNA, 19 nt, Artificial Sequence
  RNA Oligomer
cuuuccacaaaauacacgc

SEQ ID NO: 8336 - RNA, 19 nt, Artificial Sequence
  RNA Oligomer
aucauccgcuucacaauga

SEQ ID NO: 8337 - RNA, 19 nt, Artificial Sequence
  RNA Oligomer
auccgcuucacaaugauga

SEQ ID NO: 8338 - RNA, 19 nt, Artificial Sequence
  RNA Oligomer
uuucugggcucucucuucg

SEQ ID NO: 8339 - RNA, 19 nt, Artificial Sequence
  RNA Oligomer
uccucuuuccuuggucugc

SEQ ID NO: 8340 - RNA, 19 nt, Artificial Sequence
  RNA Oligomer
ucuuuccuuggucugcucc

SEQ ID NO: 8341 - RNA, 19 nt, Artificial Sequence
  RNA Oligomer
uuguacuggaucguggaca

SEQ ID NO: 8342 - RNA, 19 nt, Artificial Sequence
  RNA Oligomer
uauugcugauguccucgau

SEQ ID NO: 8343 - RNA, 19 nt, Artificial Sequence
  RNA Oligomer
uugcugauguccucgaucu

SEQ ID NO: 8344 - RNA, 19 nt, Artificial Sequence
  RNA Oligomer
cuuuugcuggaacugucgg

SEQ ID NO: 8345 - RNA, 19 nt, Artificial Sequence
  RNA Oligomer
agucacugaaguacaaggc

SEQ ID NO: 8346 - RNA, 19 nt, Artificial Sequence
  RNA Oligomer
aaacuucauguccuuggcc

SEQ ID NO: 8347 - RNA, 19 nt, Artificial Sequence
  RNA Oligomer
aacuucauguccuuggccu

SEQ ID NO: 8348 - RNA, 19 nt, Artificial Sequence
  RNA Oligomer
augagaaggucacggaugg

SEQ ID NO: 8349 - RNA, 19 nt, Artificial Sequence
  RNA Oligomer
auguuuucaggaauccacg

SEQ ID NO: 8350 - RNA, 19 nt, Artificial Sequence
  RNA Oligomer
uuuucaggaauccacgaac

SEQ ID NO: 8351 - RNA, 19 nt, Artificial Sequence
  RNA Oligomer
ucauccaugaagaucucac

SEQ ID NO: 8352 - RNA, 19 nt, Artificial Sequence
  RNA Oligomer
ugcuggaucagggagauag

SEQ ID NO: 8353 - RNA, 19 nt, Artificial Sequence
  RNA Oligomer
cucauccaguauguacucg

SEQ ID NO: 8354 - RNA, 19 nt, Artificial Sequence
  RNA Oligomer
ugcuugucauuguugccga

SEQ ID NO: 8355 - RNA, 19 nt, Artificial Sequence
  RNA Oligomer
acucggacguacuuuuuca

SEQ ID NO: 8356 - RNA, 19 nt, Artificial Sequence
  RNA Oligomer
gacguacuuuuucaccuuc

SEQ ID NO: 8357 - RNA, 19 nt, Artificial Sequence
  RNA Oligomer
aaaaugaagacagggagcu

SEQ ID NO: 8358 - RNA, 19 nt, Artificial Sequence
  RNA Oligomer
cuuccucacagacauaggc

SEQ ID NO: 8359 - RNA, 19 nt, Artificial Sequence
  RNA Oligomer
gucauagaucaggaacucc

SEQ ID NO: 8360 - RNA, 19 nt, Artificial Sequence
  RNA Oligomer
uugaacauggcgaugagga

SEQ ID NO: 8361 - RNA, 19 nt, Artificial Sequence
  RNA Oligomer
uuuccacaaaauacacgca

SEQ ID NO: 8362 - RNA, 19 nt, Artificial Sequence
  RNA Oligomer
cgcuucacaaugaugaucu

SEQ ID NO: 8363 - RNA, 19 nt, Artificial Sequence
  RNA Oligomer
uacacgcauucuuucuucu

SEQ ID NO: 8364 - RNA, 19 nt, Artificial Sequence
  RNA Oligomer
uucauguccuuggccucca

SEQ ID NO: 8365 - RNA, 19 nt, Artificial Sequence
  RNA Oligomer
aauggcccaaaugagaagg

SEQ ID NO: 8366 - RNA, 19 nt, Artificial Sequence
  RNA Oligomer
ucguacagguagagcaagg

SEQ ID NO: 8367 - RNA, 19 nt, Artificial Sequence
  RNA Oligomer
aucugaaggcuuccacugc

SEQ ID NO: 8368 - RNA, 19 nt, Artificial Sequence
  RNA Oligomer
caugaagaucucacugcgg

SEQ ID NO: 8369 - RNA, 19 nt, Artificial Sequence
  RNA Oligomer
auaucuuggaucuuuuugg

SEQ ID NO: 8370 - RNA, 19 nt, Artificial Sequence
  RNA Oligomer
ucuuuuugguccacucgac

SEQ ID NO: 8371 - RNA, 19 nt, Artificial Sequence
  RNA Oligomer
aauccugcuuuccgugaag

SEQ ID NO: 8372 - RNA, 19 nt, Artificial Sequence
  RNA Oligomer
uugucgauggugugcaacg

SEQ ID NO: 8373 - RNA, 19 nt, Artificial Sequence
  RNA Oligomer
cacaccuccucuuuccuug

SEQ ID NO: 8374 - RNA, 19 nt, Artificial Sequence
  RNA Oligomer
cuugcuugucauuguugcc

SEQ ID NO: 8375 - RNA, 19 nt, Artificial Sequence
  RNA Oligomer
uucauguugaaguucuugg

SEQ ID NO: 8376 - RNA, 19 nt, Artificial Sequence
  RNA Oligomer
guuuaggaaaaugaagaca

SEQ ID NO: 8377 - RNA, 19 nt, Artificial Sequence
  RNA Oligomer
gugcagguuagaguucagc

SEQ ID NO: 8378 - RNA, 19 nt, Artificial Sequence
  RNA Oligomer
cagcaaguuuucaaaagac

SEQ ID NO: 8379 - RNA, 19 nt, Artificial Sequence
  RNA Oligomer
ucaaccuuauugcugaugu

SEQ ID NO: 8380 - RNA, 19 nt, Artificial Sequence
  RNA Oligomer
ucguucuucuccagcuugu

SEQ ID NO: 8381 - RNA, 19 nt, Artificial Sequence
  RNA Oligomer
acuuuccacaaaauacacg

SEQ ID NO: 8382 - RNA, 19 nt, Artificial Sequence
  RNA Oligomer
agacguccuucaucauccg

SEQ ID NO: 8383 - RNA, 19 nt, Artificial Sequence
  RNA Oligomer
acguccuucaucauccgcu

SEQ ID NO: 8384 - RNA, 19 nt, Artificial Sequence
  RNA Oligomer
caaugaugaucuugggccc

SEQ ID NO: 8385 - RNA, 19 nt, Artificial Sequence
  RNA Oligomer
aagucacugaaguacaagg

SEQ ID NO: 8386 - RNA, 19 nt, Artificial Sequence
  RNA Oligomer
gauguuuucaggaauccac

SEQ ID NO: 8387 - RNA, 19 nt, Artificial Sequence
  RNA Oligomer
acaaacucaggcuuguugg

SEQ ID NO: 8388 - RNA, 19 nt, Artificial Sequence
  RNA Oligomer
auccaugaagaucucacug

SEQ ID NO: 8389 - RNA, 19 nt, Artificial Sequence
  RNA Oligomer
ccaugaagaucucacugcg

SEQ ID NO: 8390 - RNA, 19 nt, Artificial Sequence
  RNA Oligomer
gaauccacgaacugaggcu

SEQ ID NO: 8391 - RNA, 19 nt, Artificial Sequence
  RNA Oligomer
aucuuuuugguccacucga

SEQ ID NO: 8392 - RNA, 19 nt, Artificial Sequence
  RNA Oligomer
acaccuccucuuuccuugg

SEQ ID NO: 8393 - RNA, 19 nt, Artificial Sequence
  RNA Oligomer
augaacuucuccagccugg

SEQ ID NO: 8394 - RNA, 19 nt, Artificial Sequence
  RNA Oligomer
cucggacguacuuuuucac

SEQ ID NO: 8395 - RNA, 19 nt, Artificial Sequence
  RNA Oligomer
ucggacguacuuuuucacc

SEQ ID NO: 8396 - RNA, 19 nt, Artificial Sequence
  RNA Oligomer
agguuuaggaaaaugaaga

SEQ ID NO: 8397 - RNA, 19 nt, Artificial Sequence
  RNA Oligomer
gguuuaggaaaaugaagac

SEQ ID NO: 8398 - RNA, 19 nt, Artificial Sequence
  RNA Oligomer
uugacaccaaaccagaagg

SEQ ID NO: 8399 - RNA, 19 nt, Artificial Sequence
  RNA Oligomer
ucucgauccaggcauuguc

SEQ ID NO: 8400 - RNA, 19 nt, Artificial Sequence
  RNA Oligomer
ucauccauguagccuuugu

SEQ ID NO: 8401 - RNA, 19 nt, Artificial Sequence
  RNA Oligomer
uagccuuuguacaccucca

SEQ ID NO: 8402 - RNA, 19 nt, Artificial Sequence
  RNA Oligomer
uuuguacaccuccaugccg

SEQ ID NO: 8403 - RNA, 19 nt, Artificial Sequence
  RNA Oligomer
cugauguccucgaucuucu

SEQ ID NO: 8404 - RNA, 19 nt, Artificial Sequence
  RNA Oligomer
uagaggcagaguaggagga

SEQ ID NO: 8405 - RNA, 19 nt, Artificial Sequence
  RNA Oligomer
cacaaugaugaucuugggc

SEQ ID NO: 8406 - RNA, 19 nt, Artificial Sequence
  RNA Oligomer
cacgcauucuuucuucuug

SEQ ID NO: 8407 - RNA, 19 nt, Artificial Sequence
  RNA Oligomer
uuucaggaauccacgaacu

SEQ ID NO: 8408 - RNA, 19 nt, Artificial Sequence
  RNA Oligomer
cacucauccaugaagaucu

SEQ ID NO: 8409 - RNA, 19 nt, Artificial Sequence
  RNA Oligomer
acucauccaugaagaucuc

SEQ ID NO: 8410 - RNA, 19 nt, Artificial Sequence
  RNA Oligomer
ucuccuggaagaacacgcu

SEQ ID NO: 8411 - RNA, 19 nt, Artificial Sequence
  RNA Oligomer
gucaugaggugguagauca

SEQ ID NO: 8412 - RNA, 19 nt, Artificial Sequence
  RNA Oligomer
gugucaggaacuuuauuug

SEQ ID NO: 8413 - RNA, 19 nt, Artificial Sequence
  RNA Oligomer
aacuuuauuuguggaaagc

SEQ ID NO: 8414 - RNA, 19 nt, Artificial Sequence
  RNA Oligomer
guagccuuuguacaccucc

SEQ ID NO: 8415 - RNA, 19 nt, Artificial Sequence
  RNA Oligomer
cagacaguuuggaacuuuc

SEQ ID NO: 8416 - RNA, 19 nt, Artificial Sequence
  RNA Oligomer
caaaucugguccgugugcu

SEQ ID NO: 8417 - RNA, 19 nt, Artificial Sequence
  RNA Oligomer
aacuuuccacaaaauacac

SEQ ID NO: 8418 - RNA, 19 nt, Artificial Sequence
  RNA Oligomer
auggugagguaggaguggu

SEQ ID NO: 8419 - RNA, 19 nt, Artificial Sequence
  RNA Oligomer
uucuucaucagcccgcacu

SEQ ID NO: 8420 - RNA, 19 nt, Artificial Sequence
  RNA Oligomer
cagaucugaaggcuuccac

SEQ ID NO: 8421 - RNA, 19 nt, Artificial Sequence
  RNA Oligomer
aauccacgaacugaggcuu

SEQ ID NO: 8422 - RNA, 19 nt, Artificial Sequence
  RNA Oligomer
cucgacaauccugcuuucc

SEQ ID NO: 8423 - RNA, 19 nt, Artificial Sequence
  RNA Oligomer
ucgacaauccugcuuuccg

SEQ ID NO: 8424 - RNA, 19 nt, Artificial Sequence
  RNA Oligomer
gucucaaacaucuccugga

SEQ ID NO: 8425 - RNA, 19 nt, Artificial Sequence
  RNA Oligomer
aacaucuccuggaagaaca

SEQ ID NO: 8426 - RNA, 19 nt, Artificial Sequence
  RNA Oligomer
cugcuccgauaugaacuuc

SEQ ID NO: 8427 - RNA, 19 nt, Artificial Sequence
  RNA Oligomer
gauaugaacuucuccagcc

SEQ ID NO: 8428 - RNA, 19 nt, Artificial Sequence
  RNA Oligomer
cuuucuugcuugucauugu

SEQ ID NO: 8429 - RNA, 19 nt, Artificial Sequence
  RNA Oligomer
gaggaugaagugagagugg

SEQ ID NO: 8430 - RNA, 19 nt, Artificial Sequence
  RNA Oligomer
uuucuugcuugucauuguu

SEQ ID NO: 8431 - RNA, 19 nt, Artificial Sequence
  RNA Oligomer
augagcucgccuuccuugu

SEQ ID NO: 8432 - RNA, 19 nt, Artificial Sequence
  RNA Oligomer
uccucacagacauaggccu

SEQ ID NO: 8433 - RNA, 19 nt, Artificial Sequence
  RNA Oligomer
uguagccuuuguacaccuc

SEQ ID NO: 8434 - RNA, 19 nt, Artificial Sequence
  RNA Oligomer
cuuuguacaccuccaugcc

SEQ ID NO: 8435 - RNA, 19 nt, Artificial Sequence
  RNA Oligomer
caucuucuuuaugcucuuc

SEQ ID NO: 8436 - RNA, 19 nt, Artificial Sequence
  RNA Oligomer
guaaaagggugggucauag

SEQ ID NO: 8437 - RNA, 19 nt, Artificial Sequence
  RNA Oligomer
aagauggugagguaggagu

SEQ ID NO: 8438 - RNA, 19 nt, Artificial Sequence
  RNA Oligomer
gaggaagaagaagacgucc

SEQ ID NO: 8439 - RNA, 19 nt, Artificial Sequence
  RNA Oligomer
uuccacaaaauacacgcau

SEQ ID NO: 8440 - RNA, 19 nt, Artificial Sequence
  RNA Oligomer
gucagggucauagaagagc

SEQ ID NO: 8441 - RNA, 19 nt, Artificial Sequence
  RNA Oligomer
aaggcgaaguaggagagga

SEQ ID NO: 8442 - RNA, 19 nt, Artificial Sequence
  RNA Oligomer
uccuggaagaacacgcuca

SEQ ID NO: 8443 - RNA, 19 nt, Artificial Sequence
  RNA Oligomer
ugcuccgauaugaacuucu

SEQ ID NO: 8444 - RNA, 19 nt, Artificial Sequence
  RNA Oligomer
auaugaacuucuccagccu

SEQ ID NO: 8445 - RNA, 19 nt, Artificial Sequence
  RNA Oligomer
aggaugaagugagaguggu

SEQ ID NO: 8446 - RNA, 19 nt, Artificial Sequence
  RNA Oligomer
uccuggacauguuucuuug

SEQ ID NO: 8447 - RNA, 19 nt, Artificial Sequence
  RNA Oligomer
gagcuguugacaccaaacc

SEQ ID NO: 8448 - RNA, 19 nt, Artificial Sequence
  RNA Oligomer
acauguuucuuuggguccc

SEQ ID NO: 8449 - RNA, 19 nt, Artificial Sequence
  RNA Oligomer
uagaguucagccuguucag

SEQ ID NO: 8450 - RNA, 19 nt, Artificial Sequence
  RNA Oligomer
cagcaucagacaguuugga

SEQ ID NO: 8451 - RNA, 19 nt, Artificial Sequence
  RNA Oligomer
aagguguaguugaacaugg

SEQ ID NO: 8452 - RNA, 19 nt, Artificial Sequence
  RNA Oligomer
uuggugaagagcagguaga

SEQ ID NO: 8453 - RNA, 19 nt, Artificial Sequence
  RNA Oligomer
agaggaagaagaagacguc

SEQ ID NO: 8454 - RNA, 19 nt, Artificial Sequence
  RNA Oligomer
uuccacugccacucaucca

SEQ ID NO: 8455 - RNA, 19 nt, Artificial Sequence
  RNA Oligomer
uuuucaccuucuggcucag

SEQ ID NO: 8456 - RNA, 19 nt, Artificial Sequence
  RNA Oligomer
gucaggaacuuuauuugug

SEQ ID NO: 8457 - RNA, 19 nt, Artificial Sequence
  RNA Oligomer
gaacuuuccacaaaauaca

SEQ ID NO: 8458 - RNA, 19 nt, Artificial Sequence
  RNA Oligomer
ucccaggugacaaacuccu

SEQ ID NO: 8459 - RNA, 19 nt, Artificial Sequence
  RNA Oligomer
ugcagaucugaaggcuucc

SEQ ID NO: 8460 - RNA, 19 nt, Artificial Sequence
  RNA Oligomer
uaucuuggaucuuuuuggu

SEQ ID NO: 8461 - RNA, 19 nt, Artificial Sequence
  RNA Oligomer
cuccgauaugaacuucucc

SEQ ID NO: 8462 - RNA, 19 nt, Artificial Sequence
  RNA Oligomer
uccgauaugaacuucucca

SEQ ID NO: 8463 - RNA, 19 nt, Artificial Sequence
  RNA Oligomer
auguuucuuugggucccac

SEQ ID NO: 8464 - RNA, 19 nt, Artificial Sequence
  RNA Oligomer
uguagccacacugacacac

SEQ ID NO: 8465 - RNA, 19 nt, Artificial Sequence
  RNA Oligomer
auggcgucaaccuuauugc

SEQ ID NO: 8466 - RNA, 19 nt, Artificial Sequence
  RNA Oligomer
uaguugaacauggcgauga

SEQ ID NO: 8467 - RNA, 19 nt, Artificial Sequence
  RNA Oligomer
ugagguaggagugguagac

SEQ ID NO: 8468 - RNA, 19 nt, Artificial Sequence
  RNA Oligomer
uucugggcucucucuucgu

SEQ ID NO: 8469 - RNA, 19 nt, Artificial Sequence
  RNA Oligomer
ccaaaugagaaggucacgg

SEQ ID NO: 8470 - RNA, 19 nt, Artificial Sequence
  RNA Oligomer
gugcagaucugaaggcuuc

SEQ ID NO: 8471 - RNA, 19 nt, Artificial Sequence
  RNA Oligomer
uggacauguuucuuugggu

SEQ ID NO: 8472 - RNA, 19 nt, Artificial Sequence
  RNA Oligomer
auguccucgaucuucugcu

SEQ ID NO: 8473 - RNA, 19 nt, Artificial Sequence
  RNA Oligomer
aacuuccaaaucugguccg

SEQ ID NO: 8474 - RNA, 19 nt, Artificial Sequence
  RNA Oligomer
gacaaacuccuucagcugc

SEQ ID NO: 8475 - RNA, 19 nt, Artificial Sequence
  RNA Oligomer
acaaacuccuucagcugca

SEQ ID NO: 8476 - RNA, 19 nt, Artificial Sequence
  RNA Oligomer
aucuugauggccacaccuc

SEQ ID NO: 8477 - RNA, 19 nt, Artificial Sequence
  RNA Oligomer
auguugaaguucuuggccc

SEQ ID NO: 8478 - RNA, 19 nt, Artificial Sequence
  RNA Oligomer
uuucaccuucuggcucagg

SEQ ID NO: 8479 - RNA, 19 nt, Artificial Sequence
  RNA Oligomer
aucgaggagaacuucaggc

SEQ ID NO: 8480 - RNA, 19 nt, Artificial Sequence
  RNA Oligomer
cauguuucuuuggguccca

SEQ ID NO: 8481 - RNA, 19 nt, Artificial Sequence
  RNA Oligomer
caaguuuucaaaagacggc

SEQ ID NO: 8482 - RNA, 19 nt, Artificial Sequence
  RNA Oligomer
agguguaguugaacauggc

SEQ ID NO: 8483 - RNA, 19 nt, Artificial Sequence
  RNA Oligomer
aaaaugugcaugagccgga

SEQ ID NO: 8484 - RNA, 19 nt, Artificial Sequence
  RNA Oligomer
gugaaggucucaaacaucu

SEQ ID NO: 8485 - RNA, 19 nt, Artificial Sequence
  RNA Oligomer
augaggugguagaucacgc

SEQ ID NO: 8486 - RNA, 19 nt, Artificial Sequence
  RNA Oligomer
aaguuuucaaaagacggcc

SEQ ID NO: 8487 - RNA, 19 nt, Artificial Sequence
  RNA Oligomer
uugagcagcaggauguugg

SEQ ID NO: 8488 - RNA, 19 nt, Artificial Sequence
  RNA Oligomer
uugguccacucgacaaucc

SEQ ID NO: 8489 - RNA, 19 nt, Artificial Sequence
  RNA Oligomer
uuuuucaccuucuggcuca

SEQ ID NO: 8490 - RNA, 19 nt, Artificial Sequence
  RNA Oligomer
gauguccucgaucuucugc

SEQ ID NO: 8491 - RNA, 19 nt, Artificial Sequence
  RNA Oligomer
uugcuggaacugucgguuc

SEQ ID NO: 8492 - RNA, 19 nt, Artificial Sequence
  RNA Oligomer
aaaugugcaugagccggag

SEQ ID NO: 8493 - RNA, 19 nt, Artificial Sequence
  RNA Oligomer
cauucuuucuucuugaugu

SEQ ID NO: 8494 - RNA, 19 nt, Artificial Sequence
  RNA Oligomer
cuuucuucuugauguuuuc

SEQ ID NO: 8495 - RNA, 19 nt, Artificial Sequence
  RNA Oligomer
uucucguacagguagagca

SEQ ID NO: 8496 - RNA, 19 nt, Artificial Sequence
  RNA Oligomer
aagagcuucacaaacucag

SEQ ID NO: 8497 - RNA, 19 nt, Artificial Sequence
  RNA Oligomer
auucugguccuggaagugg

SEQ ID NO: 8498 - RNA, 19 nt, Artificial Sequence
  RNA Oligomer
uucaaaagacggccagugc

SEQ ID NO: 8499 - RNA, 19 nt, Artificial Sequence
  RNA Oligomer
uuuugcuggaacugucggu

SEQ ID NO: 8500 - RNA, 19 nt, Artificial Sequence
  RNA Oligomer
aagaggaagaagaagacgu

SEQ ID NO: 8501 - RNA, 19 nt, Artificial Sequence
  RNA Oligomer
acgcauucuuucuucuuga

SEQ ID NO: 8502 - RNA, 19 nt, Artificial Sequence
  RNA Oligomer
gauaucuuggaucuuuuug

SEQ ID NO: 8503 - RNA, 19 nt, Artificial Sequence
  RNA Oligomer
uugcugucuaggcagguca

SEQ ID NO: 8504 - RNA, 19 nt, Artificial Sequence
  RNA Oligomer
aaaaugcucuucagccgcg

SEQ ID NO: 8505 - RNA, 19 nt, Artificial Sequence
  RNA Oligomer
uuucaaaagacggccagug

SEQ ID NO: 8506 - RNA, 19 nt, Artificial Sequence
  RNA Oligomer
uguccucgaucuucugcuc

SEQ ID NO: 8507 - RNA, 19 nt, Artificial Sequence
  RNA Oligomer
agcagcaggauguugguga

SEQ ID NO: 8508 - RNA, 19 nt, Artificial Sequence
  RNA Oligomer
acgaagagcaagauugcgc

SEQ ID NO: 8509 - RNA, 19 nt, Artificial Sequence
  RNA Oligomer
uugauguuuucaggaaucc

SEQ ID NO: 8510 - RNA, 19 nt, Artificial Sequence
  RNA Oligomer
aagauggccacauccacgu

SEQ ID NO: 8511 - RNA, 19 nt, Artificial Sequence
  RNA Oligomer
uuccucgggucauccaugu

SEQ ID NO: 8512 - RNA, 19 nt, Artificial Sequence
  RNA Oligomer
cauguagccuuuguacacc

SEQ ID NO: 8513 - RNA, 19 nt, Artificial Sequence
  RNA Oligomer
uuuaugcucuuccugcaga

SEQ ID NO: 8514 - RNA, 19 nt, Artificial Sequence
  RNA Oligomer
auccaccacguuguacugg

SEQ ID NO: 8515 - RNA, 19 nt, Artificial Sequence
  RNA Oligomer
uccggguugaaguucacac

SEQ ID NO: 8516 - RNA, 19 nt, Artificial Sequence
  RNA Oligomer
ucguuguggaugaggaugg

SEQ ID NO: 8517 - RNA, 19 nt, Artificial Sequence
  RNA Oligomer
aagaagacguccuucauca

SEQ ID NO: 8518 - RNA, 19 nt, Artificial Sequence
  RNA Oligomer
cagggagauagugaugucc

SEQ ID NO: 8519 - RNA, 19 nt, Artificial Sequence
  RNA Oligomer
auccaggcauuguccgugu

SEQ ID NO: 8520 - RNA, 19 nt, Artificial Sequence
  RNA Oligomer
accacguuguacuggaucg

SEQ ID NO: 8521 - RNA, 19 nt, Artificial Sequence
  RNA Oligomer
auagaucaggaacuccguc

SEQ ID NO: 8522 - RNA, 19 nt, Artificial Sequence
  RNA Oligomer
cauggcgucaaccuuauug

SEQ ID NO: 8523 - RNA, 19 nt, Artificial Sequence
  RNA Oligomer
aacugucgguucuggaggu

SEQ ID NO: 8524 - RNA, 19 nt, Artificial Sequence
  RNA Oligomer
uucuggagguaguucuccu

SEQ ID NO: 8525 - RNA, 19 nt, Artificial Sequence
  RNA Oligomer
acuuccaaaucugguccgu

SEQ ID NO: 8526 - RNA, 19 nt, Artificial Sequence
  RNA Oligomer
guguaguugaacauggcga

SEQ ID NO: 8527 - RNA, 19 nt, Artificial Sequence
  RNA Oligomer
ugguaaaaaugugcaugag

SEQ ID NO: 8528 - RNA, 19 nt, Artificial Sequence
  RNA Oligomer
aaaaaugugcaugagccgg

SEQ ID NO: 8529 - RNA, 19 nt, Artificial Sequence
  RNA Oligomer
guacaaggcugccuucuuc

SEQ ID NO: 8530 - RNA, 19 nt, Artificial Sequence
  RNA Oligomer
aaggcugccuucuucauca

SEQ ID NO: 8531 - RNA, 19 nt, Artificial Sequence
  RNA Oligomer
aagagccagagguagaugg

SEQ ID NO: 8532 - RNA, 19 nt, Artificial Sequence
  RNA Oligomer
augagugcagcugucaucg

SEQ ID NO: 8533 - RNA, 19 nt, Artificial Sequence
  RNA Oligomer
ucuuggaucuuuuuggucc

SEQ ID NO: 8534 - RNA, 19 nt, Artificial Sequence
  RNA Oligomer
aguuucugcuggaucaggg

SEQ ID NO: 8535 - RNA, 19 nt, Artificial Sequence
  RNA Oligomer
auccaguauguacucggcg

SEQ ID NO: 8536 - RNA, 19 nt, Artificial Sequence
  RNA Oligomer
ucugcggaaaaugcucuuc

SEQ ID NO: 8537 - RNA, 19 nt, Artificial Sequence
  RNA Oligomer
guacuuuuucaccuucugg

SEQ ID NO: 8538 - RNA, 19 nt, Artificial Sequence
  RNA Oligomer
aagacgaugucgccaaagg

SEQ ID NO: 8539 - RNA, 19 nt, Artificial Sequence
  RNA Oligomer
uuugggucagguggaagac

SEQ ID NO: 8540 - RNA, 19 nt, Artificial Sequence
  RNA Oligomer
uuggguuuuaccacguucc

SEQ ID NO: 8541 - RNA, 19 nt, Artificial Sequence
  RNA Oligomer
uucugguccuggaagugga

SEQ ID NO: 8542 - RNA, 19 nt, Artificial Sequence
  RNA Oligomer
uagccacacugacacacca

SEQ ID NO: 8543 - RNA, 19 nt, Artificial Sequence
  RNA Oligomer
uuugcuggaacugucgguu

SEQ ID NO: 8544 - RNA, 19 nt, Artificial Sequence
  RNA Oligomer
guucuggagguaguucucc

SEQ ID NO: 8545 - RNA, 19 nt, Artificial Sequence
  RNA Oligomer
uugagcugcuugugccucu

SEQ ID NO: 8546 - RNA, 19 nt, Artificial Sequence
  RNA Oligomer
uccagcucuugaagaggcu

SEQ ID NO: 8547 - RNA, 19 nt, Artificial Sequence
  RNA Oligomer
agguugagcagcaggaugu

SEQ ID NO: 8548 - RNA, 19 nt, Artificial Sequence
  RNA Oligomer
cugaugguaaaaaugugca

SEQ ID NO: 8549 - RNA, 19 nt, Artificial Sequence
  RNA Oligomer
uaaaaaugugcaugagccg

SEQ ID NO: 8550 - RNA, 19 nt, Artificial Sequence
  RNA Oligomer
aagagcaagauugcgccga

SEQ ID NO: 8551 - RNA, 19 nt, Artificial Sequence
  RNA Oligomer
auguucagguggaagacca

SEQ ID NO: 8552 - RNA, 19 nt, Artificial Sequence
  RNA Oligomer
uccuucaggaucuugcugc

SEQ ID NO: 8553 - RNA, 19 nt, Artificial Sequence
  RNA Oligomer
aaaguggucuuggcuccgu

SEQ ID NO: 8554 - RNA, 19 nt, Artificial Sequence
  RNA Oligomer
auccugcuuuccgugaagg

SEQ ID NO: 8555 - RNA, 19 nt, Artificial Sequence
  RNA Oligomer
uuuccuuggucugcuccga

SEQ ID NO: 8556 - RNA, 19 nt, Artificial Sequence
  RNA Oligomer
uuggucugcuccgauauga

SEQ ID NO: 8557 - RNA, 19 nt, Artificial Sequence
  RNA Oligomer
ucgaggagaacuucaggca

SEQ ID NO: 8558 - RNA, 19 nt, Artificial Sequence
  RNA Oligomer
ugucuuggguuuuaccacg

SEQ ID NO: 8559 - RNA, 19 nt, Artificial Sequence
  RNA Oligomer
uucuuugggucccacugug

SEQ ID NO: 8560 - RNA, 19 nt, Artificial Sequence
  RNA Oligomer
aagggugggucauagauca

SEQ ID NO: 8561 - RNA, 19 nt, Artificial Sequence
  RNA Oligomer
uagaucucccaggauagca

SEQ ID NO: 8562 - RNA, 19 nt, Artificial Sequence
  RNA Oligomer
uacuccucgaucaggucau

SEQ ID NO: 8563 - RNA, 19 nt, Artificial Sequence
  RNA Oligomer
aguugaacauggcgaugag

SEQ ID NO: 8564 - RNA, 19 nt, Artificial Sequence
  RNA Oligomer
auguuggugaagagcaggu

SEQ ID NO: 8565 - RNA, 19 nt, Artificial Sequence
  RNA Oligomer
gaagaggaagaagaagacg

SEQ ID NO: 8566 - RNA, 19 nt, Artificial Sequence
  RNA Oligomer
aacaggaugaaguccagag

SEQ ID NO: 8567 - RNA, 19 nt, Artificial Sequence
  RNA Oligomer
aaguccagagagaggauga

SEQ ID NO: 8568 - RNA, 19 nt, Artificial Sequence
  RNA Oligomer
cucuugaagaggcugcugu

SEQ ID NO: 8569 - RNA, 19 nt, Artificial Sequence
  RNA Oligomer
cacugaaguacaaggcugc

SEQ ID NO: 8570 - RNA, 19 nt, Artificial Sequence
  RNA Oligomer
ucugagcccagaugauucc

SEQ ID NO: 8571 - RNA, 19 nt, Artificial Sequence
  RNA Oligomer
auggugaaggucacauggc

SEQ ID NO: 8572 - RNA, 19 nt, Artificial Sequence
  RNA Oligomer
uguuggagaugagugcagc

SEQ ID NO: 8573 - RNA, 19 nt, Artificial Sequence
  RNA Oligomer
aacacgcucaguuucugcu

SEQ ID NO: 8574 - RNA, 19 nt, Artificial Sequence
  RNA Oligomer
uucugcuggaucagggaga

SEQ ID NO: 8575 - RNA, 19 nt, Artificial Sequence
  RNA Oligomer
ucagggagauagugauguc

SEQ ID NO: 8576 - RNA, 19 nt, Artificial Sequence
  RNA Oligomer
uagugauguccgagacagg

SEQ ID NO: 8577 - RNA, 19 nt, Artificial Sequence
  RNA Oligomer
aagugagagugguugcugu

SEQ ID NO: 8578 - RNA, 19 nt, Artificial Sequence
  RNA Oligomer
uugucauuguugccgaagg

SEQ ID NO: 8579 - RNA, 19 nt, Artificial Sequence
  RNA Oligomer
ugucauuguugccgaaggg

SEQ ID NO: 8580 - RNA, 19 nt, Artificial Sequence
  RNA Oligomer
gucuuggguuuuaccacgu

SEQ ID NO: 8581 - RNA, 19 nt, Artificial Sequence
  RNA Oligomer
cuuggguuuuaccacguuc

SEQ ID NO: 8582 - RNA, 19 nt, Artificial Sequence
  RNA Oligomer
ucacagacauaggccugag

SEQ ID NO: 8583 - RNA, 19 nt, Artificial Sequence
  RNA Oligomer
aacgucuauggacuggagc

SEQ ID NO: 8584 - RNA, 19 nt, Artificial Sequence
  RNA Oligomer
uucgcauagagugggaugc

SEQ ID NO: 8585 - RNA, 19 nt, Artificial Sequence
  RNA Oligomer
auguagccuuuguacaccu

SEQ ID NO: 8586 - RNA, 19 nt, Artificial Sequence
  RNA Oligomer
agcaaguuuucaaaagacg

SEQ ID NO: 8587 - RNA, 19 nt, Artificial Sequence
  RNA Oligomer
uccaccacguuguacugga

SEQ ID NO: 8588 - RNA, 19 nt, Artificial Sequence
  RNA Oligomer
uaguucuccuucagguaga

SEQ ID NO: 8589 - RNA, 19 nt, Artificial Sequence
  RNA Oligomer
agaucucccaggauagcag

SEQ ID NO: 8590 - RNA, 19 nt, Artificial Sequence
  RNA Oligomer
acccucuugaugaagagcu

SEQ ID NO: 8591 - RNA, 19 nt, Artificial Sequence
  RNA Oligomer
auggcgaugaggagguuga

SEQ ID NO: 8592 - RNA, 19 nt, Artificial Sequence
  RNA Oligomer
ugcuccggguugaaguuca

SEQ ID NO: 8593 - RNA, 19 nt, Artificial Sequence
  RNA Oligomer
agcucuugaagaggcugcu

SEQ ID NO: 8594 - RNA, 19 nt, Artificial Sequence
  RNA Oligomer
guaaaaaugugcaugagcc

SEQ ID NO: 8595 - RNA, 19 nt, Artificial Sequence
  RNA Oligomer
aaguacaaggcugccuucu

SEQ ID NO: 8596 - RNA, 19 nt, Artificial Sequence
  RNA Oligomer
uucagguggaagaccacca

SEQ ID NO: 8597 - RNA, 19 nt, Artificial Sequence
  RNA Oligomer
uaaagcggcugcgugaagu

SEQ ID NO: 8598 - RNA, 19 nt, Artificial Sequence
  RNA Oligomer
caggugacaaacuccuuca

SEQ ID NO: 8599 - RNA, 19 nt, Artificial Sequence
  RNA Oligomer
gagcuucacaaacucaggc

SEQ ID NO: 8600 - RNA, 19 nt, Artificial Sequence
  RNA Oligomer
uuggaucuuuuugguccac

SEQ ID NO: 8601 - RNA, 19 nt, Artificial Sequence
  RNA Oligomer
uuucugcuggaucagggag

SEQ ID NO: 8602 - RNA, 19 nt, Artificial Sequence
  RNA Oligomer
ugaagaggcugcuguugcu

SEQ ID NO: 8603 - RNA, 19 nt, Artificial Sequence
  RNA Oligomer
agggagauagugauguccg

SEQ ID NO: 8604 - RNA, 19 nt, Artificial Sequence
  RNA Oligomer
auagugauguccgagacag

SEQ ID NO: 8605 - RNA, 19 nt, Artificial Sequence
  RNA Oligomer
ucauccaguauguacucgg

SEQ ID NO: 8606 - RNA, 19 nt, Artificial Sequence
  RNA Oligomer
cugcggaaaaugcucuuca

SEQ ID NO: 8607 - RNA, 19 nt, Artificial Sequence
  RNA Oligomer
acggaguuuauccugacag

SEQ ID NO: 8608 - RNA, 19 nt, Artificial Sequence
  RNA Oligomer
uuucuuugggucccacugu

SEQ ID NO: 8609 - RNA, 19 nt, Artificial Sequence
  RNA Oligomer
uucagccuguucagcucca

SEQ ID NO: 8610 - RNA, 19 nt, Artificial Sequence
  RNA Oligomer
uccacgucauucugguccu

SEQ ID NO: 8611 - RNA, 19 nt, Artificial Sequence
  RNA Oligomer
augcucuuccugcagaugg

SEQ ID NO: 8612 - RNA, 19 nt, Artificial Sequence
  RNA Oligomer
agguaguucuccuucaggu

SEQ ID NO: 8613 - RNA, 19 nt, Artificial Sequence
  RNA Oligomer
ucuugaugaagagcugcag

SEQ ID NO: 8614 - RNA, 19 nt, Artificial Sequence
  RNA Oligomer
aucugcccgaagaugguga

SEQ ID NO: 8615 - RNA, 19 nt, Artificial Sequence
  RNA Oligomer
aagaagaagacguccuuca

SEQ ID NO: 8616 - RNA, 19 nt, Artificial Sequence
  RNA Oligomer
augaaguccagagagagga

SEQ ID NO: 8617 - RNA, 19 nt, Artificial Sequence
  RNA Oligomer
agacacaaacuucaugucc

SEQ ID NO: 8618 - RNA, 19 nt, Artificial Sequence
  RNA Oligomer
aaacuccuucagcugcacc

SEQ ID NO: 8619 - RNA, 19 nt, Artificial Sequence
  RNA Oligomer
agcuucacaaacucaggcu

SEQ ID NO: 8620 - RNA, 19 nt, Artificial Sequence
  RNA Oligomer
aucuuggaucuuuuugguc

SEQ ID NO: 8621 - RNA, 19 nt, Artificial Sequence
  RNA Oligomer
gaucuuuuugguccacucg

SEQ ID NO: 8622 - RNA, 19 nt, Artificial Sequence
  RNA Oligomer
gaacacgcucaguuucugc

SEQ ID NO: 8623 - RNA, 19 nt, Artificial Sequence
  RNA Oligomer
agauagugauguccgagac

SEQ ID NO: 8624 - RNA, 19 nt, Artificial Sequence
  RNA Oligomer
cauccaguauguacucggc

SEQ ID NO: 8625 - RNA, 19 nt, Artificial Sequence
  RNA Oligomer
ggaaaaugcucuucagccg

SEQ ID NO: 8626 - RNA, 19 nt, Artificial Sequence
  RNA Oligomer
gaaaaugcucuucagccgc

SEQ ID NO: 8627 - RNA, 19 nt, Artificial Sequence
  RNA Oligomer
cauguugaaguucuuggcc

SEQ ID NO: 8628 - RNA, 19 nt, Artificial Sequence
  RNA Oligomer
accgagaucaagagauugg

SEQ ID NO: 8629 - RNA, 19 nt, Artificial Sequence
  RNA Oligomer
uacuuuuucaccuucuggc

SEQ ID NO: 8630 - RNA, 19 nt, Artificial Sequence
  RNA Oligomer
ucaggaacuuuauuugugg

SEQ ID NO: 8631 - RNA, 19 nt, Artificial Sequence
  RNA Oligomer
agguuagaguucagccugu

SEQ ID NO: 8632 - RNA, 19 nt, Artificial Sequence
  RNA Oligomer
aagugcugcucaugcgugu

SEQ ID NO: 8633 - RNA, 19 nt, Artificial Sequence
  RNA Oligomer
aguuuucaaaagacggcca

SEQ ID NO: 8634 - RNA, 19 nt, Artificial Sequence
  RNA Oligomer
agcaucuucuuuaugcucu

SEQ ID NO: 8635 - RNA, 19 nt, Artificial Sequence
  RNA Oligomer
cagcuuguucuugagcugc

SEQ ID NO: 8636 - RNA, 19 nt, Artificial Sequence
  RNA Oligomer
cucuugaugaagagcugca

SEQ ID NO: 8637 - RNA, 19 nt, Artificial Sequence
  RNA Oligomer
ugguacuccucgaucaggu

SEQ ID NO: 8638 - RNA, 19 nt, Artificial Sequence
  RNA Oligomer
cuggaacuuccaaaucugg

SEQ ID NO: 8639 - RNA, 19 nt, Artificial Sequence
  RNA Oligomer
augguaaaaaugugcauga

SEQ ID NO: 8640 - RNA, 19 nt, Artificial Sequence
  RNA Oligomer
acugaaguacaaggcugcc

SEQ ID NO: 8641 - RNA, 19 nt, Artificial Sequence
  RNA Oligomer
cugaaguacaaggcugccu

SEQ ID NO: 8642 - RNA, 19 nt, Artificial Sequence
  RNA Oligomer
ugcacguugagcuugacgu

SEQ ID NO: 8643 - RNA, 19 nt, Artificial Sequence
  RNA Oligomer
uucuccaggaagagcuuca

SEQ ID NO: 8644 - RNA, 19 nt, Artificial Sequence
  RNA Oligomer
uucacaaacucaggcuugu

SEQ ID NO: 8645 - RNA, 19 nt, Artificial Sequence
  RNA Oligomer
aaacucaggcuuguuggag

SEQ ID NO: 8646 - RNA, 19 nt, Artificial Sequence
  RNA Oligomer
aagaacacgcucaguuucu

SEQ ID NO: 8647 - RNA, 19 nt, Artificial Sequence
  RNA Oligomer
gagagugguugcugucuag

SEQ ID NO: 8648 - RNA, 19 nt, Artificial Sequence
  RNA Oligomer
aaugucuuggguuuuacca

SEQ ID NO: 8649 - RNA, 19 nt, Artificial Sequence
  RNA Oligomer
uuuauccugacagucagga

SEQ ID NO: 8650 - RNA, 19 nt, Artificial Sequence
  RNA Oligomer
ugcagguuagaguucagcc

SEQ ID NO: 8651 - RNA, 19 nt, Artificial Sequence
  RNA Oligomer
augcguguagccacacuga

SEQ ID NO: 8652 - RNA, 19 nt, Artificial Sequence
  RNA Oligomer
guuuucaaaagacggccag

SEQ ID NO: 8653 - RNA, 19 nt, Artificial Sequence
  RNA Oligomer
ucuuuaugcucuuccugca

SEQ ID NO: 8654 - RNA, 19 nt, Artificial Sequence
  RNA Oligomer
uguacuggaucguggacag

SEQ ID NO: 8655 - RNA, 19 nt, Artificial Sequence
  RNA Oligomer
ugcuuuugcuggaacuguc

SEQ ID NO: 8656 - RNA, 19 nt, Artificial Sequence
  RNA Oligomer
uggagguaguucuccuuca

SEQ ID NO: 8657 - RNA, 19 nt, Artificial Sequence
  RNA Oligomer
cuccuucagguagaucucc

SEQ ID NO: 8658 - RNA, 19 nt, Artificial Sequence
  RNA Oligomer
agacaguuuggaacuuucc

SEQ ID NO: 8659 - RNA, 19 nt, Artificial Sequence
  RNA Oligomer
agaacaggaugaaguccag

SEQ ID NO: 8660 - RNA, 19 nt, Artificial Sequence
  RNA Oligomer
uuccagaagucacugaagu

SEQ ID NO: 8661 - RNA, 19 nt, Artificial Sequence
  RNA Oligomer
ucuucuugauguuuucagg

SEQ ID NO: 8662 - RNA, 19 nt, Artificial Sequence
  RNA Oligomer
uucuugauguuuucaggaa

SEQ ID NO: 8663 - RNA, 19 nt, Artificial Sequence
  RNA Oligomer
auggcccaaaugagaaggu

SEQ ID NO: 8664 - RNA, 19 nt, Artificial Sequence
  RNA Oligomer
aacucaggcuuguuggaga

SEQ ID NO: 8665 - RNA, 19 nt, Artificial Sequence
  RNA Oligomer
aggucucaaacaucuccug

SEQ ID NO: 8666 - RNA, 19 nt, Artificial Sequence
  RNA Oligomer
ugaagugagagugguugcu

SEQ ID NO: 8667 - RNA, 19 nt, Artificial Sequence
  RNA Oligomer
agugguugcugucuaggca

SEQ ID NO: 8668 - RNA, 19 nt, Artificial Sequence
  RNA Oligomer
ugaggugguagaucacgcu

SEQ ID NO: 8669 - RNA, 19 nt, Artificial Sequence
  RNA Oligomer
aaaugaagacagggagcug

SEQ ID NO: 8670 - RNA, 19 nt, Artificial Sequence
  RNA Oligomer
cuggacauguuucuuuggg

SEQ ID NO: 8671 - RNA, 19 nt, Artificial Sequence
  RNA Oligomer
augucuuggguuuuaccac

SEQ ID NO: 8672 - RNA, 19 nt, Artificial Sequence
  RNA Oligomer
aaacauggaggcccucuug

SEQ ID NO: 8673 - RNA, 19 nt, Artificial Sequence
  RNA Oligomer
cucacagacauaggccuga

SEQ ID NO: 8674 - RNA, 19 nt, Artificial Sequence
  RNA Oligomer
ugugguucgcauagagugg

SEQ ID NO: 8675 - RNA, 19 nt, Artificial Sequence
  RNA Oligomer
agcuccacgucauucuggu

SEQ ID NO: 8676 - RNA, 19 nt, Artificial Sequence
  RNA Oligomer
uccagcuuguucuugagcu

SEQ ID NO: 8677 - RNA, 19 nt, Artificial Sequence
  RNA Oligomer
augaggagguugagcagca

SEQ ID NO: 8678 - RNA, 19 nt, Artificial Sequence
  RNA Oligomer
aagagcagguagaggcaga

SEQ ID NO: 8679 - RNA, 19 nt, Artificial Sequence
  RNA Oligomer
gagacacaaacuucauguc

SEQ ID NO: 8680 - RNA, 19 nt, Artificial Sequence
  RNA Oligomer
gacacaaacuucauguccu

SEQ ID NO: 8681 - RNA, 19 nt, Artificial Sequence
  RNA Oligomer
aggaacgcuuguagaggga

SEQ ID NO: 8682 - RNA, 19 nt, Artificial Sequence
  RNA Oligomer
ugucccaggugacaaacuc

SEQ ID NO: 8683 - RNA, 19 nt, Artificial Sequence
  RNA Oligomer
cacaaacucaggcuuguug

SEQ ID NO: 8684 - RNA, 19 nt, Artificial Sequence
  RNA Oligomer
ucaggcuuguuggagauga

SEQ ID NO: 8685 - RNA, 19 nt, Artificial Sequence
  RNA Oligomer
caggaauccacgaacugag

SEQ ID NO: 8686 - RNA, 19 nt, Artificial Sequence
  RNA Oligomer
cuuggaucuuuuuggucca

SEQ ID NO: 8687 - RNA, 19 nt, Artificial Sequence
  RNA Oligomer
agaacacgcucaguuucug

SEQ ID NO: 8688 - RNA, 19 nt, Artificial Sequence
  RNA Oligomer
cugguccucagaggaaucu

SEQ ID NO: 8689 - RNA, 19 nt, Artificial Sequence
  RNA Oligomer
uauuuguggaaagcacaga

SEQ ID NO: 8690 - RNA, 19 nt, Artificial Sequence
  RNA Oligomer
uuuguggaaagcacagaag

SEQ ID NO: 8691 - RNA, 19 nt, Artificial Sequence
  RNA Oligomer
acuugccucaggccaauga

SEQ ID NO: 8692 - RNA, 19 nt, Artificial Sequence
  RNA Oligomer
ucagcucugaguagccugu

SEQ ID NO: 8693 - RNA, 19 nt, Artificial Sequence
  RNA Oligomer
ugguucgcauagaguggga

SEQ ID NO: 8694 - RNA, 19 nt, Artificial Sequence
  RNA Oligomer
ucucugccguguaaaaggg

SEQ ID NO: 8695 - RNA, 19 nt, Artificial Sequence
  RNA Oligomer
aggaagaagaagacguccu

SEQ ID NO: 8696 - RNA, 19 nt, Artificial Sequence
  RNA Oligomer
aguccagagagaggaugac

SEQ ID NO: 8697 - RNA, 19 nt, Artificial Sequence
  RNA Oligomer
cacgaagagcaagauugcg

SEQ ID NO: 8698 - RNA, 19 nt, Artificial Sequence
  RNA Oligomer
ucucccugaaggagaugag

SEQ ID NO: 8699 - RNA, 19 nt, Artificial Sequence
  RNA Oligomer
uucucguggccaaaguggu

SEQ ID NO: 8700 - RNA, 19 nt, Artificial Sequence
  RNA Oligomer
cuuuauuuguggaaagcac

SEQ ID NO: 8701 - RNA, 19 nt, Artificial Sequence
  RNA Oligomer
uuauuuguggaaagcacag

SEQ ID NO: 8702 - RNA, 19 nt, Artificial Sequence
  RNA Oligomer
uggguuuuaccacguuccc

SEQ ID NO: 8703 - RNA, 19 nt, Artificial Sequence
  RNA Oligomer
aguuuauccugacagucag

SEQ ID NO: 8704 - RNA, 19 nt, Artificial Sequence
  RNA Oligomer
augaccuccaugguggaug

SEQ ID NO: 8705 - RNA, 19 nt, Artificial Sequence
  RNA Oligomer
uugugguucgcauagagug

SEQ ID NO: 8706 - RNA, 19 nt, Artificial Sequence
  RNA Oligomer
ugaugguaaaaaugugcau

SEQ ID NO: 8707 - RNA, 19 nt, Artificial Sequence
  RNA Oligomer
uacaaggcugccuucuuca

SEQ ID NO: 8708 - RNA, 19 nt, Artificial Sequence
  RNA Oligomer
uuggacaguuccuucagga

SEQ ID NO: 8709 - RNA, 19 nt, Artificial Sequence
  RNA Oligomer
ccgagaucaagagauuggg

SEQ ID NO: 8710 - RNA, 19 nt, Artificial Sequence
  RNA Oligomer
auuuguggaaagcacagaa

SEQ ID NO: 8711 - RNA, 19 nt, Artificial Sequence
  RNA Oligomer
uuauccugacagucaggag

SEQ ID NO: 8712 - RNA, 19 nt, Artificial Sequence
  RNA Oligomer
aguucagccuguucagcuc

SEQ ID NO: 8713 - RNA, 19 nt, Artificial Sequence
  RNA Oligomer
aguuccuucaggaucuugc

SEQ ID NO: 8714 - RNA, 19 nt, Artificial Sequence
  RNA Oligomer
cauggugaaggucacaugg

SEQ ID NO: 8715 - RNA, 19 nt, Artificial Sequence
  RNA Oligomer
aggugacaaacuccuucag

SEQ ID NO: 8716 - RNA, 19 nt, Artificial Sequence
  RNA Oligomer
cuccggacgauaucuugga

SEQ ID NO: 8717 - RNA, 19 nt, Artificial Sequence
  RNA Oligomer
uccacgaggaugaagugag

SEQ ID NO: 8718 - RNA, 19 nt, Artificial Sequence
  RNA Oligomer
guggaaagcacagaagagc

SEQ ID NO: 8719 - RNA, 19 nt, Artificial Sequence
  RNA Oligomer
gacauguuucuuugggucc

SEQ ID NO: 8720 - RNA, 19 nt, Artificial Sequence
  RNA Oligomer
ucuugugguucgcauagag

SEQ ID NO: 8721 - RNA, 19 nt, Artificial Sequence
  RNA Oligomer
agcacuuccagcaucuucu

SEQ ID NO: 8722 - RNA, 19 nt, Artificial Sequence
  RNA Oligomer
uuguggaugaggauggccu

SEQ ID NO: 8723 - RNA, 19 nt, Artificial Sequence
  RNA Oligomer
ucacugaaguacaaggcug

SEQ ID NO: 8724 - RNA, 19 nt, Artificial Sequence
  RNA Oligomer
ucagggucauagaagagcu

SEQ ID NO: 8725 - RNA, 19 nt, Artificial Sequence
  RNA Oligomer
acaccaaggagaagagcca

SEQ ID NO: 8726 - RNA, 19 nt, Artificial Sequence
  RNA Oligomer
uggcccaaaugagaagguc

SEQ ID NO: 8727 - RNA, 19 nt, Artificial Sequence
  RNA Oligomer
uucugcagcuugcugugga

SEQ ID NO: 8728 - RNA, 19 nt, Artificial Sequence
  RNA Oligomer
gaggcuuucuugcuuguca

SEQ ID NO: 8729 - RNA, 19 nt, Artificial Sequence
  RNA Oligomer
ucugccguguaaaagggug

SEQ ID NO: 8730 - RNA, 19 nt, Artificial Sequence
  RNA Oligomer
uccuucagguagaucuccc

SEQ ID NO: 8731 - RNA, 19 nt, Artificial Sequence
  RNA Oligomer
cagaacaggaugaagucca

SEQ ID NO: 8732 - RNA, 19 nt, Artificial Sequence
  RNA Oligomer
aaggagaagagccagaggu

SEQ ID NO: 8733 - RNA, 19 nt, Artificial Sequence
  RNA Oligomer
uggaaguccaccaugagca

SEQ ID NO: 8734 - RNA, 19 nt, Artificial Sequence
  RNA Oligomer
uucuucuugauguuuucag

SEQ ID NO: 8735 - RNA, 19 nt, Artificial Sequence
  RNA Oligomer
uucaggaucuugcugcagg

SEQ ID NO: 8736 - RNA, 19 nt, Artificial Sequence
  RNA Oligomer
caggaacuuuauuugugga

SEQ ID NO: 8737 - RNA, 19 nt, Artificial Sequence
  RNA Oligomer
aggcaaggcuccauguuga

SEQ ID NO: 8738 - RNA, 19 nt, Artificial Sequence
  RNA Oligomer
uccagcaucuucuuuaugc

SEQ ID NO: 8739 - RNA, 19 nt, Artificial Sequence
  RNA Oligomer
caguuuggaacuuuccaca

SEQ ID NO: 8740 - RNA, 19 nt, Artificial Sequence
  RNA Oligomer
aaguccaccaugagcacgu

SEQ ID NO: 8741 - RNA, 19 nt, Artificial Sequence
  RNA Oligomer
uucucccugaaggagauga

SEQ ID NO: 8742 - RNA, 19 nt, Artificial Sequence
  RNA Oligomer
gcuuguuggagaugagugc

SEQ ID NO: 8743 - RNA, 19 nt, Artificial Sequence
  RNA Oligomer
accuccucuuuccuugguc

SEQ ID NO: 8744 - RNA, 19 nt, Artificial Sequence
  RNA Oligomer
agcuuguucuugagcugcu

SEQ ID NO: 8745 - RNA, 19 nt, Artificial Sequence
  RNA Oligomer
accuucugcagcuugcugu

SEQ ID NO: 8746 - RNA, 19 nt, Artificial Sequence
  RNA Oligomer
ucuccaggaagagcuucac

SEQ ID NO: 8747 - RNA, 19 nt, Artificial Sequence
  RNA Oligomer
ucuccagcuuguucuugag

SEQ ID NO: 8748 - RNA, 19 nt, Artificial Sequence
  RNA Oligomer
acaguuuggaacuuuccac

SEQ ID NO: 8749 - RNA, 19 nt, Artificial Sequence
  RNA Oligomer
cuuggacaguuccuucagg

SEQ ID NO: 8750 - RNA, 19 nt, Artificial Sequence
  RNA Oligomer
gacaguuccuucaggaucu

SEQ ID NO: 8751 - RNA, 19 nt, Artificial Sequence
  RNA Oligomer
uuccuucaggaucuugcug

SEQ ID NO: 8752 - RNA, 19 nt, Artificial Sequence
  RNA Oligomer
ugagcccagaugauuccug

SEQ ID NO: 8753 - RNA, 19 nt, Artificial Sequence
  RNA Oligomer
acugaggcuuucuugcuug

SEQ ID NO: 8754 - RNA, 19 nt, Artificial Sequence
  RNA Oligomer
aacugaggcuuucuugcuu

SEQ ID NO: 8755 - RNA, 19 nt, Artificial Sequence
  RNA Oligomer
ccauauauuauaccaguug

SEQ ID NO: 8756 - RNA, 19 nt, Artificial Sequence
  RNA Oligomer
gcaaaaugaagggaaacac

SEQ ID NO: 8757 - RNA, 19 nt, Artificial Sequence
  RNA Oligomer
ggcaaaaugaagggaaaca

SEQ ID NO: 8758 - RNA, 19 nt, Artificial Sequence
  RNA Oligomer
cucaacaaauuuacacgac

SEQ ID NO: 8759 - RNA, 19 nt, Artificial Sequence
  RNA Oligomer
guggcaaaaugaagggaaa

SEQ ID NO: 8760 - RNA, 19 nt, Artificial Sequence
  RNA Oligomer
cccagacauuaacuucaau

SEQ ID NO: 8761 - RNA, 19 nt, Artificial Sequence
  RNA Oligomer
agagaauagagacaaucaa

SEQ ID NO: 8762 - RNA, 19 nt, Artificial Sequence
  RNA Oligomer
ggaaucucuuuaacugauu

SEQ ID NO: 8763 - RNA, 19 nt, Artificial Sequence
  RNA Oligomer
ccauucauauaccaugcug

SEQ ID NO: 8764 - RNA, 19 nt, Artificial Sequence
  RNA Oligomer
ccagacauuaacuucaauc

SEQ ID NO: 8765 - RNA, 19 nt, Artificial Sequence
  RNA Oligomer
cacgacgaaaugcuaagau

SEQ ID NO: 8766 - RNA, 19 nt, Artificial Sequence
  RNA Oligomer
caacaaauuuacacgaccc

SEQ ID NO: 8767 - RNA, 19 nt, Artificial Sequence
  RNA Oligomer
ucaacaaauuuacacgacc

SEQ ID NO: 8768 - RNA, 19 nt, Artificial Sequence
  RNA Oligomer
ggauggacacuaaaggaau

SEQ ID NO: 8769 - RNA, 19 nt, Artificial Sequence
  RNA Oligomer
ugaauguagaaugcagaaa

SEQ ID NO: 8770 - RNA, 19 nt, Artificial Sequence
  RNA Oligomer
gccugaauguagaaugcag

SEQ ID NO: 8771 - RNA, 19 nt, Artificial Sequence
  RNA Oligomer
cggugaaguuagauuacau

SEQ ID NO: 8772 - RNA, 19 nt, Artificial Sequence
  RNA Oligomer
gggcggugaaguuagauua

SEQ ID NO: 8773 - RNA, 19 nt, Artificial Sequence
  RNA Oligomer
ugaagagaauagagacaau

SEQ ID NO: 8774 - RNA, 19 nt, Artificial Sequence
  RNA Oligomer
gcauaaugcaaaccuccua

SEQ ID NO: 8775 - RNA, 19 nt, Artificial Sequence
  RNA Oligomer
cucaacucuuaauaugcuu

SEQ ID NO: 8776 - RNA, 19 nt, Artificial Sequence
  RNA Oligomer
cgauacuacaaugaagaau

SEQ ID NO: 8777 - RNA, 19 nt, Artificial Sequence
  RNA Oligomer
agccuuaauacagauauug

SEQ ID NO: 8778 - RNA, 19 nt, Artificial Sequence
  RNA Oligomer
gcaugcuacagguggauuu

SEQ ID NO: 8779 - RNA, 19 nt, Artificial Sequence
  RNA Oligomer
acccagacauuaacuucaa

SEQ ID NO: 8780 - RNA, 19 nt, Artificial Sequence
  RNA Oligomer
caagaauagaauccaugau

SEQ ID NO: 8781 - RNA, 19 nt, Artificial Sequence
  RNA Oligomer
ggaacagauugccagucuu

SEQ ID NO: 8782 - RNA, 19 nt, Artificial Sequence
  RNA Oligomer
ggaaucagaaaguuuggau

SEQ ID NO: 8783 - RNA, 19 nt, Artificial Sequence
  RNA Oligomer
cacuucucaacaaauuuac

SEQ ID NO: 8784 - RNA, 19 nt, Artificial Sequence
  RNA Oligomer
ggacacuaaaggaaucaag

SEQ ID NO: 8785 - RNA, 19 nt, Artificial Sequence
  RNA Oligomer
uggauggacacuaaaggaa

SEQ ID NO: 8786 - RNA, 19 nt, Artificial Sequence
  RNA Oligomer
ggaaauauuucuagccuga

SEQ ID NO: 8787 - RNA, 19 nt, Artificial Sequence
  RNA Oligomer
cgcacuggaaugaaugauu

SEQ ID NO: 8788 - RNA, 19 nt, Artificial Sequence
  RNA Oligomer
ccuucaagguuccaagcaa

SEQ ID NO: 8789 - RNA, 19 nt, Artificial Sequence
  RNA Oligomer
caaauugacuagacaagaa

SEQ ID NO: 8790 - RNA, 19 nt, Artificial Sequence
  RNA Oligomer
cucugaggauguugguacu

SEQ ID NO: 8791 - RNA, 19 nt, Artificial Sequence
  RNA Oligomer
gugagcacauaaaaucuaa

SEQ ID NO: 8792 - RNA, 19 nt, Artificial Sequence
  RNA Oligomer
cucuuuaagugugucuaua

SEQ ID NO: 8793 - RNA, 19 nt, Artificial Sequence
  RNA Oligomer
ugaggcauauucauauaac

SEQ ID NO: 8794 - RNA, 19 nt, Artificial Sequence
  RNA Oligomer
cugucuuuuuuccucugau

SEQ ID NO: 8795 - RNA, 19 nt, Artificial Sequence
  RNA Oligomer
aggguuuuuuucauaugug

SEQ ID NO: 8796 - RNA, 19 nt, Artificial Sequence
  RNA Oligomer
gcaauguguaaguggcaaa

SEQ ID NO: 8797 - RNA, 19 nt, Artificial Sequence
  RNA Oligomer
acaucuaaacucccuccau

SEQ ID NO: 8798 - RNA, 19 nt, Artificial Sequence
  RNA Oligomer
cggagaaacuuaaaacgcu

SEQ ID NO: 8799 - RNA, 19 nt, Artificial Sequence
  RNA Oligomer
cuaagaugaaaucggagua

SEQ ID NO: 8800 - RNA, 19 nt, Artificial Sequence
  RNA Oligomer
ccacgacgaaaugcuaaga

SEQ ID NO: 8801 - RNA, 19 nt, Artificial Sequence
  RNA Oligomer
aggaugcuauucugaaaua

SEQ ID NO: 8802 - RNA, 19 nt, Artificial Sequence
  RNA Oligomer
ccuuuuccaacacauuaua

SEQ ID NO: 8803 - RNA, 19 nt, Artificial Sequence
  RNA Oligomer
ugcuaaacuaccuggaaau

SEQ ID NO: 8804 - RNA, 19 nt, Artificial Sequence
  RNA Oligomer
gcggugaaguuagauuaca

SEQ ID NO: 8805 - RNA, 19 nt, Artificial Sequence
  RNA Oligomer
uccucccaaacagcaaaua

SEQ ID NO: 8806 - RNA, 19 nt, Artificial Sequence
  RNA Oligomer
ucaagacucagaagcagau

SEQ ID NO: 8807 - RNA, 19 nt, Artificial Sequence
  RNA Oligomer
gcucugaggauguugguac

SEQ ID NO: 8808 - RNA, 19 nt, Artificial Sequence
  RNA Oligomer
ggcucugaggauguuggua

SEQ ID NO: 8809 - RNA, 19 nt, Artificial Sequence
  RNA Oligomer
ucagcaagaugagauagau

SEQ ID NO: 8810 - RNA, 19 nt, Artificial Sequence
  RNA Oligomer
aguggcaaaaugaagggaa

SEQ ID NO: 8811 - RNA, 19 nt, Artificial Sequence
  RNA Oligomer
ugguuugucugucuuuuuu

SEQ ID NO: 8812 - RNA, 19 nt, Artificial Sequence
  RNA Oligomer
cugcccauauauuauacca

SEQ ID NO: 8813 - RNA, 19 nt, Artificial Sequence
  RNA Oligomer
cguggacuuagauauguuu

SEQ ID NO: 8814 - RNA, 19 nt, Artificial Sequence
  RNA Oligomer
uccauucauauaccaugcu

SEQ ID NO: 8815 - RNA, 19 nt, Artificial Sequence
  RNA Oligomer
gacgaaaugcuaagaugaa

SEQ ID NO: 8816 - RNA, 19 nt, Artificial Sequence
  RNA Oligomer
cgacgaaaugcuaagauga

SEQ ID NO: 8817 - RNA, 19 nt, Artificial Sequence
  RNA Oligomer
ggaugcuauucugaaauac

SEQ ID NO: 8818 - RNA, 19 nt, Artificial Sequence
  RNA Oligomer
ugcacuucucaacaaauuu

SEQ ID NO: 8819 - RNA, 19 nt, Artificial Sequence
  RNA Oligomer
accuuuuccaacacauuau

SEQ ID NO: 8820 - RNA, 19 nt, Artificial Sequence
  RNA Oligomer
cuaaaccuuuuccaacaca

SEQ ID NO: 8821 - RNA, 19 nt, Artificial Sequence
  RNA Oligomer
ccuaaaccuuuuccaacac

SEQ ID NO: 8822 - RNA, 19 nt, Artificial Sequence
  RNA Oligomer
ccagauaagaaguggcuug

SEQ ID NO: 8823 - RNA, 19 nt, Artificial Sequence
  RNA Oligomer
cugaauguagaaugcagaa

SEQ ID NO: 8824 - RNA, 19 nt, Artificial Sequence
  RNA Oligomer
cuaaacuaccuggaaauau

SEQ ID NO: 8825 - RNA, 19 nt, Artificial Sequence
  RNA Oligomer
ggugaaguuagauuacauu

SEQ ID NO: 8826 - RNA, 19 nt, Artificial Sequence
  RNA Oligomer
agguuuugaugaacaagaa

SEQ ID NO: 8827 - RNA, 19 nt, Artificial Sequence
  RNA Oligomer
gcaaaugcaaagcagacua

SEQ ID NO: 8828 - RNA, 19 nt, Artificial Sequence
  RNA Oligomer
agaauagagacaaucaaca

SEQ ID NO: 8829 - RNA, 19 nt, Artificial Sequence
  RNA Oligomer
gugaagagaauagagacaa

SEQ ID NO: 8830 - RNA, 19 nt, Artificial Sequence
  RNA Oligomer
gcucuuuaagugugucuau

SEQ ID NO: 8831 - RNA, 19 nt, Artificial Sequence
  RNA Oligomer
aggaaucucuuuaacugau

SEQ ID NO: 8832 - RNA, 19 nt, Artificial Sequence
  RNA Oligomer
caaguugaaauccaggaau

SEQ ID NO: 8833 - RNA, 19 nt, Artificial Sequence
  RNA Oligomer
acguggacuuagauauguu

SEQ ID NO: 8834 - RNA, 19 nt, Artificial Sequence
  RNA Oligomer
cgcaaucucuuccacacau

SEQ ID NO: 8835 - RNA, 19 nt, Artificial Sequence
  RNA Oligomer
cagaauugaugagagacau

SEQ ID NO: 8836 - RNA, 19 nt, Artificial Sequence
  RNA Oligomer
gccuuaauacagauauugg

SEQ ID NO: 8837 - RNA, 19 nt, Artificial Sequence
  RNA Oligomer
gaaaauguuucucagcuaa

SEQ ID NO: 8838 - RNA, 19 nt, Artificial Sequence
  RNA Oligomer
gaaaaacccuugacacgau

SEQ ID NO: 8839 - RNA, 19 nt, Artificial Sequence
  RNA Oligomer
acagagucuugaagauuuu

SEQ ID NO: 8840 - RNA, 19 nt, Artificial Sequence
  RNA Oligomer
agacauuaacuucaaucga

SEQ ID NO: 8841 - RNA, 19 nt, Artificial Sequence
  RNA Oligomer
acgacgaaaugcuaagaug

SEQ ID NO: 8842 - RNA, 19 nt, Artificial Sequence
  RNA Oligomer
ugaaucauuccaucacaau

SEQ ID NO: 8843 - RNA, 19 nt, Artificial Sequence
  RNA Oligomer
ugaucgauuucugggauaa

SEQ ID NO: 8844 - RNA, 19 nt, Artificial Sequence
  RNA Oligomer
uggacacuaaaggaaucaa

SEQ ID NO: 8845 - RNA, 19 nt, Artificial Sequence
  RNA Oligomer
aguaacuauucggguagau

SEQ ID NO: 8846 - RNA, 19 nt, Artificial Sequence
  RNA Oligomer
caguaacuauucggguaga

SEQ ID NO: 8847 - RNA, 19 nt, Artificial Sequence
  RNA Oligomer
caguuggauggacacuaaa

SEQ ID NO: 8848 - RNA, 19 nt, Artificial Sequence
  RNA Oligomer
ggagaugagaagaaugccu

SEQ ID NO: 8849 - RNA, 19 nt, Artificial Sequence
  RNA Oligomer
ccauugaggagaugagaag

SEQ ID NO: 8850 - RNA, 19 nt, Artificial Sequence
  RNA Oligomer
cuagccugaauguagaaug

SEQ ID NO: 8851 - RNA, 19 nt, Artificial Sequence
  RNA Oligomer
ccaccucgcuuguuuucaa

SEQ ID NO: 8852 - RNA, 19 nt, Artificial Sequence
  RNA Oligomer
agggcggugaaguuagauu

SEQ ID NO: 8853 - RNA, 19 nt, Artificial Sequence
  RNA Oligomer
uccagguuuugaugaacaa

SEQ ID NO: 8854 - RNA, 19 nt, Artificial Sequence
  RNA Oligomer
gacaaguccagguuuugau

SEQ ID NO: 8855 - RNA, 19 nt, Artificial Sequence
  RNA Oligomer
gcagaugaggagacaaguc

SEQ ID NO: 8856 - RNA, 19 nt, Artificial Sequence
  RNA Oligomer
ccaucucucucagguuagu

SEQ ID NO: 8857 - RNA, 19 nt, Artificial Sequence
  RNA Oligomer
ugugagcacauaaaaucua

SEQ ID NO: 8858 - RNA, 19 nt, Artificial Sequence
  RNA Oligomer
gcuugaggcauauucauau

SEQ ID NO: 8859 - RNA, 19 nt, Artificial Sequence
  RNA Oligomer
ugcuaaaaaucucccugug

SEQ ID NO: 8860 - RNA, 19 nt, Artificial Sequence
  RNA Oligomer
gucaguugguacaucuaaa

SEQ ID NO: 8861 - RNA, 19 nt, Artificial Sequence
  RNA Oligomer
gucagguguaauauaugaa

SEQ ID NO: 8862 - RNA, 19 nt, Artificial Sequence
  RNA Oligomer
cgaauagcaucuccuccca

SEQ ID NO: 8863 - RNA, 19 nt, Artificial Sequence
  RNA Oligomer
ucauauaccaugcugucga

SEQ ID NO: 8864 - RNA, 19 nt, Artificial Sequence
  RNA Oligomer
gcuuuauccauucauauac

SEQ ID NO: 8865 - RNA, 19 nt, Artificial Sequence
  RNA Oligomer
acaaugaagaaugcagaaa

SEQ ID NO: 8866 - RNA, 19 nt, Artificial Sequence
  RNA Oligomer
agaauugaugagagacauu

SEQ ID NO: 8867 - RNA, 19 nt, Artificial Sequence
  RNA Oligomer
agagaaucuuucugcagug

SEQ ID NO: 8868 - RNA, 19 nt, Artificial Sequence
  RNA Oligomer
aggcaugcuacagguggau

SEQ ID NO: 8869 - RNA, 19 nt, Artificial Sequence
  RNA Oligomer
ugaugaguucuguacaaaa

SEQ ID NO: 8870 - RNA, 19 nt, Artificial Sequence
  RNA Oligomer
cgauuguuugagggacguu

SEQ ID NO: 8871 - RNA, 19 nt, Artificial Sequence
  RNA Oligomer
uaagaugaaaucggaguau

SEQ ID NO: 8872 - RNA, 19 nt, Artificial Sequence
  RNA Oligomer
acagcggaaucagaaaguu

SEQ ID NO: 8873 - RNA, 19 nt, Artificial Sequence
  RNA Oligomer
cgauuucugggauaaggua

SEQ ID NO: 8874 - RNA, 19 nt, Artificial Sequence
  RNA Oligomer
cagcuuugaucgauuucug

SEQ ID NO: 8875 - RNA, 19 nt, Artificial Sequence
  RNA Oligomer
ggaaucaagacagcggaau

SEQ ID NO: 8876 - RNA, 19 nt, Artificial Sequence
  RNA Oligomer
uccuaaaccuuuuccaaca

SEQ ID NO: 8877 - RNA, 19 nt, Artificial Sequence
  RNA Oligomer
acaguaacuauucggguag

SEQ ID NO: 8878 - RNA, 19 nt, Artificial Sequence
  RNA Oligomer
cacaguaacuauucgggua

SEQ ID NO: 8879 - RNA, 19 nt, Artificial Sequence
  RNA Oligomer
agaaaagaacagugggaaa

SEQ ID NO: 8880 - RNA, 19 nt, Artificial Sequence
  RNA Oligomer
ggacagaagaaaagaacag

SEQ ID NO: 8881 - RNA, 19 nt, Artificial Sequence
  RNA Oligomer
gaaauauuucuagccugaa

SEQ ID NO: 8882 - RNA, 19 nt, Artificial Sequence
  RNA Oligomer
cuaccuggaaauauuucua

SEQ ID NO: 8883 - RNA, 19 nt, Artificial Sequence
  RNA Oligomer
aggaaacgguacucuacua

SEQ ID NO: 8884 - RNA, 19 nt, Artificial Sequence
  RNA Oligomer
ccgauggauguggauaauu

SEQ ID NO: 8885 - RNA, 19 nt, Artificial Sequence
  RNA Oligomer
accgauggauguggauaau

SEQ ID NO: 8886 - RNA, 19 nt, Artificial Sequence
  RNA Oligomer
acaacaaauugacuagaca

SEQ ID NO: 8887 - RNA, 19 nt, Artificial Sequence
  RNA Oligomer
gacaacaaauugacuagac

SEQ ID NO: 8888 - RNA, 19 nt, Artificial Sequence
  RNA Oligomer
gaagagaauagagacaauc

SEQ ID NO: 8889 - RNA, 19 nt, Artificial Sequence
  RNA Oligomer
ucaaaaugaugaucacagu

SEQ ID NO: 8890 - RNA, 19 nt, Artificial Sequence
  RNA Oligomer
ggagcagcuuuuggaaagu

SEQ ID NO: 8891 - RNA, 19 nt, Artificial Sequence
  RNA Oligomer
ugcucuuuaagugugucua

SEQ ID NO: 8892 - RNA, 19 nt, Artificial Sequence
  RNA Oligomer
cugggaacuucaugcugau

SEQ ID NO: 8893 - RNA, 19 nt, Artificial Sequence
  RNA Oligomer
cuugaggcauauucauaua

SEQ ID NO: 8894 - RNA, 19 nt, Artificial Sequence
  RNA Oligomer
gguguaaagaaaacagauu

SEQ ID NO: 8895 - RNA, 19 nt, Artificial Sequence
  RNA Oligomer
guguaaguggcaaaaugaa

SEQ ID NO: 8896 - RNA, 19 nt, Artificial Sequence
  RNA Oligomer
ugcuugcauuguuuaaguu

SEQ ID NO: 8897 - RNA, 19 nt, Artificial Sequence
  RNA Oligomer
ucaacucuuaauaugcuug

SEQ ID NO: 8898 - RNA, 19 nt, Artificial Sequence
  RNA Oligomer
acucaacucuuaauaugcu

SEQ ID NO: 8899 - RNA, 19 nt, Artificial Sequence
  RNA Oligomer
uccacucaacucuuaauau

SEQ ID NO: 8900 - RNA, 19 nt, Artificial Sequence
  RNA Oligomer
caauguguaaguggcaaaa

SEQ ID NO: 8901 - RNA, 19 nt, Artificial Sequence
  RNA Oligomer
acaaguugaaauccaggaa

SEQ ID NO: 8902 - RNA, 19 nt, Artificial Sequence
  RNA Oligomer
gaaacaaguugaaauccag

SEQ ID NO: 8903 - RNA, 19 nt, Artificial Sequence
  RNA Oligomer
gccaggaaacaaguugaaa

SEQ ID NO: 8904 - RNA, 19 nt, Artificial Sequence
  RNA Oligomer
ugccaggaaacaaguugaa

SEQ ID NO: 8905 - RNA, 19 nt, Artificial Sequence
  RNA Oligomer
uccugcccauauauuauac

SEQ ID NO: 8906 - RNA, 19 nt, Artificial Sequence
  RNA Oligomer
ucaguugguacaucuaaac

SEQ ID NO: 8907 - RNA, 19 nt, Artificial Sequence
  RNA Oligomer
gcaguugucaguugguaca

SEQ ID NO: 8908 - RNA, 19 nt, Artificial Sequence
  RNA Oligomer
ucagaauugaugagagaca

SEQ ID NO: 8909 - RNA, 19 nt, Artificial Sequence
  RNA Oligomer
ggugggaaagugaacgaau

SEQ ID NO: 8910 - RNA, 19 nt, Artificial Sequence
  RNA Oligomer
gggugaugccagguuaaaa

SEQ ID NO: 8911 - RNA, 19 nt, Artificial Sequence
  RNA Oligomer
cgcuuuuuaaucaauccug

SEQ ID NO: 8912 - RNA, 19 nt, Artificial Sequence
  RNA Oligomer
ccgcuuuuuaaucaauccu

SEQ ID NO: 8913 - RNA, 19 nt, Artificial Sequence
  RNA Oligomer
gcaaaucguuuuguuggag

SEQ ID NO: 8914 - RNA, 19 nt, Artificial Sequence
  RNA Oligomer
ggcaugcuacagguggauu

SEQ ID NO: 8915 - RNA, 19 nt, Artificial Sequence
  RNA Oligomer
gacagagucuugaagauuu

SEQ ID NO: 8916 - RNA, 19 nt, Artificial Sequence
  RNA Oligomer
ccaugaugaguucuguaca

SEQ ID NO: 8917 - RNA, 19 nt, Artificial Sequence
  RNA Oligomer
ggguuggugacauuuacaa

SEQ ID NO: 8918 - RNA, 19 nt, Artificial Sequence
  RNA Oligomer
gcuaagaugaaaucggagu

SEQ ID NO: 8919 - RNA, 19 nt, Artificial Sequence
  RNA Oligomer
acagauugccagucuuuua

SEQ ID NO: 8920 - RNA, 19 nt, Artificial Sequence
  RNA Oligomer
ccaucacaaugucgcagga

SEQ ID NO: 8921 - RNA, 19 nt, Artificial Sequence
  RNA Oligomer
gaaucagaaaguuuggaua

SEQ ID NO: 8922 - RNA, 19 nt, Artificial Sequence
  RNA Oligomer
cggaaucagaaaguuugga

SEQ ID NO: 8923 - RNA, 19 nt, Artificial Sequence
  RNA Oligomer
gcagaagcucaacauuuau

SEQ ID NO: 8924 - RNA, 19 nt, Artificial Sequence
  RNA Oligomer
ggauaagguacuugaagaa

SEQ ID NO: 8925 - RNA, 19 nt, Artificial Sequence
  RNA Oligomer
acagcuuugaucgauuucu

SEQ ID NO: 8926 - RNA, 19 nt, Artificial Sequence
  RNA Oligomer
guggcauauucuaagaaau

SEQ ID NO: 8927 - RNA, 19 nt, Artificial Sequence
  RNA Oligomer
gaacaaaauuuguacccag

SEQ ID NO: 8928 - RNA, 19 nt, Artificial Sequence
  RNA Oligomer
agaacaaaauuuguaccca

SEQ ID NO: 8929 - RNA, 19 nt, Artificial Sequence
  RNA Oligomer
uaaaccuuuuccaacacau

SEQ ID NO: 8930 - RNA, 19 nt, Artificial Sequence
  RNA Oligomer
cuauucggguagaucuuuu

SEQ ID NO: 8931 - RNA, 19 nt, Artificial Sequence
  RNA Oligomer
uggugggaaagugaacgaa

SEQ ID NO: 8932 - RNA, 19 nt, Artificial Sequence
  RNA Oligomer
cuaaauacguuccaccuca

SEQ ID NO: 8933 - RNA, 19 nt, Artificial Sequence
  RNA Oligomer
gaaaagaacagugggaaac

SEQ ID NO: 8934 - RNA, 19 nt, Artificial Sequence
  RNA Oligomer
augcuaaacuaccuggaaa

SEQ ID NO: 8935 - RNA, 19 nt, Artificial Sequence
  RNA Oligomer
gagucgcacuggaaugaau

SEQ ID NO: 8936 - RNA, 19 nt, Artificial Sequence
  RNA Oligomer
ggcggugaaguuagauuac

SEQ ID NO: 8937 - RNA, 19 nt, Artificial Sequence
  RNA Oligomer
ugaacaagaagaugguagu

SEQ ID NO: 8938 - RNA, 19 nt, Artificial Sequence
  RNA Oligomer
aaguccagguuuugaugaa

SEQ ID NO: 8939 - RNA, 19 nt, Artificial Sequence
  RNA Oligomer
caacaaauugacuagacaa

SEQ ID NO: 8940 - RNA, 19 nt, Artificial Sequence
  RNA Oligomer
uguuggcucugaggauguu

SEQ ID NO: 8941 - RNA, 19 nt, Artificial Sequence
  RNA Oligomer
agauguuggcucugaggau

SEQ ID NO: 8942 - RNA, 19 nt, Artificial Sequence
  RNA Oligomer
auagagacaaucaacaguu

SEQ ID NO: 8943 - RNA, 19 nt, Artificial Sequence
  RNA Oligomer
gugggaaagugaacgaauc

SEQ ID NO: 8944 - RNA, 19 nt, Artificial Sequence
  RNA Oligomer
caacucuuaauaugcuugc

SEQ ID NO: 8945 - RNA, 19 nt, Artificial Sequence
  RNA Oligomer
gcuaaaaaucucccuguga

SEQ ID NO: 8946 - RNA, 19 nt, Artificial Sequence
  RNA Oligomer
uuccugcccauauauuaua

SEQ ID NO: 8947 - RNA, 19 nt, Artificial Sequence
  RNA Oligomer
guggacuuagauauguuuu

SEQ ID NO: 8948 - RNA, 19 nt, Artificial Sequence
  RNA Oligomer
cacguggacuuagauaugu

SEQ ID NO: 8949 - RNA, 19 nt, Artificial Sequence
  RNA Oligomer
gguacaucuaaacucccuc

SEQ ID NO: 8950 - RNA, 19 nt, Artificial Sequence
  RNA Oligomer
gcaaucucuuccacacaug

SEQ ID NO: 8951 - RNA, 19 nt, Artificial Sequence
  RNA Oligomer
ugagcugucagguguaaua

SEQ ID NO: 8952 - RNA, 19 nt, Artificial Sequence
  RNA Oligomer
gguuaaaagccuuaauaca

SEQ ID NO: 8953 - RNA, 19 nt, Artificial Sequence
  RNA Oligomer
cacgaagaugggagugaaa

SEQ ID NO: 8954 - RNA, 19 nt, Artificial Sequence
  RNA Oligomer
acccuugacacgauugcau

SEQ ID NO: 8955 - RNA, 19 nt, Artificial Sequence
  RNA Oligomer
augaugaguucuguacaaa

SEQ ID NO: 8956 - RNA, 19 nt, Artificial Sequence
  RNA Oligomer
aagaugaaaucggaguauu

SEQ ID NO: 8957 - RNA, 19 nt, Artificial Sequence
  RNA Oligomer
cgaaaugcuaagaugaaau

SEQ ID NO: 8958 - RNA, 19 nt, Artificial Sequence
  RNA Oligomer
gaaacagaagaugaaucau

SEQ ID NO: 8959 - RNA, 19 nt, Artificial Sequence
  RNA Oligomer
gaacgaaucccgaaucaaa

SEQ ID NO: 8960 - RNA, 19 nt, Artificial Sequence
  RNA Oligomer
uugaucgauuucugggaua

SEQ ID NO: 8961 - RNA, 19 nt, Artificial Sequence
  RNA Oligomer
cacuaaaggaaucaagaca

SEQ ID NO: 8962 - RNA, 19 nt, Artificial Sequence
  RNA Oligomer
cauguuaaaaugccuuguu

SEQ ID NO: 8963 - RNA, 19 nt, Artificial Sequence
  RNA Oligomer
cccuaaauacguuccaccu

SEQ ID NO: 8964 - RNA, 19 nt, Artificial Sequence
  RNA Oligomer
gaagaaaagaacaguggga

SEQ ID NO: 8965 - RNA, 19 nt, Artificial Sequence
  RNA Oligomer
acagaucauuucaugagac

SEQ ID NO: 8966 - RNA, 19 nt, Artificial Sequence
  RNA Oligomer
cacagaucauuucaugaga

SEQ ID NO: 8967 - RNA, 19 nt, Artificial Sequence
  RNA Oligomer
ucgcacuggaaugaaugau

SEQ ID NO: 8968 - RNA, 19 nt, Artificial Sequence
  RNA Oligomer
agguuagugaaaugaggcu

SEQ ID NO: 8969 - RNA, 19 nt, Artificial Sequence
  RNA Oligomer
uuccucccaaacagcaaau

SEQ ID NO: 8970 - RNA, 19 nt, Artificial Sequence
  RNA Oligomer
gaacaagaagaugguaguu

SEQ ID NO: 8971 - RNA, 19 nt, Artificial Sequence
  RNA Oligomer
uggauguggauaauucuaa

SEQ ID NO: 8972 - RNA, 19 nt, Artificial Sequence
  RNA Oligomer
ugacuagacaagaaaguug

SEQ ID NO: 8973 - RNA, 19 nt, Artificial Sequence
  RNA Oligomer
gccagagaguccauuguca

SEQ ID NO: 8974 - RNA, 19 nt, Artificial Sequence
  RNA Oligomer
gucagcaagaugagauaga

SEQ ID NO: 8975 - RNA, 19 nt, Artificial Sequence
  RNA Oligomer
ugcuaacauugaucgguca

SEQ ID NO: 8976 - RNA, 19 nt, Artificial Sequence
  RNA Oligomer
guaugcucuuuaagugugu

SEQ ID NO: 8977 - RNA, 19 nt, Artificial Sequence
  RNA Oligomer
cggagcagcuuuuggaaag

SEQ ID NO: 8978 - RNA, 19 nt, Artificial Sequence
  RNA Oligomer
acucccauaucaucuauau

SEQ ID NO: 8979 - RNA, 19 nt, Artificial Sequence
  RNA Oligomer
gaaacucccauaucaucua

SEQ ID NO: 8980 - RNA, 19 nt, Artificial Sequence
  RNA Oligomer
cugguauucaaagguuaua

SEQ ID NO: 8981 - RNA, 19 nt, Artificial Sequence
  RNA Oligomer
gaaauguggaauaaaagga

SEQ ID NO: 8982 - RNA, 19 nt, Artificial Sequence
  RNA Oligomer
ugucuuuuuuccucugauc

SEQ ID NO: 8983 - RNA, 19 nt, Artificial Sequence
  RNA Oligomer
ucugucuuuuuuccucuga

SEQ ID NO: 8984 - RNA, 19 nt, Artificial Sequence
  RNA Oligomer
guacuuuugagguaucauu

SEQ ID NO: 8985 - RNA, 19 nt, Artificial Sequence
  RNA Oligomer
cuccuagguuaaaauaguu

SEQ ID NO: 8986 - RNA, 19 nt, Artificial Sequence
  RNA Oligomer
uuccacucaacucuuaaua

SEQ ID NO: 8987 - RNA, 19 nt, Artificial Sequence
  RNA Oligomer
cuuccacucaacucuuaau

SEQ ID NO: 8988 - RNA, 19 nt, Artificial Sequence
  RNA Oligomer
agcaauguguaaguggcaa

SEQ ID NO: 8989 - RNA, 19 nt, Artificial Sequence
  RNA Oligomer
caaugaagaaugcagaaac

SEQ ID NO: 8990 - RNA, 19 nt, Artificial Sequence
  RNA Oligomer
acgauacuacaaugaagaa

SEQ ID NO: 8991 - RNA, 19 nt, Artificial Sequence
  RNA Oligomer
cuguuggagauguguauaa

SEQ ID NO: 8992 - RNA, 19 nt, Artificial Sequence
  RNA Oligomer
gcacauuuuccuuacugaa

SEQ ID NO: 8993 - RNA, 19 nt, Artificial Sequence
  RNA Oligomer
ugucuaauuaucacaggua

SEQ ID NO: 8994 - RNA, 19 nt, Artificial Sequence
  RNA Oligomer
ccugaguugauuauuucac

SEQ ID NO: 8995 - RNA, 19 nt, Artificial Sequence
  RNA Oligomer
gaagaaauccgcuuuuuaa

SEQ ID NO: 8996 - RNA, 19 nt, Artificial Sequence
  RNA Oligomer
agaagaaauccgcuuuuua

SEQ ID NO: 8997 - RNA, 19 nt, Artificial Sequence
  RNA Oligomer
ugcaaaucguuuuguugga

SEQ ID NO: 8998 - RNA, 19 nt, Artificial Sequence
  RNA Oligomer
uccaugaugaguucuguac

SEQ ID NO: 8999 - RNA, 19 nt, Artificial Sequence
  RNA Oligomer
ccuacuggguuggugacau

SEQ ID NO: 9000 - RNA, 19 nt, Artificial Sequence
  RNA Oligomer
auagaauccaugaugaguu

SEQ ID NO: 9001 - RNA, 19 nt, Artificial Sequence
  RNA Oligomer
ucgauuguuugagggacgu

SEQ ID NO: 9002 - RNA, 19 nt, Artificial Sequence
  RNA Oligomer
cagauugccagucuuuuag

SEQ ID NO: 9003 - RNA, 19 nt, Artificial Sequence
  RNA Oligomer
agcggaaucagaaaguuug

SEQ ID NO: 9004 - RNA, 19 nt, Artificial Sequence
  RNA Oligomer
gaaaauugcacucugucug

SEQ ID NO: 9005 - RNA, 19 nt, Artificial Sequence
  RNA Oligomer
caacauuuauaucagucca

SEQ ID NO: 9006 - RNA, 19 nt, Artificial Sequence
  RNA Oligomer
cugaaauacaauguggcau

SEQ ID NO: 9007 - RNA, 19 nt, Artificial Sequence
  RNA Oligomer
gcuauucugaaauacaaug

SEQ ID NO: 9008 - RNA, 19 nt, Artificial Sequence
  RNA Oligomer
caaaacuugaaggaugcua

SEQ ID NO: 9009 - RNA, 19 nt, Artificial Sequence
  RNA Oligomer
caccucaccuuucuccaga

SEQ ID NO: 9010 - RNA, 19 nt, Artificial Sequence
  RNA Oligomer
ggaagaucccuaaauacgu

SEQ ID NO: 9011 - RNA, 19 nt, Artificial Sequence
  RNA Oligomer
cagaaauucuaagcaacau

SEQ ID NO: 9012 - RNA, 19 nt, Artificial Sequence
  RNA Oligomer
gcagaaauucuaagcaaca

SEQ ID NO: 9013 - RNA, 19 nt, Artificial Sequence
  RNA Oligomer
caccucgcuuguuuucaaa

SEQ ID NO: 9014 - RNA, 19 nt, Artificial Sequence
  RNA Oligomer
ccaauuugaaggaggagag

SEQ ID NO: 9015 - RNA, 19 nt, Artificial Sequence
  RNA Oligomer
gaauuuaggaaacgguacu

SEQ ID NO: 9016 - RNA, 19 nt, Artificial Sequence
  RNA Oligomer
gacgcugacauugaauuua

SEQ ID NO: 9017 - RNA, 19 nt, Artificial Sequence
  RNA Oligomer
cagguuuugaugaacaaga

SEQ ID NO: 9018 - RNA, 19 nt, Artificial Sequence
  RNA Oligomer
ccauuugagaaggaaagug

SEQ ID NO: 9019 - RNA, 19 nt, Artificial Sequence
  RNA Oligomer
guugucagcaagaugagau

SEQ ID NO: 9020 - RNA, 19 nt, Artificial Sequence
  RNA Oligomer
gccaaaagccaccagaagu

SEQ ID NO: 9021 - RNA, 19 nt, Artificial Sequence
  RNA Oligomer
gcagacuacggaagaugaa

SEQ ID NO: 9022 - RNA, 19 nt, Artificial Sequence
  RNA Oligomer
gagacaaucaacaguuucu

SEQ ID NO: 9023 - RNA, 19 nt, Artificial Sequence
  RNA Oligomer
gugaaccucaaacaguaac

SEQ ID NO: 9024 - RNA, 19 nt, Artificial Sequence
  RNA Oligomer
gcagcuuuuggaaagugaa

SEQ ID NO: 9025 - RNA, 19 nt, Artificial Sequence
  RNA Oligomer
cguaugcucuuuaagugug

SEQ ID NO: 9026 - RNA, 19 nt, Artificial Sequence
  RNA Oligomer
gucagaaacucccauauca

SEQ ID NO: 9027 - RNA, 19 nt, Artificial Sequence
  RNA Oligomer
cugaugugguguaaagaaa

SEQ ID NO: 9028 - RNA, 19 nt, Artificial Sequence
  RNA Oligomer
ccuccuagguuaaaauagu

SEQ ID NO: 9029 - RNA, 19 nt, Artificial Sequence
  RNA Oligomer
ccuuccacucaacucuuaa

SEQ ID NO: 9030 - RNA, 19 nt, Artificial Sequence
  RNA Oligomer
cuuucuuccugcccauaua

SEQ ID NO: 9031 - RNA, 19 nt, Artificial Sequence
  RNA Oligomer
uguacauaauccacauuug

SEQ ID NO: 9032 - RNA, 19 nt, Artificial Sequence
  RNA Oligomer
cuacgauacuacaaugaag

SEQ ID NO: 9033 - RNA, 19 nt, Artificial Sequence
  RNA Oligomer
cugaaaaaaguacacagua

SEQ ID NO: 9034 - RNA, 19 nt, Artificial Sequence
  RNA Oligomer
gcaugcacauuuuccuuac

SEQ ID NO: 9035 - RNA, 19 nt, Artificial Sequence
  RNA Oligomer
gagagacauuuacagcaug

SEQ ID NO: 9036 - RNA, 19 nt, Artificial Sequence
  RNA Oligomer
ugagcgagaugugguuuau

SEQ ID NO: 9037 - RNA, 19 nt, Artificial Sequence
  RNA Oligomer
ggugaugccagguuaaaag

SEQ ID NO: 9038 - RNA, 19 nt, Artificial Sequence
  RNA Oligomer
caaggcuuacuguggauuu

SEQ ID NO: 9039 - RNA, 19 nt, Artificial Sequence
  RNA Oligomer
acaaggcuuacuguggauu

SEQ ID NO: 9040 - RNA, 19 nt, Artificial Sequence
  RNA Oligomer
cgaaucaaagcggcgcauu

SEQ ID NO: 9041 - RNA, 19 nt, Artificial Sequence
  RNA Oligomer
cuaauuaucacagguacug

SEQ ID NO: 9042 - RNA, 19 nt, Artificial Sequence
  RNA Oligomer
gucuaauuaucacagguac

SEQ ID NO: 9043 - RNA, 19 nt, Artificial Sequence
  RNA Oligomer
gcuuuuuaaucaauccuga

SEQ ID NO: 9044 - RNA, 19 nt, Artificial Sequence
  RNA Oligomer
gaaauccgcuuuuuaauca

SEQ ID NO: 9045 - RNA, 19 nt, Artificial Sequence
  RNA Oligomer
cgaagguaccauagaagaa

SEQ ID NO: 9046 - RNA, 19 nt, Artificial Sequence
  RNA Oligomer
ggugacauuuacaagacag

SEQ ID NO: 9047 - RNA, 19 nt, Artificial Sequence
  RNA Oligomer
agaugaaaucggaguauuc

SEQ ID NO: 9048 - RNA, 19 nt, Artificial Sequence
  RNA Oligomer
aggaacagauugccagucu

SEQ ID NO: 9049 - RNA, 19 nt, Artificial Sequence
  RNA Oligomer
ccugaaacagaagaugaau

SEQ ID NO: 9050 - RNA, 19 nt, Artificial Sequence
  RNA Oligomer
ccaauaccacuccugaaac

SEQ ID NO: 9051 - RNA, 19 nt, Artificial Sequence
  RNA Oligomer
cagcggaaucagaaaguuu

SEQ ID NO: 9052 - RNA, 19 nt, Artificial Sequence
  RNA Oligomer
gacagcggaaucagaaagu

SEQ ID NO: 9053 - RNA, 19 nt, Artificial Sequence
  RNA Oligomer
acauuuauaucaguccauc

SEQ ID NO: 9054 - RNA, 19 nt, Artificial Sequence
  RNA Oligomer
cuuuacagcuuugaucgau

SEQ ID NO: 9055 - RNA, 19 nt, Artificial Sequence
  RNA Oligomer
uguggcauauucuaagaaa

SEQ ID NO: 9056 - RNA, 19 nt, Artificial Sequence
  RNA Oligomer
aaggaugcuauucugaaau

SEQ ID NO: 9057 - RNA, 19 nt, Artificial Sequence
  RNA Oligomer
ccaaaacuugaaggaugcu

SEQ ID NO: 9058 - RNA, 19 nt, Artificial Sequence
  RNA Oligomer
guagaucuuuugcgagcag

SEQ ID NO: 9059 - RNA, 19 nt, Artificial Sequence
  RNA Oligomer
guggugggaaagugaacga

SEQ ID NO: 9060 - RNA, 19 nt, Artificial Sequence
  RNA Oligomer
acagaagaaaagaacagug

SEQ ID NO: 9061 - RNA, 19 nt, Artificial Sequence
  RNA Oligomer
gcagaggacagaagaaaag

SEQ ID NO: 9062 - RNA, 19 nt, Artificial Sequence
  RNA Oligomer
cagaucauuucaugagacu

SEQ ID NO: 9063 - RNA, 19 nt, Artificial Sequence
  RNA Oligomer
gcaacauggaaaaaaggau

SEQ ID NO: 9064 - RNA, 19 nt, Artificial Sequence
  RNA Oligomer
agagucgcacuggaaugaa

SEQ ID NO: 9065 - RNA, 19 nt, Artificial Sequence
  RNA Oligomer
cucuacuaagggcggugaa

SEQ ID NO: 9066 - RNA, 19 nt, Artificial Sequence
  RNA Oligomer
gacauugaauuuaggaaac

SEQ ID NO: 9067 - RNA, 19 nt, Artificial Sequence
  RNA Oligomer
acgcugacauugaauuuag

SEQ ID NO: 9068 - RNA, 19 nt, Artificial Sequence
  RNA Oligomer
ccagguuuugaugaacaag

SEQ ID NO: 9069 - RNA, 19 nt, Artificial Sequence
  RNA Oligomer
gcaagaugagauagaugug

SEQ ID NO: 9070 - RNA, 19 nt, Artificial Sequence
  RNA Oligomer
agcaagaugagauagaugu

SEQ ID NO: 9071 - RNA, 19 nt, Artificial Sequence
  RNA Oligomer
uugucagcaagaugagaua

SEQ ID NO: 9072 - RNA, 19 nt, Artificial Sequence
  RNA Oligomer
cagaagugcagcaagucuu

SEQ ID NO: 9073 - RNA, 19 nt, Artificial Sequence
  RNA Oligomer
ccagaagugcagcaagucu

SEQ ID NO: 9074 - RNA, 19 nt, Artificial Sequence
  RNA Oligomer
ggaagaugaacaggccaga

SEQ ID NO: 9075 - RNA, 19 nt, Artificial Sequence
  RNA Oligomer
acaaucaacaguuucucac

SEQ ID NO: 9076 - RNA, 19 nt, Artificial Sequence
  RNA Oligomer
agauagugaagagaauaga

SEQ ID NO: 9077 - RNA, 19 nt, Artificial Sequence
  RNA Oligomer
cagauagugaagagaauag

SEQ ID NO: 9078 - RNA, 19 nt, Artificial Sequence
  RNA Oligomer
acagauagugaagagaaua

SEQ ID NO: 9079 - RNA, 19 nt, Artificial Sequence
  RNA Oligomer
cucccauaucaucuauauu

SEQ ID NO: 9080 - RNA, 19 nt, Artificial Sequence
  RNA Oligomer
aaacucccauaucaucuau

SEQ ID NO: 9081 - RNA, 19 nt, Artificial Sequence
  RNA Oligomer
ucagaaacucccauaucau

SEQ ID NO: 9082 - RNA, 19 nt, Artificial Sequence
  RNA Oligomer
ggguuuuuuucauaugugu

SEQ ID NO: 9083 - RNA, 19 nt, Artificial Sequence
  RNA Oligomer
gcuugcauuguuuaaguuu

SEQ ID NO: 9084 - RNA, 19 nt, Artificial Sequence
  RNA Oligomer
gugcaguugucaguuggua

SEQ ID NO: 9085 - RNA, 19 nt, Artificial Sequence
  RNA Oligomer
gcuacgauacuacaaugaa

SEQ ID NO: 9086 - RNA, 19 nt, Artificial Sequence
  RNA Oligomer
ugaugagagacauuuacag

SEQ ID NO: 9087 - RNA, 19 nt, Artificial Sequence
  RNA Oligomer
ccagguuaaaagccuuaau

SEQ ID NO: 9088 - RNA, 19 nt, Artificial Sequence
  RNA Oligomer
gaaugucuaauuaucacag

SEQ ID NO: 9089 - RNA, 19 nt, Artificial Sequence
  RNA Oligomer
acgauugcaugucacuuac

SEQ ID NO: 9090 - RNA, 19 nt, Artificial Sequence
  RNA Oligomer
gugacauuuacaagacaga

SEQ ID NO: 9091 - RNA, 19 nt, Artificial Sequence
  RNA Oligomer
uggugacauuuacaagaca

SEQ ID NO: 9092 - RNA, 19 nt, Artificial Sequence
  RNA Oligomer
cuggguuggugacauuuac

SEQ ID NO: 9093 - RNA, 19 nt, Artificial Sequence
  RNA Oligomer
guuacccagacauuaacuu

SEQ ID NO: 9094 - RNA, 19 nt, Artificial Sequence
  RNA Oligomer
agccaauaccacuccugaa

SEQ ID NO: 9095 - RNA, 19 nt, Artificial Sequence
  RNA Oligomer
gcauauucuaagaaauggg

SEQ ID NO: 9096 - RNA, 19 nt, Artificial Sequence
  RNA Oligomer
ggcauauucuaagaaaugg

SEQ ID NO: 9097 - RNA, 19 nt, Artificial Sequence
  RNA Oligomer
gcucauucagacugcacuu

SEQ ID NO: 9098 - RNA, 19 nt, Artificial Sequence
  RNA Oligomer
caaaauuuguacccagugg

SEQ ID NO: 9099 - RNA, 19 nt, Artificial Sequence
  RNA Oligomer
acaaaauuuguacccagug

SEQ ID NO: 9100 - RNA, 19 nt, Artificial Sequence
  RNA Oligomer
uugaggagaugagaagaau

SEQ ID NO: 9101 - RNA, 19 nt, Artificial Sequence
  RNA Oligomer
auacguuccaccucaccuu

SEQ ID NO: 9102 - RNA, 19 nt, Artificial Sequence
  RNA Oligomer
guacucuacuaagggcggu

SEQ ID NO: 9103 - RNA, 19 nt, Artificial Sequence
  RNA Oligomer
cugacauugaauuuaggaa

SEQ ID NO: 9104 - RNA, 19 nt, Artificial Sequence
  RNA Oligomer
gagacgcugacauugaauu

SEQ ID NO: 9105 - RNA, 19 nt, Artificial Sequence
  RNA Oligomer
cucccaaacagcaaauaaa

SEQ ID NO: 9106 - RNA, 19 nt, Artificial Sequence
  RNA Oligomer
ccagagaguccauugucag

SEQ ID NO: 9107 - RNA, 19 nt, Artificial Sequence
  RNA Oligomer
ugaucacagugacacagau

SEQ ID NO: 9108 - RNA, 19 nt, Artificial Sequence
  RNA Oligomer
gugugucuauaugugagca

SEQ ID NO: 9109 - RNA, 19 nt, Artificial Sequence
  RNA Oligomer
aacucccauaucaucuaua

SEQ ID NO: 9110 - RNA, 19 nt, Artificial Sequence
  RNA Oligomer
aaguuucucugguauucaa

SEQ ID NO: 9111 - RNA, 19 nt, Artificial Sequence
  RNA Oligomer
acauauugaaguuucucug

SEQ ID NO: 9112 - RNA, 19 nt, Artificial Sequence
  RNA Oligomer
gacuaauguuucuuuugug

SEQ ID NO: 9113 - RNA, 19 nt, Artificial Sequence
  RNA Oligomer
ugguguaaagaaaacagau

SEQ ID NO: 9114 - RNA, 19 nt, Artificial Sequence
  RNA Oligomer
ccugaugugguguaaagaa

SEQ ID NO: 9115 - RNA, 19 nt, Artificial Sequence
  RNA Oligomer
uuccucugaucaguauuuu

SEQ ID NO: 9116 - RNA, 19 nt, Artificial Sequence
  RNA Oligomer
augcuugcauuguuuaagu

SEQ ID NO: 9117 - RNA, 19 nt, Artificial Sequence
  RNA Oligomer
gcagcaauguguaaguggc

SEQ ID NO: 9118 - RNA, 19 nt, Artificial Sequence
  RNA Oligomer
cccauauauuauaccaguu

SEQ ID NO: 9119 - RNA, 19 nt, Artificial Sequence
  RNA Oligomer
agacugcagcaauguguaa

SEQ ID NO: 9120 - RNA, 19 nt, Artificial Sequence
  RNA Oligomer
caguugucaguugguacau

SEQ ID NO: 9121 - RNA, 19 nt, Artificial Sequence
  RNA Oligomer
agagaccgcugaccauuca

SEQ ID NO: 9122 - RNA, 19 nt, Artificial Sequence
  RNA Oligomer
ugcuacgauacuacaauga

SEQ ID NO: 9123 - RNA, 19 nt, Artificial Sequence
  RNA Oligomer
guugcuacgauacuacaau

SEQ ID NO: 9124 - RNA, 19 nt, Artificial Sequence
  RNA Oligomer
gagauguguauaagcuguu

SEQ ID NO: 9125 - RNA, 19 nt, Artificial Sequence
  RNA Oligomer
ggagauguguauaagcugu

SEQ ID NO: 9126 - RNA, 19 nt, Artificial Sequence
  RNA Oligomer
cacugaaaaaaguacacag

SEQ ID NO: 9127 - RNA, 19 nt, Artificial Sequence
  RNA Oligomer
cgagaugugguuuauuuca

SEQ ID NO: 9128 - RNA, 19 nt, Artificial Sequence
  RNA Oligomer
cugagcgagaugugguuua

SEQ ID NO: 9129 - RNA, 19 nt, Artificial Sequence
  RNA Oligomer
gaacaaggcuuacugugga

SEQ ID NO: 9130 - RNA, 19 nt, Artificial Sequence
  RNA Oligomer
gaaaaugagacgcgagcug

SEQ ID NO: 9131 - RNA, 19 nt, Artificial Sequence
  RNA Oligomer
cugagaaaaugagacgcga

SEQ ID NO: 9132 - RNA, 19 nt, Artificial Sequence
  RNA Oligomer
ccaucgaugcucuucacuu

SEQ ID NO: 9133 - RNA, 19 nt, Artificial Sequence
  RNA Oligomer
ucagcuaagucuugauaag

SEQ ID NO: 9134 - RNA, 19 nt, Artificial Sequence
  RNA Oligomer
cauagaagaaaauggccaa

SEQ ID NO: 9135 - RNA, 19 nt, Artificial Sequence
  RNA Oligomer
augggaaagaugugaaaaa

SEQ ID NO: 9136 - RNA, 19 nt, Artificial Sequence
  RNA Oligomer
cgaaucccgaaucaaagcg

SEQ ID NO: 9137 - RNA, 19 nt, Artificial Sequence
  RNA Oligomer
gacauuuacaagacagagu

SEQ ID NO: 9138 - RNA, 19 nt, Artificial Sequence
  RNA Oligomer
ugaaaucggaguauucuag

SEQ ID NO: 9139 - RNA, 19 nt, Artificial Sequence
  RNA Oligomer
acgaaaugcuaagaugaaa

SEQ ID NO: 9140 - RNA, 19 nt, Artificial Sequence
  RNA Oligomer
ccugauauggugaaaauug

SEQ ID NO: 9141 - RNA, 19 nt, Artificial Sequence
  RNA Oligomer
uucuaagaaaugggacuuu

SEQ ID NO: 9142 - RNA, 19 nt, Artificial Sequence
  RNA Oligomer
ugggagcucauucagacug

SEQ ID NO: 9143 - RNA, 19 nt, Artificial Sequence
  RNA Oligomer
auguuaaaaugccuuguuc

SEQ ID NO: 9144 - RNA, 19 nt, Artificial Sequence
  RNA Oligomer
gguagaucuuuugcgagca

SEQ ID NO: 9145 - RNA, 19 nt, Artificial Sequence
  RNA Oligomer
ggguagaucuuuugcgagc

SEQ ID NO: 9146 - RNA, 19 nt, Artificial Sequence
  RNA Oligomer
cggguagaucuuuugcgag

SEQ ID NO: 9147 - RNA, 19 nt, Artificial Sequence
  RNA Oligomer
ucggguagaucuuuugcga

SEQ ID NO: 9148 - RNA, 19 nt, Artificial Sequence
  RNA Oligomer
cguuccaccucaccuuucu

SEQ ID NO: 9149 - RNA, 19 nt, Artificial Sequence
  RNA Oligomer
caaacaucaaagaacagaa

SEQ ID NO: 9150 - RNA, 19 nt, Artificial Sequence
  RNA Oligomer
ccaaacaucaaagaacaga

SEQ ID NO: 9151 - RNA, 19 nt, Artificial Sequence
  RNA Oligomer
gacagaagaaaagaacagu

SEQ ID NO: 9152 - RNA, 19 nt, Artificial Sequence
  RNA Oligomer
agaaauucuaagcaacaug

SEQ ID NO: 9153 - RNA, 19 nt, Artificial Sequence
  RNA Oligomer
acauugaauuuaggaaacg

SEQ ID NO: 9154 - RNA, 19 nt, Artificial Sequence
  RNA Oligomer
cgcugacauugaauuuagg

SEQ ID NO: 9155 - RNA, 19 nt, Artificial Sequence
  RNA Oligomer
agacgcugacauugaauuu

SEQ ID NO: 9156 - RNA, 19 nt, Artificial Sequence
  RNA Oligomer
agagacgcugacauugaau

SEQ ID NO: 9157 - RNA, 19 nt, Artificial Sequence
  RNA Oligomer
uaguugucaagacucagaa

SEQ ID NO: 9158 - RNA, 19 nt, Artificial Sequence
  RNA Oligomer
gugccagagaguccauugu

SEQ ID NO: 9159 - RNA, 19 nt, Artificial Sequence
  RNA Oligomer
uggugccagagaguccauu

SEQ ID NO: 9160 - RNA, 19 nt, Artificial Sequence
  RNA Oligomer
agaugagauagauguggug

SEQ ID NO: 9161 - RNA, 19 nt, Artificial Sequence
  RNA Oligomer
gggaagacugugcaaguug

SEQ ID NO: 9162 - RNA, 19 nt, Artificial Sequence
  RNA Oligomer
agaugaacaggccagagaa

SEQ ID NO: 9163 - RNA, 19 nt, Artificial Sequence
  RNA Oligomer
agaaagcaggcgaguguuu

SEQ ID NO: 9164 - RNA, 19 nt, Artificial Sequence
  RNA Oligomer
cuaaauaaaauuggacugg

SEQ ID NO: 9165 - RNA, 19 nt, Artificial Sequence
  RNA Oligomer
gagcagcuuuuggaaagug

SEQ ID NO: 9166 - RNA, 19 nt, Artificial Sequence
  RNA Oligomer
acacggagcagcuuuugga

SEQ ID NO: 9167 - RNA, 19 nt, Artificial Sequence
  RNA Oligomer
ugaaguuucucugguauuc

SEQ ID NO: 9168 - RNA, 19 nt, Artificial Sequence
  RNA Oligomer
gaugaaaggaaauguggaa

SEQ ID NO: 9169 - RNA, 19 nt, Artificial Sequence
  RNA Oligomer
uccucugaucaguauuuuu

SEQ ID NO: 9170 - RNA, 19 nt, Artificial Sequence
  RNA Oligomer
gagguaucauuuuuaucug

SEQ ID NO: 9171 - RNA, 19 nt, Artificial Sequence
  RNA Oligomer
cacaugugcaguugucagu

SEQ ID NO: 9172 - RNA, 19 nt, Artificial Sequence
  RNA Oligomer
cacuguuggagauguguau

SEQ ID NO: 9173 - RNA, 19 nt, Artificial Sequence
  RNA Oligomer
ccguccuggaguuucuuca

SEQ ID NO: 9174 - RNA, 19 nt, Artificial Sequence
  RNA Oligomer
aacaaggcuuacuguggau

SEQ ID NO: 9175 - RNA, 19 nt, Artificial Sequence
  RNA Oligomer
caggacuugugcaagaaga

SEQ ID NO: 9176 - RNA, 19 nt, Artificial Sequence
  RNA Oligomer
gcaggacuugugcaagaag

SEQ ID NO: 9177 - RNA, 19 nt, Artificial Sequence
  RNA Oligomer
acagguggauuuugcaaau

SEQ ID NO: 9178 - RNA, 19 nt, Artificial Sequence
  RNA Oligomer
cgauugcaugucacuuacg

SEQ ID NO: 9179 - RNA, 19 nt, Artificial Sequence
  RNA Oligomer
aaaucggaguauucuaguu

SEQ ID NO: 9180 - RNA, 19 nt, Artificial Sequence
  RNA Oligomer
gcaggaacagauugccagu

SEQ ID NO: 9181 - RNA, 19 nt, Artificial Sequence
  RNA Oligomer
cucaacauuuauaucaguc

SEQ ID NO: 9182 - RNA, 19 nt, Artificial Sequence
  RNA Oligomer
agcucaacauuuauaucag

SEQ ID NO: 9183 - RNA, 19 nt, Artificial Sequence
  RNA Oligomer
cugggauaagguacuugaa

SEQ ID NO: 9184 - RNA, 19 nt, Artificial Sequence
  RNA Oligomer
aggaaucaagacagcggaa

SEQ ID NO: 9185 - RNA, 19 nt, Artificial Sequence
  RNA Oligomer
uggcauauucuaagaaaug

SEQ ID NO: 9186 - RNA, 19 nt, Artificial Sequence
  RNA Oligomer
auguggcauauucuaagaa

SEQ ID NO: 9187 - RNA, 19 nt, Artificial Sequence
  RNA Oligomer
ugaaggaugcuauucugaa

SEQ ID NO: 9188 - RNA, 19 nt, Artificial Sequence
  RNA Oligomer
aaaacuugaaggaugcuau

SEQ ID NO: 9189 - RNA, 19 nt, Artificial Sequence
  RNA Oligomer
cucauucagacugcacuuc

SEQ ID NO: 9190 - RNA, 19 nt, Artificial Sequence
  RNA Oligomer
caacauggaaaaaaggauu

SEQ ID NO: 9191 - RNA, 19 nt, Artificial Sequence
  RNA Oligomer
ccauugucagauguuggcu

SEQ ID NO: 9192 - RNA, 19 nt, Artificial Sequence
  RNA Oligomer
agauagauguggugccaga

SEQ ID NO: 9193 - RNA, 19 nt, Artificial Sequence
  RNA Oligomer
ugagauagauguggugcca

SEQ ID NO: 9194 - RNA, 19 nt, Artificial Sequence
  RNA Oligomer
agcagcuuuuggaaaguga

SEQ ID NO: 9195 - RNA, 19 nt, Artificial Sequence
  RNA Oligomer
aaauuggacuggugggaaa

SEQ ID NO: 9196 - RNA, 19 nt, Artificial Sequence
  RNA Oligomer
acggagcagcuuuuggaaa

SEQ ID NO: 9197 - RNA, 19 nt, Artificial Sequence
  RNA Oligomer
uugucagaaacucccauau

SEQ ID NO: 9198 - RNA, 19 nt, Artificial Sequence
  RNA Oligomer
cugagaugaaaggaaaugu

SEQ ID NO: 9199 - RNA, 19 nt, Artificial Sequence
  RNA Oligomer
gacguccuguuugagcugu

SEQ ID NO: 9200 - RNA, 19 nt, Artificial Sequence
  RNA Oligomer
gacaucaagcuuuauccau

SEQ ID NO: 9201 - RNA, 19 nt, Artificial Sequence
  RNA Oligomer
ugcacauuuuccuuacuga

SEQ ID NO: 9202 - RNA, 19 nt, Artificial Sequence
  RNA Oligomer
agcaugcacauuuuccuua

SEQ ID NO: 9203 - RNA, 19 nt, Artificial Sequence
  RNA Oligomer
gagcgagaugugguuuauu

SEQ ID NO: 9204 - RNA, 19 nt, Artificial Sequence
  RNA Oligomer
ugagacgcgagcugaacaa

SEQ ID NO: 9205 - RNA, 19 nt, Artificial Sequence
  RNA Oligomer
gcugagacauaucguuggu

SEQ ID NO: 9206 - RNA, 19 nt, Artificial Sequence
  RNA Oligomer
gcuaagucuugauaaguca

SEQ ID NO: 9207 - RNA, 19 nt, Artificial Sequence
  RNA Oligomer
agcuaagucuugauaaguc

SEQ ID NO: 9208 - RNA, 19 nt, Artificial Sequence
  RNA Oligomer
cucagcuaagucuugauaa

SEQ ID NO: 9209 - RNA, 19 nt, Artificial Sequence
  RNA Oligomer
ucucagcuaagucuugaua

SEQ ID NO: 9210 - RNA, 19 nt, Artificial Sequence
  RNA Oligomer
ugauuauuucacggcucuu

SEQ ID NO: 9211 - RNA, 19 nt, Artificial Sequence
  RNA Oligomer
uccgcuuuuuaaucaaucc

SEQ ID NO: 9212 - RNA, 19 nt, Artificial Sequence
  RNA Oligomer
aggacuugugcaagaagaa

SEQ ID NO: 9213 - RNA, 19 nt, Artificial Sequence
  RNA Oligomer
ucguuuuguuggagguggu

SEQ ID NO: 9214 - RNA, 19 nt, Artificial Sequence
  RNA Oligomer
gaguucuguacaaaaagau

SEQ ID NO: 9215 - RNA, 19 nt, Artificial Sequence
  RNA Oligomer
ucacuuacgaagguaccau

SEQ ID NO: 9216 - RNA, 19 nt, Artificial Sequence
  RNA Oligomer
gcucuucugcuacuuuaga

SEQ ID NO: 9217 - RNA, 19 nt, Artificial Sequence
  RNA Oligomer
caggaacagauugccaguc

SEQ ID NO: 9218 - RNA, 19 nt, Artificial Sequence
  RNA Oligomer
ucaacauuuauaucagucc

SEQ ID NO: 9219 - RNA, 19 nt, Artificial Sequence
  RNA Oligomer
cuaagaaaugggacuuuac

SEQ ID NO: 9220 - RNA, 19 nt, Artificial Sequence
  RNA Oligomer
acaauguggcauauucuaa

SEQ ID NO: 9221 - RNA, 19 nt, Artificial Sequence
  RNA Oligomer
aaagauuugugggauaaca

SEQ ID NO: 9222 - RNA, 19 nt, Artificial Sequence
  RNA Oligomer
cauggaaaaaaggauucua

SEQ ID NO: 9223 - RNA, 19 nt, Artificial Sequence
  RNA Oligomer
ccucccaaacagcaaauaa

SEQ ID NO: 9224 - RNA, 19 nt, Artificial Sequence
  RNA Oligomer
gaaauucuccuccauuuga

SEQ ID NO: 9225 - RNA, 19 nt, Artificial Sequence
  RNA Oligomer
agacuacggaagaugaaca

SEQ ID NO: 9226 - RNA, 19 nt, Artificial Sequence
  RNA Oligomer
aaagcagacuacggaagau

SEQ ID NO: 9227 - RNA, 19 nt, Artificial Sequence
  RNA Oligomer
accagagcaguuuaguaau

SEQ ID NO: 9228 - RNA, 19 nt, Artificial Sequence
  RNA Oligomer
aaauaaaauuggacuggug

SEQ ID NO: 9229 - RNA, 19 nt, Artificial Sequence
  RNA Oligomer
gaaguuucucugguauuca

SEQ ID NO: 9230 - RNA, 19 nt, Artificial Sequence
  RNA Oligomer
cugcagcaauguguaagug

SEQ ID NO: 9231 - RNA, 19 nt, Artificial Sequence
  RNA Oligomer
gacgcaaucucuuccacac

SEQ ID NO: 9232 - RNA, 19 nt, Artificial Sequence
  RNA Oligomer
accagacaucaagcuuuau

SEQ ID NO: 9233 - RNA, 19 nt, Artificial Sequence
  RNA Oligomer
cuggaccagacaucaagcu

SEQ ID NO: 9234 - RNA, 19 nt, Artificial Sequence
  RNA Oligomer
agauguguauaagcuguug

SEQ ID NO: 9235 - RNA, 19 nt, Artificial Sequence
  RNA Oligomer
ugagagacauuuacagcau

SEQ ID NO: 9236 - RNA, 19 nt, Artificial Sequence
  RNA Oligomer
gcgagaugugguuuauuuc

SEQ ID NO: 9237 - RNA, 19 nt, Artificial Sequence
  RNA Oligomer
agcugagcgagaugugguu

SEQ ID NO: 9238 - RNA, 19 nt, Artificial Sequence
  RNA Oligomer
gccagguuaaaagccuuaa

SEQ ID NO: 9239 - RNA, 19 nt, Artificial Sequence
  RNA Oligomer
caugucacuuacgaaggua

SEQ ID NO: 9240 - RNA, 19 nt, Artificial Sequence
  RNA Oligomer
ugaguucuguacaaaaaga

SEQ ID NO: 9241 - RNA, 19 nt, Artificial Sequence
  RNA Oligomer
gaugaguucuguacaaaaa

SEQ ID NO: 9242 - RNA, 19 nt, Artificial Sequence
  RNA Oligomer
caauguggcauauucuaag

SEQ ID NO: 9243 - RNA, 19 nt, Artificial Sequence
  RNA Oligomer
agaugagaauggugagcga

SEQ ID NO: 9244 - RNA, 19 nt, Artificial Sequence
  RNA Oligomer
aaagaacagaaaggaagau

SEQ ID NO: 9245 - RNA, 19 nt, Artificial Sequence
  RNA Oligomer
acauggaaaaaaggauucu

SEQ ID NO: 9246 - RNA, 19 nt, Artificial Sequence
  RNA Oligomer
agaagcagaugaggagaca

SEQ ID NO: 9247 - RNA, 19 nt, Artificial Sequence
  RNA Oligomer
gacuacggaagaugaacag

SEQ ID NO: 9248 - RNA, 19 nt, Artificial Sequence
  RNA Oligomer
ugguaccagagcaguuuag

SEQ ID NO: 9249 - RNA, 19 nt, Artificial Sequence
  RNA Oligomer
ggcauauucauauaaccaa

SEQ ID NO: 9250 - RNA, 19 nt, Artificial Sequence
  RNA Oligomer
gcccauauauuauaccagu

SEQ ID NO: 9251 - RNA, 19 nt, Artificial Sequence
  RNA Oligomer
caugcacauuuuccuuacu

SEQ ID NO: 9252 - RNA, 19 nt, Artificial Sequence
  RNA Oligomer
gccaucgaugcucuucacu

SEQ ID NO: 9253 - RNA, 19 nt, Artificial Sequence
  RNA Oligomer
guugauuauuucacggcuc

SEQ ID NO: 9254 - RNA, 19 nt, Artificial Sequence
  RNA Oligomer
ucggaguauucuaguuacc

SEQ ID NO: 9255 - RNA, 19 nt, Artificial Sequence
  RNA Oligomer
caacugguauaauauaugg

SEQ ID NO: 9256 - RNA, 19 nt, Artificial Sequence
  RNA Oligomer
guguuucccuucauuuugc

SEQ ID NO: 9257 - RNA, 19 nt, Artificial Sequence
  RNA Oligomer
uguuucccuucauuuugcc

SEQ ID NO: 9258 - RNA, 19 nt, Artificial Sequence
  RNA Oligomer
gucguguaaauuuguugag

SEQ ID NO: 9259 - RNA, 19 nt, Artificial Sequence
  RNA Oligomer
uuucccuucauuuugccac

SEQ ID NO: 9260 - RNA, 19 nt, Artificial Sequence
  RNA Oligomer
auugaaguuaaugucuggg

SEQ ID NO: 9261 - RNA, 19 nt, Artificial Sequence
  RNA Oligomer
uugauugucucuauucucu

SEQ ID NO: 9262 - RNA, 19 nt, Artificial Sequence
  RNA Oligomer
aaucaguuaaagagauucc

SEQ ID NO: 9263 - RNA, 19 nt, Artificial Sequence
  RNA Oligomer
cagcaugguauaugaaugg

SEQ ID NO: 9264 - RNA, 19 nt, Artificial Sequence
  RNA Oligomer
gauugaaguuaaugucugg

SEQ ID NO: 9265 - RNA, 19 nt, Artificial Sequence
  RNA Oligomer
aucuuagcauuucgucgug

SEQ ID NO: 9266 - RNA, 19 nt, Artificial Sequence
  RNA Oligomer
gggucguguaaauuuguug

SEQ ID NO: 9267 - RNA, 19 nt, Artificial Sequence
  RNA Oligomer
ggucguguaaauuuguuga

SEQ ID NO: 9268 - RNA, 19 nt, Artificial Sequence
  RNA Oligomer
auuccuuuaguguccaucc

SEQ ID NO: 9269 - RNA, 19 nt, Artificial Sequence
  RNA Oligomer
uuucugcauucuacauuca

SEQ ID NO: 9270 - RNA, 19 nt, Artificial Sequence
  RNA Oligomer
cugcauucuacauucaggc

SEQ ID NO: 9271 - RNA, 19 nt, Artificial Sequence
  RNA Oligomer
auguaaucuaacuucaccg

SEQ ID NO: 9272 - RNA, 19 nt, Artificial Sequence
  RNA Oligomer
uaaucuaacuucaccgccc

SEQ ID NO: 9273 - RNA, 19 nt, Artificial Sequence
  RNA Oligomer
auugucucuauucucuuca

SEQ ID NO: 9274 - RNA, 19 nt, Artificial Sequence
  RNA Oligomer
uaggagguuugcauuaugc

SEQ ID NO: 9275 - RNA, 19 nt, Artificial Sequence
  RNA Oligomer
aagcauauuaagaguugag

SEQ ID NO: 9276 - RNA, 19 nt, Artificial Sequence
  RNA Oligomer
auucuucauuguaguaucg

SEQ ID NO: 9277 - RNA, 19 nt, Artificial Sequence
  RNA Oligomer
caauaucuguauuaaggcu

SEQ ID NO: 9278 - RNA, 19 nt, Artificial Sequence
  RNA Oligomer
aaauccaccuguagcaugc

SEQ ID NO: 9279 - RNA, 19 nt, Artificial Sequence
  RNA Oligomer
uugaaguuaaugucugggu

SEQ ID NO: 9280 - RNA, 19 nt, Artificial Sequence
  RNA Oligomer
aucauggauucuauucuug

SEQ ID NO: 9281 - RNA, 19 nt, Artificial Sequence
  RNA Oligomer
aagacuggcaaucuguucc

SEQ ID NO: 9282 - RNA, 19 nt, Artificial Sequence
  RNA Oligomer
auccaaacuuucugauucc

SEQ ID NO: 9283 - RNA, 19 nt, Artificial Sequence
  RNA Oligomer
guaaauuuguugagaagug

SEQ ID NO: 9284 - RNA, 19 nt, Artificial Sequence
  RNA Oligomer
cuugauuccuuuagugucc

SEQ ID NO: 9285 - RNA, 19 nt, Artificial Sequence
  RNA Oligomer
uuccuuuaguguccaucca

SEQ ID NO: 9286 - RNA, 19 nt, Artificial Sequence
  RNA Oligomer
ucaggcuagaaauauuucc

SEQ ID NO: 9287 - RNA, 19 nt, Artificial Sequence
  RNA Oligomer
aaucauucauuccagugcg

SEQ ID NO: 9288 - RNA, 19 nt, Artificial Sequence
  RNA Oligomer
uugcuuggaaccuugaagg

SEQ ID NO: 9289 - RNA, 19 nt, Artificial Sequence
  RNA Oligomer
uucuugucuagucaauuug

SEQ ID NO: 9290 - RNA, 19 nt, Artificial Sequence
  RNA Oligomer
aguaccaacauccucagag

SEQ ID NO: 9291 - RNA, 19 nt, Artificial Sequence
  RNA Oligomer
uuagauuuuaugugcucac

SEQ ID NO: 9292 - RNA, 19 nt, Artificial Sequence
  RNA Oligomer
uauagacacacuuaaagag

SEQ ID NO: 9293 - RNA, 19 nt, Artificial Sequence
  RNA Oligomer
guuauaugaauaugccuca

SEQ ID NO: 9294 - RNA, 19 nt, Artificial Sequence
  RNA Oligomer
aucagaggaaaaaagacag

SEQ ID NO: 9295 - RNA, 19 nt, Artificial Sequence
  RNA Oligomer
cacauaugaaaaaaacccu

SEQ ID NO: 9296 - RNA, 19 nt, Artificial Sequence
  RNA Oligomer
uuugccacuuacacauugc

SEQ ID NO: 9297 - RNA, 19 nt, Artificial Sequence
  RNA Oligomer
auggagggaguuuagaugu

SEQ ID NO: 9298 - RNA, 19 nt, Artificial Sequence
  RNA Oligomer
agcguuuuaaguuucuccg

SEQ ID NO: 9299 - RNA, 19 nt, Artificial Sequence
  RNA Oligomer
uacuccgauuucaucuuag

SEQ ID NO: 9300 - RNA, 19 nt, Artificial Sequence
  RNA Oligomer
ucuuagcauuucgucgugg

SEQ ID NO: 9301 - RNA, 19 nt, Artificial Sequence
  RNA Oligomer
uauuucagaauagcauccu

SEQ ID NO: 9302 - RNA, 19 nt, Artificial Sequence
  RNA Oligomer
uauaauguguuggaaaagg

SEQ ID NO: 9303 - RNA, 19 nt, Artificial Sequence
  RNA Oligomer
auuuccagguaguuuagca

SEQ ID NO: 9304 - RNA, 19 nt, Artificial Sequence
  RNA Oligomer
uguaaucuaacuucaccgc

SEQ ID NO: 9305 - RNA, 19 nt, Artificial Sequence
  RNA Oligomer
uauuugcuguuugggagga

SEQ ID NO: 9306 - RNA, 19 nt, Artificial Sequence
  RNA Oligomer
aucugcuucugagucuuga

SEQ ID NO: 9307 - RNA, 19 nt, Artificial Sequence
  RNA Oligomer
guaccaacauccucagagc

SEQ ID NO: 9308 - RNA, 19 nt, Artificial Sequence
  RNA Oligomer
uaccaacauccucagagcc

SEQ ID NO: 9309 - RNA, 19 nt, Artificial Sequence
  RNA Oligomer
aucuaucucaucuugcuga

SEQ ID NO: 9310 - RNA, 19 nt, Artificial Sequence
  RNA Oligomer
uucccuucauuuugccacu

SEQ ID NO: 9311 - RNA, 19 nt, Artificial Sequence
  RNA Oligomer
aaaaaagacagacaaacca

SEQ ID NO: 9312 - RNA, 19 nt, Artificial Sequence
  RNA Oligomer
ugguauaauauaugggcag

SEQ ID NO: 9313 - RNA, 19 nt, Artificial Sequence
  RNA Oligomer
aaacauaucuaaguccacg

SEQ ID NO: 9314 - RNA, 19 nt, Artificial Sequence
  RNA Oligomer
agcaugguauaugaaugga

SEQ ID NO: 9315 - RNA, 19 nt, Artificial Sequence
  RNA Oligomer
uucaucuuagcauuucguc

SEQ ID NO: 9316 - RNA, 19 nt, Artificial Sequence
  RNA Oligomer
ucaucuuagcauuucgucg

SEQ ID NO: 9317 - RNA, 19 nt, Artificial Sequence
  RNA Oligomer
guauuucagaauagcaucc

SEQ ID NO: 9318 - RNA, 19 nt, Artificial Sequence
  RNA Oligomer
aaauuuguugagaagugca

SEQ ID NO: 9319 - RNA, 19 nt, Artificial Sequence
  RNA Oligomer
auaauguguuggaaaaggu

SEQ ID NO: 9320 - RNA, 19 nt, Artificial Sequence
  RNA Oligomer
uguguuggaaaagguuuag

SEQ ID NO: 9321 - RNA, 19 nt, Artificial Sequence
  RNA Oligomer
guguuggaaaagguuuagg

SEQ ID NO: 9322 - RNA, 19 nt, Artificial Sequence
  RNA Oligomer
caagccacuucuuaucugg

SEQ ID NO: 9323 - RNA, 19 nt, Artificial Sequence
  RNA Oligomer
uucugcauucuacauucag

SEQ ID NO: 9324 - RNA, 19 nt, Artificial Sequence
  RNA Oligomer
auauuuccagguaguuuag

SEQ ID NO: 9325 - RNA, 19 nt, Artificial Sequence
  RNA Oligomer
aauguaaucuaacuucacc

SEQ ID NO: 9326 - RNA, 19 nt, Artificial Sequence
  RNA Oligomer
uucuuguucaucaaaaccu

SEQ ID NO: 9327 - RNA, 19 nt, Artificial Sequence
  RNA Oligomer
uagucugcuuugcauuugc

SEQ ID NO: 9328 - RNA, 19 nt, Artificial Sequence
  RNA Oligomer
uguugauugucucuauucu

SEQ ID NO: 9329 - RNA, 19 nt, Artificial Sequence
  RNA Oligomer
uugucucuauucucuucac

SEQ ID NO: 9330 - RNA, 19 nt, Artificial Sequence
  RNA Oligomer
auagacacacuuaaagagc

SEQ ID NO: 9331 - RNA, 19 nt, Artificial Sequence
  RNA Oligomer
aucaguuaaagagauuccu

SEQ ID NO: 9332 - RNA, 19 nt, Artificial Sequence
  RNA Oligomer
auuccuggauuucaacuug

SEQ ID NO: 9333 - RNA, 19 nt, Artificial Sequence
  RNA Oligomer
aacauaucuaaguccacgu

SEQ ID NO: 9334 - RNA, 19 nt, Artificial Sequence
  RNA Oligomer
auguguggaagagauugcg

SEQ ID NO: 9335 - RNA, 19 nt, Artificial Sequence
  RNA Oligomer
augucucucaucaauucug

SEQ ID NO: 9336 - RNA, 19 nt, Artificial Sequence
  RNA Oligomer
ccaauaucuguauuaaggc

SEQ ID NO: 9337 - RNA, 19 nt, Artificial Sequence
  RNA Oligomer
uuagcugagaaacauuuuc

SEQ ID NO: 9338 - RNA, 19 nt, Artificial Sequence
  RNA Oligomer
aucgugucaaggguuuuuc

SEQ ID NO: 9339 - RNA, 19 nt, Artificial Sequence
  RNA Oligomer
aaaaucuucaagacucugu

SEQ ID NO: 9340 - RNA, 19 nt, Artificial Sequence
  RNA Oligomer
ucgauugaaguuaaugucu

SEQ ID NO: 9341 - RNA, 19 nt, Artificial Sequence
  RNA Oligomer
caucuuagcauuucgucgu

SEQ ID NO: 9342 - RNA, 19 nt, Artificial Sequence
  RNA Oligomer
auugugauggaaugauuca

SEQ ID NO: 9343 - RNA, 19 nt, Artificial Sequence
  RNA Oligomer
uuaucccagaaaucgauca

SEQ ID NO: 9344 - RNA, 19 nt, Artificial Sequence
  RNA Oligomer
uugauuccuuuagugucca

SEQ ID NO: 9345 - RNA, 19 nt, Artificial Sequence
  RNA Oligomer
aucuacccgaauaguuacu

SEQ ID NO: 9346 - RNA, 19 nt, Artificial Sequence
  RNA Oligomer
ucuacccgaauaguuacug

SEQ ID NO: 9347 - RNA, 19 nt, Artificial Sequence
  RNA Oligomer
uuuaguguccauccaacug

SEQ ID NO: 9348 - RNA, 19 nt, Artificial Sequence
  RNA Oligomer
aggcauucuucucaucucc

SEQ ID NO: 9349 - RNA, 19 nt, Artificial Sequence
  RNA Oligomer
cuucucaucuccucaaugg

SEQ ID NO: 9350 - RNA, 19 nt, Artificial Sequence
  RNA Oligomer
cauucuacauucaggcuag

SEQ ID NO: 9351 - RNA, 19 nt, Artificial Sequence
  RNA Oligomer
uugaaaacaagcgaggugg

SEQ ID NO: 9352 - RNA, 19 nt, Artificial Sequence
  RNA Oligomer
aaucuaacuucaccgcccu

SEQ ID NO: 9353 - RNA, 19 nt, Artificial Sequence
  RNA Oligomer
uuguucaucaaaaccugga

SEQ ID NO: 9354 - RNA, 19 nt, Artificial Sequence
  RNA Oligomer
aucaaaaccuggacuuguc

SEQ ID NO: 9355 - RNA, 19 nt, Artificial Sequence
  RNA Oligomer
gacuugucuccucaucugc

SEQ ID NO: 9356 - RNA, 19 nt, Artificial Sequence
  RNA Oligomer
acuaaccugagagagaugg

SEQ ID NO: 9357 - RNA, 19 nt, Artificial Sequence
  RNA Oligomer
uagauuuuaugugcucaca

SEQ ID NO: 9358 - RNA, 19 nt, Artificial Sequence
  RNA Oligomer
auaugaauaugccucaagc

SEQ ID NO: 9359 - RNA, 19 nt, Artificial Sequence
  RNA Oligomer
cacagggagauuuuuagca

SEQ ID NO: 9360 - RNA, 19 nt, Artificial Sequence
  RNA Oligomer
uuuagauguaccaacugac

SEQ ID NO: 9361 - RNA, 19 nt, Artificial Sequence
  RNA Oligomer
uucauauauuacaccugac

SEQ ID NO: 9362 - RNA, 19 nt, Artificial Sequence
  RNA Oligomer
ugggaggagaugcuauucg

SEQ ID NO: 9363 - RNA, 19 nt, Artificial Sequence
  RNA Oligomer
ucgacagcaugguauauga

SEQ ID NO: 9364 - RNA, 19 nt, Artificial Sequence
  RNA Oligomer
guauaugaauggauaaagc

SEQ ID NO: 9365 - RNA, 19 nt, Artificial Sequence
  RNA Oligomer
uuucugcauucuucauugu

SEQ ID NO: 9366 - RNA, 19 nt, Artificial Sequence
  RNA Oligomer
aaugucucucaucaauucu

SEQ ID NO: 9367 - RNA, 19 nt, Artificial Sequence
  RNA Oligomer
cacugcagaaagauucucu

SEQ ID NO: 9368 - RNA, 19 nt, Artificial Sequence
  RNA Oligomer
auccaccuguagcaugccu

SEQ ID NO: 9369 - RNA, 19 nt, Artificial Sequence
  RNA Oligomer
uuuuguacagaacucauca

SEQ ID NO: 9370 - RNA, 19 nt, Artificial Sequence
  RNA Oligomer
aacgucccucaaacaaucg

SEQ ID NO: 9371 - RNA, 19 nt, Artificial Sequence
  RNA Oligomer
auacuccgauuucaucuua

SEQ ID NO: 9372 - RNA, 19 nt, Artificial Sequence
  RNA Oligomer
aacuuucugauuccgcugu

SEQ ID NO: 9373 - RNA, 19 nt, Artificial Sequence
  RNA Oligomer
uaccuuaucccagaaaucg

SEQ ID NO: 9374 - RNA, 19 nt, Artificial Sequence
  RNA Oligomer
cagaaaucgaucaaagcug

SEQ ID NO: 9375 - RNA, 19 nt, Artificial Sequence
  RNA Oligomer
auuccgcugucuugauucc

SEQ ID NO: 9376 - RNA, 19 nt, Artificial Sequence
  RNA Oligomer
uguuggaaaagguuuagga

SEQ ID NO: 9377 - RNA, 19 nt, Artificial Sequence
  RNA Oligomer
cuacccgaauaguuacugu

SEQ ID NO: 9378 - RNA, 19 nt, Artificial Sequence
  RNA Oligomer
uacccgaauaguuacugug

SEQ ID NO: 9379 - RNA, 19 nt, Artificial Sequence
  RNA Oligomer
uuucccacuguucuuuucu

SEQ ID NO: 9380 - RNA, 19 nt, Artificial Sequence
  RNA Oligomer
cuguucuuuucuucugucc

SEQ ID NO: 9381 - RNA, 19 nt, Artificial Sequence
  RNA Oligomer
uucaggcuagaaauauuuc

SEQ ID NO: 9382 - RNA, 19 nt, Artificial Sequence
  RNA Oligomer
uagaaauauuuccagguag

SEQ ID NO: 9383 - RNA, 19 nt, Artificial Sequence
  RNA Oligomer
uaguagaguaccguuuccu

SEQ ID NO: 9384 - RNA, 19 nt, Artificial Sequence
  RNA Oligomer
aauuauccacauccaucgg

SEQ ID NO: 9385 - RNA, 19 nt, Artificial Sequence
  RNA Oligomer
auuauccacauccaucggu

SEQ ID NO: 9386 - RNA, 19 nt, Artificial Sequence
  RNA Oligomer
ugucuagucaauuuguugu

SEQ ID NO: 9387 - RNA, 19 nt, Artificial Sequence
  RNA Oligomer
gucuagucaauuuguuguc

SEQ ID NO: 9388 - RNA, 19 nt, Artificial Sequence
  RNA Oligomer
gauugucucuauucucuuc

SEQ ID NO: 9389 - RNA, 19 nt, Artificial Sequence
  RNA Oligomer
acugugaucaucauuuuga

SEQ ID NO: 9390 - RNA, 19 nt, Artificial Sequence
  RNA Oligomer
acuuuccaaaagcugcucc

SEQ ID NO: 9391 - RNA, 19 nt, Artificial Sequence
  RNA Oligomer
uagacacacuuaaagagca

SEQ ID NO: 9392 - RNA, 19 nt, Artificial Sequence
  RNA Oligomer
aucagcaugaaguucccag

SEQ ID NO: 9393 - RNA, 19 nt, Artificial Sequence
  RNA Oligomer
uauaugaauaugccucaag

SEQ ID NO: 9394 - RNA, 19 nt, Artificial Sequence
  RNA Oligomer
aaucuguuuucuuuacacc

SEQ ID NO: 9395 - RNA, 19 nt, Artificial Sequence
  RNA Oligomer
uucauuuugccacuuacac

SEQ ID NO: 9396 - RNA, 19 nt, Artificial Sequence
  RNA Oligomer
aacuuaaacaaugcaagca

SEQ ID NO: 9397 - RNA, 19 nt, Artificial Sequence
  RNA Oligomer
caagcauauuaagaguuga

SEQ ID NO: 9398 - RNA, 19 nt, Artificial Sequence
  RNA Oligomer
agcauauuaagaguugagu

SEQ ID NO: 9399 - RNA, 19 nt, Artificial Sequence
  RNA Oligomer
auauuaagaguugagugga

SEQ ID NO: 9400 - RNA, 19 nt, Artificial Sequence
  RNA Oligomer
uuuugccacuuacacauug

SEQ ID NO: 9401 - RNA, 19 nt, Artificial Sequence
  RNA Oligomer
uuccuggauuucaacuugu

SEQ ID NO: 9402 - RNA, 19 nt, Artificial Sequence
  RNA Oligomer
cuggauuucaacuuguuuc

SEQ ID NO: 9403 - RNA, 19 nt, Artificial Sequence
  RNA Oligomer
uuucaacuuguuuccuggc

SEQ ID NO: 9404 - RNA, 19 nt, Artificial Sequence
  RNA Oligomer
uucaacuuguuuccuggca

SEQ ID NO: 9405 - RNA, 19 nt, Artificial Sequence
  RNA Oligomer
guauaauauaugggcagga

SEQ ID NO: 9406 - RNA, 19 nt, Artificial Sequence
  RNA Oligomer
guuuagauguaccaacuga

SEQ ID NO: 9407 - RNA, 19 nt, Artificial Sequence
  RNA Oligomer
uguaccaacugacaacugc

SEQ ID NO: 9408 - RNA, 19 nt, Artificial Sequence
  RNA Oligomer
ugucucucaucaauucuga

SEQ ID NO: 9409 - RNA, 19 nt, Artificial Sequence
  RNA Oligomer
auucguucacuuucccacc

SEQ ID NO: 9410 - RNA, 19 nt, Artificial Sequence
  RNA Oligomer
uuuuaaccuggcaucaccc

SEQ ID NO: 9411 - RNA, 19 nt, Artificial Sequence
  RNA Oligomer
caggauugauuaaaaagcg

SEQ ID NO: 9412 - RNA, 19 nt, Artificial Sequence
  RNA Oligomer
aggauugauuaaaaagcgg

SEQ ID NO: 9413 - RNA, 19 nt, Artificial Sequence
  RNA Oligomer
cuccaacaaaacgauuugc

SEQ ID NO: 9414 - RNA, 19 nt, Artificial Sequence
  RNA Oligomer
aauccaccuguagcaugcc

SEQ ID NO: 9415 - RNA, 19 nt, Artificial Sequence
  RNA Oligomer
aaaucuucaagacucuguc

SEQ ID NO: 9416 - RNA, 19 nt, Artificial Sequence
  RNA Oligomer
uguacagaacucaucaugg

SEQ ID NO: 9417 - RNA, 19 nt, Artificial Sequence
  RNA Oligomer
uuguaaaugucaccaaccc

SEQ ID NO: 9418 - RNA, 19 nt, Artificial Sequence
  RNA Oligomer
acuccgauuucaucuuagc

SEQ ID NO: 9419 - RNA, 19 nt, Artificial Sequence
  RNA Oligomer
uaaaagacuggcaaucugu

SEQ ID NO: 9420 - RNA, 19 nt, Artificial Sequence
  RNA Oligomer
uccugcgacauugugaugg

SEQ ID NO: 9421 - RNA, 19 nt, Artificial Sequence
  RNA Oligomer
uauccaaacuuucugauuc

SEQ ID NO: 9422 - RNA, 19 nt, Artificial Sequence
  RNA Oligomer
uccaaacuuucugauuccg

SEQ ID NO: 9423 - RNA, 19 nt, Artificial Sequence
  RNA Oligomer
auaaauguugagcuucugc

SEQ ID NO: 9424 - RNA, 19 nt, Artificial Sequence
  RNA Oligomer
uucuucaaguaccuuaucc

SEQ ID NO: 9425 - RNA, 19 nt, Artificial Sequence
  RNA Oligomer
agaaaucgaucaaagcugu

SEQ ID NO: 9426 - RNA, 19 nt, Artificial Sequence
  RNA Oligomer
auuucuuagaauaugccac

SEQ ID NO: 9427 - RNA, 19 nt, Artificial Sequence
  RNA Oligomer
cuggguacaaauuuuguuc

SEQ ID NO: 9428 - RNA, 19 nt, Artificial Sequence
  RNA Oligomer
uggguacaaauuuuguucu

SEQ ID NO: 9429 - RNA, 19 nt, Artificial Sequence
  RNA Oligomer
auguguuggaaaagguuua

SEQ ID NO: 9430 - RNA, 19 nt, Artificial Sequence
  RNA Oligomer
aaaagaucuacccgaauag

SEQ ID NO: 9431 - RNA, 19 nt, Artificial Sequence
  RNA Oligomer
uucguucacuuucccacca

SEQ ID NO: 9432 - RNA, 19 nt, Artificial Sequence
  RNA Oligomer
ugagguggaacguauuuag

SEQ ID NO: 9433 - RNA, 19 nt, Artificial Sequence
  RNA Oligomer
guuucccacuguucuuuuc

SEQ ID NO: 9434 - RNA, 19 nt, Artificial Sequence
  RNA Oligomer
uuuccagguaguuuagcau

SEQ ID NO: 9435 - RNA, 19 nt, Artificial Sequence
  RNA Oligomer
auucauuccagugcgacuc

SEQ ID NO: 9436 - RNA, 19 nt, Artificial Sequence
  RNA Oligomer
guaaucuaacuucaccgcc

SEQ ID NO: 9437 - RNA, 19 nt, Artificial Sequence
  RNA Oligomer
acuaccaucuucuuguuca

SEQ ID NO: 9438 - RNA, 19 nt, Artificial Sequence
  RNA Oligomer
uucaucaaaaccuggacuu

SEQ ID NO: 9439 - RNA, 19 nt, Artificial Sequence
  RNA Oligomer
uugucuagucaauuuguug

SEQ ID NO: 9440 - RNA, 19 nt, Artificial Sequence
  RNA Oligomer
aacauccucagagccaaca

SEQ ID NO: 9441 - RNA, 19 nt, Artificial Sequence
  RNA Oligomer
auccucagagccaacaucu

SEQ ID NO: 9442 - RNA, 19 nt, Artificial Sequence
  RNA Oligomer
aacuguugauugucucuau

SEQ ID NO: 9443 - RNA, 19 nt, Artificial Sequence
  RNA Oligomer
gauucguucacuuucccac

SEQ ID NO: 9444 - RNA, 19 nt, Artificial Sequence
  RNA Oligomer
gcaagcauauuaagaguug

SEQ ID NO: 9445 - RNA, 19 nt, Artificial Sequence
  RNA Oligomer
ucacagggagauuuuuagc

SEQ ID NO: 9446 - RNA, 19 nt, Artificial Sequence
  RNA Oligomer
uauaauauaugggcaggaa

SEQ ID NO: 9447 - RNA, 19 nt, Artificial Sequence
  RNA Oligomer
aaaacauaucuaaguccac

SEQ ID NO: 9448 - RNA, 19 nt, Artificial Sequence
  RNA Oligomer
acauaucuaaguccacgug

SEQ ID NO: 9449 - RNA, 19 nt, Artificial Sequence
  RNA Oligomer
gagggaguuuagauguacc

SEQ ID NO: 9450 - RNA, 19 nt, Artificial Sequence
  RNA Oligomer
cauguguggaagagauugc

SEQ ID NO: 9451 - RNA, 19 nt, Artificial Sequence
  RNA Oligomer
uauuacaccugacagcuca

SEQ ID NO: 9452 - RNA, 19 nt, Artificial Sequence
  RNA Oligomer
uguauuaaggcuuuuaacc

SEQ ID NO: 9453 - RNA, 19 nt, Artificial Sequence
  RNA Oligomer
uuucacucccaucuucgug

SEQ ID NO: 9454 - RNA, 19 nt, Artificial Sequence
  RNA Oligomer
augcaaucgugucaagggu

SEQ ID NO: 9455 - RNA, 19 nt, Artificial Sequence
  RNA Oligomer
uuuguacagaacucaucau

SEQ ID NO: 9456 - RNA, 19 nt, Artificial Sequence
  RNA Oligomer
aauacuccgauuucaucuu

SEQ ID NO: 9457 - RNA, 19 nt, Artificial Sequence
  RNA Oligomer
auuucaucuuagcauuucg

SEQ ID NO: 9458 - RNA, 19 nt, Artificial Sequence
  RNA Oligomer
augauucaucuucuguuuc

SEQ ID NO: 9459 - RNA, 19 nt, Artificial Sequence
  RNA Oligomer
uuugauucgggauucguuc

SEQ ID NO: 9460 - RNA, 19 nt, Artificial Sequence
  RNA Oligomer
uaucccagaaaucgaucaa

SEQ ID NO: 9461 - RNA, 19 nt, Artificial Sequence
  RNA Oligomer
ugucuugauuccuuuagug

SEQ ID NO: 9462 - RNA, 19 nt, Artificial Sequence
  RNA Oligomer
aacaaggcauuuuaacaug

SEQ ID NO: 9463 - RNA, 19 nt, Artificial Sequence
  RNA Oligomer
agguggaacguauuuaggg

SEQ ID NO: 9464 - RNA, 19 nt, Artificial Sequence
  RNA Oligomer
ucccacuguucuuuucuuc

SEQ ID NO: 9465 - RNA, 19 nt, Artificial Sequence
  RNA Oligomer
gucucaugaaaugaucugu

SEQ ID NO: 9466 - RNA, 19 nt, Artificial Sequence
  RNA Oligomer
ucucaugaaaugaucugug

SEQ ID NO: 9467 - RNA, 19 nt, Artificial Sequence
  RNA Oligomer
aucauucauuccagugcga

SEQ ID NO: 9468 - RNA, 19 nt, Artificial Sequence
  RNA Oligomer
agccucauuucacuaaccu

SEQ ID NO: 9469 - RNA, 19 nt, Artificial Sequence
  RNA Oligomer
auuugcuguuugggaggaa

SEQ ID NO: 9470 - RNA, 19 nt, Artificial Sequence
  RNA Oligomer
aacuaccaucuucuuguuc

SEQ ID NO: 9471 - RNA, 19 nt, Artificial Sequence
  RNA Oligomer
uuagaauuauccacaucca

SEQ ID NO: 9472 - RNA, 19 nt, Artificial Sequence
  RNA Oligomer
caacuuucuugucuaguca

SEQ ID NO: 9473 - RNA, 19 nt, Artificial Sequence
  RNA Oligomer
ugacaauggacucucuggc

SEQ ID NO: 9474 - RNA, 19 nt, Artificial Sequence
  RNA Oligomer
ucuaucucaucuugcugac

SEQ ID NO: 9475 - RNA, 19 nt, Artificial Sequence
  RNA Oligomer
ugaccgaucaauguuagca

SEQ ID NO: 9476 - RNA, 19 nt, Artificial Sequence
  RNA Oligomer
acacacuuaaagagcauac

SEQ ID NO: 9477 - RNA, 19 nt, Artificial Sequence
  RNA Oligomer
cuuuccaaaagcugcuccg

SEQ ID NO: 9478 - RNA, 19 nt, Artificial Sequence
  RNA Oligomer
auauagaugauaugggagu

SEQ ID NO: 9479 - RNA, 19 nt, Artificial Sequence
  RNA Oligomer
uagaugauaugggaguuuc

SEQ ID NO: 9480 - RNA, 19 nt, Artificial Sequence
  RNA Oligomer
uauaaccuuugaauaccag

SEQ ID NO: 9481 - RNA, 19 nt, Artificial Sequence
  RNA Oligomer
uccuuuuauuccacauuuc

SEQ ID NO: 9482 - RNA, 19 nt, Artificial Sequence
  RNA Oligomer
gaucagaggaaaaaagaca

SEQ ID NO: 9483 - RNA, 19 nt, Artificial Sequence
  RNA Oligomer
ucagaggaaaaaagacaga

SEQ ID NO: 9484 - RNA, 19 nt, Artificial Sequence
  RNA Oligomer
aaugauaccucaaaaguac

SEQ ID NO: 9485 - RNA, 19 nt, Artificial Sequence
  RNA Oligomer
aacuauuuuaaccuaggag

SEQ ID NO: 9486 - RNA, 19 nt, Artificial Sequence
  RNA Oligomer
uauuaagaguugaguggaa

SEQ ID NO: 9487 - RNA, 19 nt, Artificial Sequence
  RNA Oligomer
auuaagaguugaguggaag

SEQ ID NO: 9488 - RNA, 19 nt, Artificial Sequence
  RNA Oligomer
uugccacuuacacauugcu

SEQ ID NO: 9489 - RNA, 19 nt, Artificial Sequence
  RNA Oligomer
guuucugcauucuucauug

SEQ ID NO: 9490 - RNA, 19 nt, Artificial Sequence
  RNA Oligomer
uucuucauuguaguaucgu

SEQ ID NO: 9491 - RNA, 19 nt, Artificial Sequence
  RNA Oligomer
uuauacacaucuccaacag

SEQ ID NO: 9492 - RNA, 19 nt, Artificial Sequence
  RNA Oligomer
uucaguaaggaaaaugugc

SEQ ID NO: 9493 - RNA, 19 nt, Artificial Sequence
  RNA Oligomer
uaccugugauaauuagaca

SEQ ID NO: 9494 - RNA, 19 nt, Artificial Sequence
  RNA Oligomer
gugaaauaaucaacucagg

SEQ ID NO: 9495 - RNA, 19 nt, Artificial Sequence
  RNA Oligomer
uuaaaaagcggauuucuuc

SEQ ID NO: 9496 - RNA, 19 nt, Artificial Sequence
  RNA Oligomer
uaaaaagcggauuucuucu

SEQ ID NO: 9497 - RNA, 19 nt, Artificial Sequence
  RNA Oligomer
uccaacaaaacgauuugca

SEQ ID NO: 9498 - RNA, 19 nt, Artificial Sequence
  RNA Oligomer
guacagaacucaucaugga

SEQ ID NO: 9499 - RNA, 19 nt, Artificial Sequence
  RNA Oligomer
augucaccaacccaguagg

SEQ ID NO: 9500 - RNA, 19 nt, Artificial Sequence
  RNA Oligomer
aacucaucauggauucuau

SEQ ID NO: 9501 - RNA, 19 nt, Artificial Sequence
  RNA Oligomer
acgucccucaaacaaucga

SEQ ID NO: 9502 - RNA, 19 nt, Artificial Sequence
  RNA Oligomer
cuaaaagacuggcaaucug

SEQ ID NO: 9503 - RNA, 19 nt, Artificial Sequence
  RNA Oligomer
caaacuuucugauuccgcu

SEQ ID NO: 9504 - RNA, 19 nt, Artificial Sequence
  RNA Oligomer
cagacagagugcaauuuuc

SEQ ID NO: 9505 - RNA, 19 nt, Artificial Sequence
  RNA Oligomer
uggacugauauaaauguug

SEQ ID NO: 9506 - RNA, 19 nt, Artificial Sequence
  RNA Oligomer
augccacauuguauuucag

SEQ ID NO: 9507 - RNA, 19 nt, Artificial Sequence
  RNA Oligomer
cauuguauuucagaauagc

SEQ ID NO: 9508 - RNA, 19 nt, Artificial Sequence
  RNA Oligomer
uagcauccuucaaguuuug

SEQ ID NO: 9509 - RNA, 19 nt, Artificial Sequence
  RNA Oligomer
ucuggagaaaggugaggug

SEQ ID NO: 9510 - RNA, 19 nt, Artificial Sequence
  RNA Oligomer
acguauuuagggaucuucc

SEQ ID NO: 9511 - RNA, 19 nt, Artificial Sequence
  RNA Oligomer
auguugcuuagaauuucug

SEQ ID NO: 9512 - RNA, 19 nt, Artificial Sequence
  RNA Oligomer
uguugcuuagaauuucugc

SEQ ID NO: 9513 - RNA, 19 nt, Artificial Sequence
  RNA Oligomer
uuugaaaacaagcgaggug

SEQ ID NO: 9514 - RNA, 19 nt, Artificial Sequence
  RNA Oligomer
cucuccuccuucaaauugg

SEQ ID NO: 9515 - RNA, 19 nt, Artificial Sequence
  RNA Oligomer
aguaccguuuccuaaauuc

SEQ ID NO: 9516 - RNA, 19 nt, Artificial Sequence
  RNA Oligomer
uaaauucaaugucagcguc

SEQ ID NO: 9517 - RNA, 19 nt, Artificial Sequence
  RNA Oligomer
ucuuguucaucaaaaccug

SEQ ID NO: 9518 - RNA, 19 nt, Artificial Sequence
  RNA Oligomer
cacuuuccuucucaaaugg

SEQ ID NO: 9519 - RNA, 19 nt, Artificial Sequence
  RNA Oligomer
aucucaucuugcugacaac

SEQ ID NO: 9520 - RNA, 19 nt, Artificial Sequence
  RNA Oligomer
acuucugguggcuuuuggc

SEQ ID NO: 9521 - RNA, 19 nt, Artificial Sequence
  RNA Oligomer
uucaucuuccguagucugc

SEQ ID NO: 9522 - RNA, 19 nt, Artificial Sequence
  RNA Oligomer
agaaacuguugauugucuc

SEQ ID NO: 9523 - RNA, 19 nt, Artificial Sequence
  RNA Oligomer
guuacuguuugagguucac

SEQ ID NO: 9524 - RNA, 19 nt, Artificial Sequence
  RNA Oligomer
uucacuuuccaaaagcugc

SEQ ID NO: 9525 - RNA, 19 nt, Artificial Sequence
  RNA Oligomer
cacacuuaaagagcauacg

SEQ ID NO: 9526 - RNA, 19 nt, Artificial Sequence
  RNA Oligomer
ugauaugggaguuucugac

SEQ ID NO: 9527 - RNA, 19 nt, Artificial Sequence
  RNA Oligomer
uuucuuuacaccacaucag

SEQ ID NO: 9528 - RNA, 19 nt, Artificial Sequence
  RNA Oligomer
acuauuuuaaccuaggagg

SEQ ID NO: 9529 - RNA, 19 nt, Artificial Sequence
  RNA Oligomer
uuaagaguugaguggaagg

SEQ ID NO: 9530 - RNA, 19 nt, Artificial Sequence
  RNA Oligomer
uauaugggcaggaagaaag

SEQ ID NO: 9531 - RNA, 19 nt, Artificial Sequence
  RNA Oligomer
caaauguggauuauguaca

SEQ ID NO: 9532 - RNA, 19 nt, Artificial Sequence
  RNA Oligomer
cuucauuguaguaucguag

SEQ ID NO: 9533 - RNA, 19 nt, Artificial Sequence
  RNA Oligomer
uacuguguacuuuuuucag

SEQ ID NO: 9534 - RNA, 19 nt, Artificial Sequence
  RNA Oligomer
guaaggaaaaugugcaugc

SEQ ID NO: 9535 - RNA, 19 nt, Artificial Sequence
  RNA Oligomer
caugcuguaaaugucucuc

SEQ ID NO: 9536 - RNA, 19 nt, Artificial Sequence
  RNA Oligomer
auaaaccacaucucgcuca

SEQ ID NO: 9537 - RNA, 19 nt, Artificial Sequence
  RNA Oligomer
cuuuuaaccuggcaucacc

SEQ ID NO: 9538 - RNA, 19 nt, Artificial Sequence
  RNA Oligomer
aaauccacaguaagccuug

SEQ ID NO: 9539 - RNA, 19 nt, Artificial Sequence
  RNA Oligomer
aauccacaguaagccuugu

SEQ ID NO: 9540 - RNA, 19 nt, Artificial Sequence
  RNA Oligomer
aaugcgccgcuuugauucg

SEQ ID NO: 9541 - RNA, 19 nt, Artificial Sequence
  RNA Oligomer
caguaccugugauaauuag

SEQ ID NO: 9542 - RNA, 19 nt, Artificial Sequence
  RNA Oligomer
guaccugugauaauuagac

SEQ ID NO: 9543 - RNA, 19 nt, Artificial Sequence
  RNA Oligomer
ucaggauugauuaaaaagc

SEQ ID NO: 9544 - RNA, 19 nt, Artificial Sequence
  RNA Oligomer
ugauuaaaaagcggauuuc

SEQ ID NO: 9545 - RNA, 19 nt, Artificial Sequence
  RNA Oligomer
uucuucuaugguaccuucg

SEQ ID NO: 9546 - RNA, 19 nt, Artificial Sequence
  RNA Oligomer
cugucuuguaaaugucacc

SEQ ID NO: 9547 - RNA, 19 nt, Artificial Sequence
  RNA Oligomer
gaauacuccgauuucaucu

SEQ ID NO: 9548 - RNA, 19 nt, Artificial Sequence
  RNA Oligomer
agacuggcaaucuguuccu

SEQ ID NO: 9549 - RNA, 19 nt, Artificial Sequence
  RNA Oligomer
auucaucuucuguuucagg

SEQ ID NO: 9550 - RNA, 19 nt, Artificial Sequence
  RNA Oligomer
guuucaggagugguauugg

SEQ ID NO: 9551 - RNA, 19 nt, Artificial Sequence
  RNA Oligomer
aaacuuucugauuccgcug

SEQ ID NO: 9552 - RNA, 19 nt, Artificial Sequence
  RNA Oligomer
acuuucugauuccgcuguc

SEQ ID NO: 9553 - RNA, 19 nt, Artificial Sequence
  RNA Oligomer
gauggacugauauaaaugu

SEQ ID NO: 9554 - RNA, 19 nt, Artificial Sequence
  RNA Oligomer
aucgaucaaagcuguaaag

SEQ ID NO: 9555 - RNA, 19 nt, Artificial Sequence
  RNA Oligomer
uuucuuagaauaugccaca

SEQ ID NO: 9556 - RNA, 19 nt, Artificial Sequence
  RNA Oligomer
auuucagaauagcauccuu

SEQ ID NO: 9557 - RNA, 19 nt, Artificial Sequence
  RNA Oligomer
agcauccuucaaguuuugg

SEQ ID NO: 9558 - RNA, 19 nt, Artificial Sequence
  RNA Oligomer
cugcucgcaaaagaucuac

SEQ ID NO: 9559 - RNA, 19 nt, Artificial Sequence
  RNA Oligomer
ucguucacuuucccaccac

SEQ ID NO: 9560 - RNA, 19 nt, Artificial Sequence
  RNA Oligomer
cacuguucuuuucuucugu

SEQ ID NO: 9561 - RNA, 19 nt, Artificial Sequence
  RNA Oligomer
cuuuucuucuguccucugc

SEQ ID NO: 9562 - RNA, 19 nt, Artificial Sequence
  RNA Oligomer
agucucaugaaaugaucug

SEQ ID NO: 9563 - RNA, 19 nt, Artificial Sequence
  RNA Oligomer
auccuuuuuuccauguugc

SEQ ID NO: 9564 - RNA, 19 nt, Artificial Sequence
  RNA Oligomer
uucauuccagugcgacucu

SEQ ID NO: 9565 - RNA, 19 nt, Artificial Sequence
  RNA Oligomer
uucaccgcccuuaguagag

SEQ ID NO: 9566 - RNA, 19 nt, Artificial Sequence
  RNA Oligomer
guuuccuaaauucaauguc

SEQ ID NO: 9567 - RNA, 19 nt, Artificial Sequence
  RNA Oligomer
cuaaauucaaugucagcgu

SEQ ID NO: 9568 - RNA, 19 nt, Artificial Sequence
  RNA Oligomer
cuuguucaucaaaaccugg

SEQ ID NO: 9569 - RNA, 19 nt, Artificial Sequence
  RNA Oligomer
cacaucuaucucaucuugc

SEQ ID NO: 9570 - RNA, 19 nt, Artificial Sequence
  RNA Oligomer
acaucuaucucaucuugcu

SEQ ID NO: 9571 - RNA, 19 nt, Artificial Sequence
  RNA Oligomer
uaucucaucuugcugacaa

SEQ ID NO: 9572 - RNA, 19 nt, Artificial Sequence
  RNA Oligomer
aagacuugcugcacuucug

SEQ ID NO: 9573 - RNA, 19 nt, Artificial Sequence
  RNA Oligomer
agacuugcugcacuucugg

SEQ ID NO: 9574 - RNA, 19 nt, Artificial Sequence
  RNA Oligomer
ucuggccuguucaucuucc

SEQ ID NO: 9575 - RNA, 19 nt, Artificial Sequence
  RNA Oligomer
gugagaaacuguugauugu

SEQ ID NO: 9576 - RNA, 19 nt, Artificial Sequence
  RNA Oligomer
ucuauucucuucacuaucu

SEQ ID NO: 9577 - RNA, 19 nt, Artificial Sequence
  RNA Oligomer
cuauucucuucacuaucug

SEQ ID NO: 9578 - RNA, 19 nt, Artificial Sequence
  RNA Oligomer
uauucucuucacuaucugu

SEQ ID NO: 9579 - RNA, 19 nt, Artificial Sequence
  RNA Oligomer
aauauagaugauaugggag

SEQ ID NO: 9580 - RNA, 19 nt, Artificial Sequence
  RNA Oligomer
auagaugauaugggaguuu

SEQ ID NO: 9581 - RNA, 19 nt, Artificial Sequence
  RNA Oligomer
augauaugggaguuucuga

SEQ ID NO: 9582 - RNA, 19 nt, Artificial Sequence
  RNA Oligomer
acacauaugaaaaaaaccc

SEQ ID NO: 9583 - RNA, 19 nt, Artificial Sequence
  RNA Oligomer
aaacuuaaacaaugcaagc

SEQ ID NO: 9584 - RNA, 19 nt, Artificial Sequence
  RNA Oligomer
uaccaacugacaacugcac

SEQ ID NO: 9585 - RNA, 19 nt, Artificial Sequence
  RNA Oligomer
uucauuguaguaucguagc

SEQ ID NO: 9586 - RNA, 19 nt, Artificial Sequence
  RNA Oligomer
cuguaaaugucucucauca

SEQ ID NO: 9587 - RNA, 19 nt, Artificial Sequence
  RNA Oligomer
auuaaggcuuuuaaccugg

SEQ ID NO: 9588 - RNA, 19 nt, Artificial Sequence
  RNA Oligomer
cugugauaauuagacauuc

SEQ ID NO: 9589 - RNA, 19 nt, Artificial Sequence
  RNA Oligomer
guaagugacaugcaaucgu

SEQ ID NO: 9590 - RNA, 19 nt, Artificial Sequence
  RNA Oligomer
ucugucuuguaaaugucac

SEQ ID NO: 9591 - RNA, 19 nt, Artificial Sequence
  RNA Oligomer
ugucuuguaaaugucacca

SEQ ID NO: 9592 - RNA, 19 nt, Artificial Sequence
  RNA Oligomer
guaaaugucaccaacccag

SEQ ID NO: 9593 - RNA, 19 nt, Artificial Sequence
  RNA Oligomer
aaguuaaugucuggguaac

SEQ ID NO: 9594 - RNA, 19 nt, Artificial Sequence
  RNA Oligomer
uucaggagugguauuggcu

SEQ ID NO: 9595 - RNA, 19 nt, Artificial Sequence
  RNA Oligomer
cccauuucuuagaauaugc

SEQ ID NO: 9596 - RNA, 19 nt, Artificial Sequence
  RNA Oligomer
ccauuucuuagaauaugcc

SEQ ID NO: 9597 - RNA, 19 nt, Artificial Sequence
  RNA Oligomer
aagugcagucugaaugagc

SEQ ID NO: 9598 - RNA, 19 nt, Artificial Sequence
  RNA Oligomer
ccacuggguacaaauuuug

SEQ ID NO: 9599 - RNA, 19 nt, Artificial Sequence
  RNA Oligomer
cacuggguacaaauuuugu

SEQ ID NO: 9600 - RNA, 19 nt, Artificial Sequence
  RNA Oligomer
auucuucucaucuccucaa

SEQ ID NO: 9601 - RNA, 19 nt, Artificial Sequence
  RNA Oligomer
aaggugagguggaacguau

SEQ ID NO: 9602 - RNA, 19 nt, Artificial Sequence
  RNA Oligomer
accgcccuuaguagaguac

SEQ ID NO: 9603 - RNA, 19 nt, Artificial Sequence
  RNA Oligomer
uuccuaaauucaaugucag

SEQ ID NO: 9604 - RNA, 19 nt, Artificial Sequence
  RNA Oligomer
aauucaaugucagcgucuc

SEQ ID NO: 9605 - RNA, 19 nt, Artificial Sequence
  RNA Oligomer
uuuauuugcuguuugggag

SEQ ID NO: 9606 - RNA, 19 nt, Artificial Sequence
  RNA Oligomer
cugacaauggacucucugg

SEQ ID NO: 9607 - RNA, 19 nt, Artificial Sequence
  RNA Oligomer
aucugugucacugugauca

SEQ ID NO: 9608 - RNA, 19 nt, Artificial Sequence
  RNA Oligomer
ugcucacauauagacacac

SEQ ID NO: 9609 - RNA, 19 nt, Artificial Sequence
  RNA Oligomer
uauagaugauaugggaguu

SEQ ID NO: 9610 - RNA, 19 nt, Artificial Sequence
  RNA Oligomer
uugaauaccagagaaacuu

SEQ ID NO: 9611 - RNA, 19 nt, Artificial Sequence
  RNA Oligomer
cagagaaacuucaauaugu

SEQ ID NO: 9612 - RNA, 19 nt, Artificial Sequence
  RNA Oligomer
cacaaaagaaacauuaguc

SEQ ID NO: 9613 - RNA, 19 nt, Artificial Sequence
  RNA Oligomer
aucuguuuucuuuacacca

SEQ ID NO: 9614 - RNA, 19 nt, Artificial Sequence
  RNA Oligomer
uucuuuacaccacaucagg

SEQ ID NO: 9615 - RNA, 19 nt, Artificial Sequence
  RNA Oligomer
aaaauacugaucagaggaa

SEQ ID NO: 9616 - RNA, 19 nt, Artificial Sequence
  RNA Oligomer
acuuaaacaaugcaagcau

SEQ ID NO: 9617 - RNA, 19 nt, Artificial Sequence
  RNA Oligomer
gccacuuacacauugcugc

SEQ ID NO: 9618 - RNA, 19 nt, Artificial Sequence
  RNA Oligomer
aacugguauaauauauggg

SEQ ID NO: 9619 - RNA, 19 nt, Artificial Sequence
  RNA Oligomer
uuacacauugcugcagucu

SEQ ID NO: 9620 - RNA, 19 nt, Artificial Sequence
  RNA Oligomer
auguaccaacugacaacug

SEQ ID NO: 9621 - RNA, 19 nt, Artificial Sequence
  RNA Oligomer
ugaauggucagcggucucu

SEQ ID NO: 9622 - RNA, 19 nt, Artificial Sequence
  RNA Oligomer
ucauuguaguaucguagca

SEQ ID NO: 9623 - RNA, 19 nt, Artificial Sequence
  RNA Oligomer
auuguaguaucguagcaac

SEQ ID NO: 9624 - RNA, 19 nt, Artificial Sequence
  RNA Oligomer
aacagcuuauacacaucuc

SEQ ID NO: 9625 - RNA, 19 nt, Artificial Sequence
  RNA Oligomer
acagcuuauacacaucucc

SEQ ID NO: 9626 - RNA, 19 nt, Artificial Sequence
  RNA Oligomer
cuguguacuuuuuucagug

SEQ ID NO: 9627 - RNA, 19 nt, Artificial Sequence
  RNA Oligomer
ugaaauaaaccacaucucg

SEQ ID NO: 9628 - RNA, 19 nt, Artificial Sequence
  RNA Oligomer
uaaaccacaucucgcucag

SEQ ID NO: 9629 - RNA, 19 nt, Artificial Sequence
  RNA Oligomer
uccacaguaagccuuguuc

SEQ ID NO: 9630 - RNA, 19 nt, Artificial Sequence
  RNA Oligomer
cagcucgcgucucauuuuc

SEQ ID NO: 9631 - RNA, 19 nt, Artificial Sequence
  RNA Oligomer
ucgcgucucauuuucucag

SEQ ID NO: 9632 - RNA, 19 nt, Artificial Sequence
  RNA Oligomer
aagugaagagcaucgaugg

SEQ ID NO: 9633 - RNA, 19 nt, Artificial Sequence
  RNA Oligomer
cuuaucaagacuuagcuga

SEQ ID NO: 9634 - RNA, 19 nt, Artificial Sequence
  RNA Oligomer
uuggccauuuucuucuaug

SEQ ID NO: 9635 - RNA, 19 nt, Artificial Sequence
  RNA Oligomer
uuuuucacaucuuucccau

SEQ ID NO: 9636 - RNA, 19 nt, Artificial Sequence
  RNA Oligomer
cgcuuugauucgggauucg

SEQ ID NO: 9637 - RNA, 19 nt, Artificial Sequence
  RNA Oligomer
acucugucuuguaaauguc

SEQ ID NO: 9638 - RNA, 19 nt, Artificial Sequence
  RNA Oligomer
cuagaauacuccgauuuca

SEQ ID NO: 9639 - RNA, 19 nt, Artificial Sequence
  RNA Oligomer
uuucaucuuagcauuucgu

SEQ ID NO: 9640 - RNA, 19 nt, Artificial Sequence
  RNA Oligomer
caauuuucaccauaucagg

SEQ ID NO: 9641 - RNA, 19 nt, Artificial Sequence
  RNA Oligomer
aaagucccauuucuuagaa

SEQ ID NO: 9642 - RNA, 19 nt, Artificial Sequence
  RNA Oligomer
cagucugaaugagcuccca

SEQ ID NO: 9643 - RNA, 19 nt, Artificial Sequence
  RNA Oligomer
gaacaaggcauuuuaacau

SEQ ID NO: 9644 - RNA, 19 nt, Artificial Sequence
  RNA Oligomer
ugcucgcaaaagaucuacc

SEQ ID NO: 9645 - RNA, 19 nt, Artificial Sequence
  RNA Oligomer
gcucgcaaaagaucuaccc

SEQ ID NO: 9646 - RNA, 19 nt, Artificial Sequence
  RNA Oligomer
cucgcaaaagaucuacccg

SEQ ID NO: 9647 - RNA, 19 nt, Artificial Sequence
  RNA Oligomer
ucgcaaaagaucuacccga

SEQ ID NO: 9648 - RNA, 19 nt, Artificial Sequence
  RNA Oligomer
agaaaggugagguggaacg

SEQ ID NO: 9649 - RNA, 19 nt, Artificial Sequence
  RNA Oligomer
uucuguucuuugauguuug

SEQ ID NO: 9650 - RNA, 19 nt, Artificial Sequence
  RNA Oligomer
ucuguucuuugauguuugg

SEQ ID NO: 9651 - RNA, 19 nt, Artificial Sequence
  RNA Oligomer
acuguucuuuucuucuguc

SEQ ID NO: 9652 - RNA, 19 nt, Artificial Sequence
  RNA Oligomer
cauguugcuuagaauuucu

SEQ ID NO: 9653 - RNA, 19 nt, Artificial Sequence
  RNA Oligomer
cguuuccuaaauucaaugu

SEQ ID NO: 9654 - RNA, 19 nt, Artificial Sequence
  RNA Oligomer
ccuaaauucaaugucagcg

SEQ ID NO: 9655 - RNA, 19 nt, Artificial Sequence
  RNA Oligomer
aaauucaaugucagcgucu

SEQ ID NO: 9656 - RNA, 19 nt, Artificial Sequence
  RNA Oligomer
auucaaugucagcgucucu

SEQ ID NO: 9657 - RNA, 19 nt, Artificial Sequence
  RNA Oligomer
uucugagucuugacaacua

SEQ ID NO: 9658 - RNA, 19 nt, Artificial Sequence
  RNA Oligomer
acaauggacucucuggcac

SEQ ID NO: 9659 - RNA, 19 nt, Artificial Sequence
  RNA Oligomer
aauggacucucuggcacca

SEQ ID NO: 9660 - RNA, 19 nt, Artificial Sequence
  RNA Oligomer
caccacaucuaucucaucu

SEQ ID NO: 9661 - RNA, 19 nt, Artificial Sequence
  RNA Oligomer
caacuugcacagucuuccc

SEQ ID NO: 9662 - RNA, 19 nt, Artificial Sequence
  RNA Oligomer
uucucuggccuguucaucu

SEQ ID NO: 9663 - RNA, 19 nt, Artificial Sequence
  RNA Oligomer
aaacacucgccugcuuucu

SEQ ID NO: 9664 - RNA, 19 nt, Artificial Sequence
  RNA Oligomer
ccaguccaauuuuauuuag

SEQ ID NO: 9665 - RNA, 19 nt, Artificial Sequence
  RNA Oligomer
cacuuuccaaaagcugcuc

SEQ ID NO: 9666 - RNA, 19 nt, Artificial Sequence
  RNA Oligomer
uccaaaagcugcuccgugu

SEQ ID NO: 9667 - RNA, 19 nt, Artificial Sequence
  RNA Oligomer
gaauaccagagaaacuuca

SEQ ID NO: 9668 - RNA, 19 nt, Artificial Sequence
  RNA Oligomer
uuccacauuuccuuucauc

SEQ ID NO: 9669 - RNA, 19 nt, Artificial Sequence
  RNA Oligomer
aaaaauacugaucagagga

SEQ ID NO: 9670 - RNA, 19 nt, Artificial Sequence
  RNA Oligomer
cagauaaaaaugauaccuc

SEQ ID NO: 9671 - RNA, 19 nt, Artificial Sequence
  RNA Oligomer
acugacaacugcacaugug

SEQ ID NO: 9672 - RNA, 19 nt, Artificial Sequence
  RNA Oligomer
auacacaucuccaacagug

SEQ ID NO: 9673 - RNA, 19 nt, Artificial Sequence
  RNA Oligomer
ugaagaaacuccaggacgg

SEQ ID NO: 9674 - RNA, 19 nt, Artificial Sequence
  RNA Oligomer
auccacaguaagccuuguu

SEQ ID NO: 9675 - RNA, 19 nt, Artificial Sequence
  RNA Oligomer
ucuucuugcacaaguccug

SEQ ID NO: 9676 - RNA, 19 nt, Artificial Sequence
  RNA Oligomer
cuucuugcacaaguccugc

SEQ ID NO: 9677 - RNA, 19 nt, Artificial Sequence
  RNA Oligomer
auuugcaaaauccaccugu

SEQ ID NO: 9678 - RNA, 19 nt, Artificial Sequence
  RNA Oligomer
cguaagugacaugcaaucg

SEQ ID NO: 9679 - RNA, 19 nt, Artificial Sequence
  RNA Oligomer
aacuagaauacuccgauuu

SEQ ID NO: 9680 - RNA, 19 nt, Artificial Sequence
  RNA Oligomer
acuggcaaucuguuccugc

SEQ ID NO: 9681 - RNA, 19 nt, Artificial Sequence
  RNA Oligomer
gacugauauaaauguugag

SEQ ID NO: 9682 - RNA, 19 nt, Artificial Sequence
  RNA Oligomer
cugauauaaauguugagcu

SEQ ID NO: 9683 - RNA, 19 nt, Artificial Sequence
  RNA Oligomer
uucaaguaccuuaucccag

SEQ ID NO: 9684 - RNA, 19 nt, Artificial Sequence
  RNA Oligomer
uuccgcugucuugauuccu

SEQ ID NO: 9685 - RNA, 19 nt, Artificial Sequence
  RNA Oligomer
cauuucuuagaauaugcca

SEQ ID NO: 9686 - RNA, 19 nt, Artificial Sequence
  RNA Oligomer
uucuuagaauaugccacau

SEQ ID NO: 9687 - RNA, 19 nt, Artificial Sequence
  RNA Oligomer
uucagaauagcauccuuca

SEQ ID NO: 9688 - RNA, 19 nt, Artificial Sequence
  RNA Oligomer
auagcauccuucaaguuuu

SEQ ID NO: 9689 - RNA, 19 nt, Artificial Sequence
  RNA Oligomer
gaagugcagucugaaugag

SEQ ID NO: 9690 - RNA, 19 nt, Artificial Sequence
  RNA Oligomer
aauccuuuuuuccauguug

SEQ ID NO: 9691 - RNA, 19 nt, Artificial Sequence
  RNA Oligomer
agccaacaucugacaaugg

SEQ ID NO: 9692 - RNA, 19 nt, Artificial Sequence
  RNA Oligomer
ucuggcaccacaucuaucu

SEQ ID NO: 9693 - RNA, 19 nt, Artificial Sequence
  RNA Oligomer
uggcaccacaucuaucuca

SEQ ID NO: 9694 - RNA, 19 nt, Artificial Sequence
  RNA Oligomer
ucacuuuccaaaagcugcu

SEQ ID NO: 9695 - RNA, 19 nt, Artificial Sequence
  RNA Oligomer
uuucccaccaguccaauuu

SEQ ID NO: 9696 - RNA, 19 nt, Artificial Sequence
  RNA Oligomer
uuuccaaaagcugcuccgu

SEQ ID NO: 9697 - RNA, 19 nt, Artificial Sequence
  RNA Oligomer
auaugggaguuucugacaa

SEQ ID NO: 9698 - RNA, 19 nt, Artificial Sequence
  RNA Oligomer
acauuuccuuucaucucag

SEQ ID NO: 9699 - RNA, 19 nt, Artificial Sequence
  RNA Oligomer
acagcucaaacaggacguc

SEQ ID NO: 9700 - RNA, 19 nt, Artificial Sequence
  RNA Oligomer
auggauaaagcuugauguc

SEQ ID NO: 9701 - RNA, 19 nt, Artificial Sequence
  RNA Oligomer
ucaguaaggaaaaugugca

SEQ ID NO: 9702 - RNA, 19 nt, Artificial Sequence
  RNA Oligomer
uaaggaaaaugugcaugcu

SEQ ID NO: 9703 - RNA, 19 nt, Artificial Sequence
  RNA Oligomer
aauaaaccacaucucgcuc

SEQ ID NO: 9704 - RNA, 19 nt, Artificial Sequence
  RNA Oligomer
uuguucagcucgcgucuca

SEQ ID NO: 9705 - RNA, 19 nt, Artificial Sequence
  RNA Oligomer
accaacgauaugucucagc

SEQ ID NO: 9706 - RNA, 19 nt, Artificial Sequence
  RNA Oligomer
ugacuuaucaagacuuagc

SEQ ID NO: 9707 - RNA, 19 nt, Artificial Sequence
  RNA Oligomer
gacuuaucaagacuuagcu

SEQ ID NO: 9708 - RNA, 19 nt, Artificial Sequence
  RNA Oligomer
uuaucaagacuuagcugag

SEQ ID NO: 9709 - RNA, 19 nt, Artificial Sequence
  RNA Oligomer
uaucaagacuuagcugaga

SEQ ID NO: 9710 - RNA, 19 nt, Artificial Sequence
  RNA Oligomer
aagagccgugaaauaauca

SEQ ID NO: 9711 - RNA, 19 nt, Artificial Sequence
  RNA Oligomer
ggauugauuaaaaagcgga

SEQ ID NO: 9712 - RNA, 19 nt, Artificial Sequence
  RNA Oligomer
uucuucuugcacaaguccu

SEQ ID NO: 9713 - RNA, 19 nt, Artificial Sequence
  RNA Oligomer
accaccuccaacaaaacga

SEQ ID NO: 9714 - RNA, 19 nt, Artificial Sequence
  RNA Oligomer
aucuuuuuguacagaacuc

SEQ ID NO: 9715 - RNA, 19 nt, Artificial Sequence
  RNA Oligomer
augguaccuucguaaguga

SEQ ID NO: 9716 - RNA, 19 nt, Artificial Sequence
  RNA Oligomer
ucuaaaguagcagaagagc

SEQ ID NO: 9717 - RNA, 19 nt, Artificial Sequence
  RNA Oligomer
gacuggcaaucuguuccug

SEQ ID NO: 9718 - RNA, 19 nt, Artificial Sequence
  RNA Oligomer
ggacugauauaaauguuga

SEQ ID NO: 9719 - RNA, 19 nt, Artificial Sequence
  RNA Oligomer
guaaagucccauuucuuag

SEQ ID NO: 9720 - RNA, 19 nt, Artificial Sequence
  RNA Oligomer
uuagaauaugccacauugu

SEQ ID NO: 9721 - RNA, 19 nt, Artificial Sequence
  RNA Oligomer
uguuaucccacaaaucuuu

SEQ ID NO: 9722 - RNA, 19 nt, Artificial Sequence
  RNA Oligomer
uagaauccuuuuuuccaug

SEQ ID NO: 9723 - RNA, 19 nt, Artificial Sequence
  RNA Oligomer
uuauuugcuguuugggagg

SEQ ID NO: 9724 - RNA, 19 nt, Artificial Sequence
  RNA Oligomer
ucaaauggaggagaauuuc

SEQ ID NO: 9725 - RNA, 19 nt, Artificial Sequence
  RNA Oligomer
uguucaucuuccguagucu

SEQ ID NO: 9726 - RNA, 19 nt, Artificial Sequence
  RNA Oligomer
aucuuccguagucugcuuu

SEQ ID NO: 9727 - RNA, 19 nt, Artificial Sequence
  RNA Oligomer
auuacuaaacugcucuggu

SEQ ID NO: 9728 - RNA, 19 nt, Artificial Sequence
  RNA Oligomer
caccaguccaauuuuauuu

SEQ ID NO: 9729 - RNA, 19 nt, Artificial Sequence
  RNA Oligomer
ugaauaccagagaaacuuc

SEQ ID NO: 9730 - RNA, 19 nt, Artificial Sequence
  RNA Oligomer
cacuuacacauugcugcag

SEQ ID NO: 9731 - RNA, 19 nt, Artificial Sequence
  RNA Oligomer
guguggaagagauugcguc

SEQ ID NO: 9732 - RNA, 19 nt, Artificial Sequence
  RNA Oligomer
auaaagcuugaugucuggu

SEQ ID NO: 9733 - RNA, 19 nt, Artificial Sequence
  RNA Oligomer
agcuugaugucugguccag

SEQ ID NO: 9734 - RNA, 19 nt, Artificial Sequence
  RNA Oligomer
caacagcuuauacacaucu

SEQ ID NO: 9735 - RNA, 19 nt, Artificial Sequence
  RNA Oligomer
augcuguaaaugucucuca

SEQ ID NO: 9736 - RNA, 19 nt, Artificial Sequence
  RNA Oligomer
gaaauaaaccacaucucgc

SEQ ID NO: 9737 - RNA, 19 nt, Artificial Sequence
  RNA Oligomer
aaccacaucucgcucagcu

SEQ ID NO: 9738 - RNA, 19 nt, Artificial Sequence
  RNA Oligomer
uuaaggcuuuuaaccuggc

SEQ ID NO: 9739 - RNA, 19 nt, Artificial Sequence
  RNA Oligomer
uaccuucguaagugacaug

SEQ ID NO: 9740 - RNA, 19 nt, Artificial Sequence
  RNA Oligomer
ucuuuuuguacagaacuca

SEQ ID NO: 9741 - RNA, 19 nt, Artificial Sequence
  RNA Oligomer
uuuuuguacagaacucauc

SEQ ID NO: 9742 - RNA, 19 nt, Artificial Sequence
  RNA Oligomer
cuuagaauaugccacauug

SEQ ID NO: 9743 - RNA, 19 nt, Artificial Sequence
  RNA Oligomer
ucgcucaccauucucaucu

SEQ ID NO: 9744 - RNA, 19 nt, Artificial Sequence
  RNA Oligomer
aucuuccuuucuguucuuu

SEQ ID NO: 9745 - RNA, 19 nt, Artificial Sequence
  RNA Oligomer
agaauccuuuuuuccaugu

SEQ ID NO: 9746 - RNA, 19 nt, Artificial Sequence
  RNA Oligomer
ugucuccucaucugcuucu

SEQ ID NO: 9747 - RNA, 19 nt, Artificial Sequence
  RNA Oligomer
cuguucaucuuccguaguc

SEQ ID NO: 9748 - RNA, 19 nt, Artificial Sequence
  RNA Oligomer
cuaaacugcucugguacca

SEQ ID NO: 9749 - RNA, 19 nt, Artificial Sequence
  RNA Oligomer
uugguuauaugaauaugcc

SEQ ID NO: 9750 - RNA, 19 nt, Artificial Sequence
  RNA Oligomer
acugguauaauauaugggc

SEQ ID NO: 9751 - RNA, 19 nt, Artificial Sequence
  RNA Oligomer
aguaaggaaaaugugcaug

SEQ ID NO: 9752 - RNA, 19 nt, Artificial Sequence
  RNA Oligomer
agugaagagcaucgauggc

SEQ ID NO: 9753 - RNA, 19 nt, Artificial Sequence
  RNA Oligomer
gagccgugaaauaaucaac

SEQ ID NO: 9754 - RNA, 19 nt, Artificial Sequence
  RNA Oligomer
gguaacuagaauacuccga

SEQ ID NO: 9755 - RNA, 19 nt, Artificial Sequence
  RNA Oligomer
gggugcauuuauuucaaaa

SEQ ID NO: 9756 - RNA, 19 nt, Artificial Sequence
  RNA Oligomer
gcaugauguauuuuuguac

SEQ ID NO: 9757 - RNA, 19 nt, Artificial Sequence
  RNA Oligomer
ugcucaaguuuuucagaaa

SEQ ID NO: 9758 - RNA, 19 nt, Artificial Sequence
  RNA Oligomer
gcucaaguuuuucagaaag

SEQ ID NO: 9759 - RNA, 19 nt, Artificial Sequence
  RNA Oligomer
ucucaugugauccuuuuau

SEQ ID NO: 9760 - RNA, 19 nt, Artificial Sequence
  RNA Oligomer
gauguauuuuuguacccuu

SEQ ID NO: 9761 - RNA, 19 nt, Artificial Sequence
  RNA Oligomer
ugauguauuuuuguacccu

SEQ ID NO: 9762 - RNA, 19 nt, Artificial Sequence
  RNA Oligomer
cgauuauaagcaaaaggaa

SEQ ID NO: 9763 - RNA, 19 nt, Artificial Sequence
  RNA Oligomer
guauuuuuguacccuuccu

SEQ ID NO: 9764 - RNA, 19 nt, Artificial Sequence
  RNA Oligomer
cucaugugauccuuuuaug

SEQ ID NO: 9765 - RNA, 19 nt, Artificial Sequence
  RNA Oligomer
agagcuggaaucgauuaua

SEQ ID NO: 9766 - RNA, 19 nt, Artificial Sequence
  RNA Oligomer
ccuuguugcaugauguauu

SEQ ID NO: 9767 - RNA, 19 nt, Artificial Sequence
  RNA Oligomer
augcucaaguuuuucagaa

SEQ ID NO: 9768 - RNA, 19 nt, Artificial Sequence
  RNA Oligomer
uaauucucaugugauccuu

SEQ ID NO: 9769 - RNA, 19 nt, Artificial Sequence
  RNA Oligomer
cacuuuaauucucauguga

SEQ ID NO: 9770 - RNA, 19 nt, Artificial Sequence
  RNA Oligomer
acagaccugacaaguuucu

SEQ ID NO: 9771 - RNA, 19 nt, Artificial Sequence
  RNA Oligomer
cgcaguaaaaucuuugaca

SEQ ID NO: 9772 - RNA, 19 nt, Artificial Sequence
  RNA Oligomer
ccgcaguaaaaucuuugac

SEQ ID NO: 9773 - RNA, 19 nt, Artificial Sequence
  RNA Oligomer
cccgcaguaaaaucuuuga

SEQ ID NO: 9774 - RNA, 19 nt, Artificial Sequence
  RNA Oligomer
gucaaaccauaaacuucau

SEQ ID NO: 9775 - RNA, 19 nt, Artificial Sequence
  RNA Oligomer
cucaaguuuuucagaaagc

SEQ ID NO: 9776 - RNA, 19 nt, Artificial Sequence
  RNA Oligomer
agaccugacaaguuucuuc

SEQ ID NO: 9777 - RNA, 19 nt, Artificial Sequence
  RNA Oligomer
acaugguggaagagaagau

SEQ ID NO: 9778 - RNA, 19 nt, Artificial Sequence
  RNA Oligomer
cuuguugcaugauguauuu

SEQ ID NO: 9779 - RNA, 19 nt, Artificial Sequence
  RNA Oligomer
caagugaagaaaagugaau

SEQ ID NO: 9780 - RNA, 19 nt, Artificial Sequence
  RNA Oligomer
gaacaggcaagugaagaaa

SEQ ID NO: 9781 - RNA, 19 nt, Artificial Sequence
  RNA Oligomer
cuuuaauucucaugugauc

SEQ ID NO: 9782 - RNA, 19 nt, Artificial Sequence
  RNA Oligomer
cccaaagucuuaaaauaac

SEQ ID NO: 9783 - RNA, 19 nt, Artificial Sequence
  RNA Oligomer
ucgauuauaagcaaaagga

SEQ ID NO: 9784 - RNA, 19 nt, Artificial Sequence
  RNA Oligomer
agagaagauuccagagacu

SEQ ID NO: 9785 - RNA, 19 nt, Artificial Sequence
  RNA Oligomer
gaaugcucaaguuuuucag

SEQ ID NO: 9786 - RNA, 19 nt, Artificial Sequence
  RNA Oligomer
ugaaugcucaaguuuuuca

SEQ ID NO: 9787 - RNA, 19 nt, Artificial Sequence
  RNA Oligomer
agugaaugcucaaguuuuu

SEQ ID NO: 9788 - RNA, 19 nt, Artificial Sequence
  RNA Oligomer
gcaagugaagaaaagugaa

SEQ ID NO: 9789 - RNA, 19 nt, Artificial Sequence
  RNA Oligomer
ggcaagugaagaaaaguga

SEQ ID NO: 9790 - RNA, 19 nt, Artificial Sequence
  RNA Oligomer
acaggcaagugaagaaaag

SEQ ID NO: 9791 - RNA, 19 nt, Artificial Sequence
  RNA Oligomer
agaacaggcaagugaagaa

SEQ ID NO: 9792 - RNA, 19 nt, Artificial Sequence
  RNA Oligomer
ugagaugagacauguagac

SEQ ID NO: 9793 - RNA, 19 nt, Artificial Sequence
  RNA Oligomer
caaguuucuucagugugug

SEQ ID NO: 9794 - RNA, 19 nt, Artificial Sequence
  RNA Oligomer
caaguacacugaaauucau

SEQ ID NO: 9795 - RNA, 19 nt, Artificial Sequence
  RNA Oligomer
guccauaauuugcaaccag

SEQ ID NO: 9796 - RNA, 19 nt, Artificial Sequence
  RNA Oligomer
gaauaaaagaucuggccca

SEQ ID NO: 9797 - RNA, 19 nt, Artificial Sequence
  RNA Oligomer
gcauuacauuuccaaauga

SEQ ID NO: 9798 - RNA, 19 nt, Artificial Sequence
  RNA Oligomer
aaaagugaaugcucaaguu

SEQ ID NO: 9799 - RNA, 19 nt, Artificial Sequence
  RNA Oligomer
gaaaagugaaugcucaagu

SEQ ID NO: 9800 - RNA, 19 nt, Artificial Sequence
  RNA Oligomer
ugaaaaaucaccacaccaa

SEQ ID NO: 9801 - RNA, 19 nt, Artificial Sequence
  RNA Oligomer
guaacauccuuucuauuga

SEQ ID NO: 9802 - RNA, 19 nt, Artificial Sequence
  RNA Oligomer
ccugagaugagacauguag

SEQ ID NO: 9803 - RNA, 19 nt, Artificial Sequence
  RNA Oligomer
cagucgcugugguuguuuu

SEQ ID NO: 9804 - RNA, 19 nt, Artificial Sequence
  RNA Oligomer
gggugauacaugguggaag

SEQ ID NO: 9805 - RNA, 19 nt, Artificial Sequence
  RNA Oligomer
gaaguccauaauuugcaac

SEQ ID NO: 9806 - RNA, 19 nt, Artificial Sequence
  RNA Oligomer
guauucuggaaaacgguuu

SEQ ID NO: 9807 - RNA, 19 nt, Artificial Sequence
  RNA Oligomer
ugaccuuguugcaugaugu

SEQ ID NO: 9808 - RNA, 19 nt, Artificial Sequence
  RNA Oligomer
cucuuauuagaacaggcaa

SEQ ID NO: 9809 - RNA, 19 nt, Artificial Sequence
  RNA Oligomer
agaugagacauguagacug

SEQ ID NO: 9810 - RNA, 19 nt, Artificial Sequence
  RNA Oligomer
gugugugaaaaauccugag

SEQ ID NO: 9811 - RNA, 19 nt, Artificial Sequence
  RNA Oligomer
aagagcuggaaucgauuau

SEQ ID NO: 9812 - RNA, 19 nt, Artificial Sequence
  RNA Oligomer
uccauaauuugcaaccaga

SEQ ID NO: 9813 - RNA, 19 nt, Artificial Sequence
  RNA Oligomer
acauuacugaagaagacua

SEQ ID NO: 9814 - RNA, 19 nt, Artificial Sequence
  RNA Oligomer
gggaggugcaguuucagaa

SEQ ID NO: 9815 - RNA, 19 nt, Artificial Sequence
  RNA Oligomer
guguaugggaugcuuucaa

SEQ ID NO: 9816 - RNA, 19 nt, Artificial Sequence
  RNA Oligomer
gaccuuguugcaugaugua

SEQ ID NO: 9817 - RNA, 19 nt, Artificial Sequence
  RNA Oligomer
agaaaagugaaugcucaag

SEQ ID NO: 9818 - RNA, 19 nt, Artificial Sequence
  RNA Oligomer
gaagaaaagugaaugcuca

SEQ ID NO: 9819 - RNA, 19 nt, Artificial Sequence
  RNA Oligomer
acuuauaucaucagcauac

SEQ ID NO: 9820 - RNA, 19 nt, Artificial Sequence
  RNA Oligomer
uccugagaugagacaugua

SEQ ID NO: 9821 - RNA, 19 nt, Artificial Sequence
  RNA Oligomer
gguuguuuuagcuccuuga

SEQ ID NO: 9822 - RNA, 19 nt, Artificial Sequence
  RNA Oligomer
cuggaaucgauuauaagca

SEQ ID NO: 9823 - RNA, 19 nt, Artificial Sequence
  RNA Oligomer
caugguggaagagaagauu

SEQ ID NO: 9824 - RNA, 19 nt, Artificial Sequence
  RNA Oligomer
auaauuugcaaccagagaa

SEQ ID NO: 9825 - RNA, 19 nt, Artificial Sequence
  RNA Oligomer
ccauaauuugcaaccagag

SEQ ID NO: 9826 - RNA, 19 nt, Artificial Sequence
  RNA Oligomer
aguccauaauuugcaacca

SEQ ID NO: 9827 - RNA, 19 nt, Artificial Sequence
  RNA Oligomer
ucccgcaguaaaaucuuug

SEQ ID NO: 9828 - RNA, 19 nt, Artificial Sequence
  RNA Oligomer
aucccgcaguaaaaucuuu

SEQ ID NO: 9829 - RNA, 19 nt, Artificial Sequence
  RNA Oligomer
ugguccaugugaugcucaa

SEQ ID NO: 9830 - RNA, 19 nt, Artificial Sequence
  RNA Oligomer
uggcccaucaguucacaca

SEQ ID NO: 9831 - RNA, 19 nt, Artificial Sequence
  RNA Oligomer
caaaacauccuugcaacau

SEQ ID NO: 9832 - RNA, 19 nt, Artificial Sequence
  RNA Oligomer
accuuguugcaugauguau

SEQ ID NO: 9833 - RNA, 19 nt, Artificial Sequence
  RNA Oligomer
gaaagcauuacauuuccaa

SEQ ID NO: 9834 - RNA, 19 nt, Artificial Sequence
  RNA Oligomer
aggcaagugaagaaaagug

SEQ ID NO: 9835 - RNA, 19 nt, Artificial Sequence
  RNA Oligomer
gaaaaaucaccacaccaaa

SEQ ID NO: 9836 - RNA, 19 nt, Artificial Sequence
  RNA Oligomer
aucaucagcauaccuuuau

SEQ ID NO: 9837 - RNA, 19 nt, Artificial Sequence
  RNA Oligomer
ugacaaaaacagcacuuuu

SEQ ID NO: 9838 - RNA, 19 nt, Artificial Sequence
  RNA Oligomer
cuaccuugcugaugaccuc

SEQ ID NO: 9839 - RNA, 19 nt, Artificial Sequence
  RNA Oligomer
cuaaugaaguugggaacuc

SEQ ID NO: 9840 - RNA, 19 nt, Artificial Sequence
  RNA Oligomer
ggugcauuuauuucaaaac

SEQ ID NO: 9841 - RNA, 19 nt, Artificial Sequence
  RNA Oligomer
guauguuaaguuacuucac

SEQ ID NO: 9842 - RNA, 19 nt, Artificial Sequence
  RNA Oligomer
acaucugagaucugagcca

SEQ ID NO: 9843 - RNA, 19 nt, Artificial Sequence
  RNA Oligomer
ucaucuugcacaucugaga

SEQ ID NO: 9844 - RNA, 19 nt, Artificial Sequence
  RNA Oligomer
ugggugauacaugguggaa

SEQ ID NO: 9845 - RNA, 19 nt, Artificial Sequence
  RNA Oligomer
cugggugauacauggugga

SEQ ID NO: 9846 - RNA, 19 nt, Artificial Sequence
  RNA Oligomer
ccagacuggagaaaggacu

SEQ ID NO: 9847 - RNA, 19 nt, Artificial Sequence
  RNA Oligomer
ucaguucacacagguccag

SEQ ID NO: 9848 - RNA, 19 nt, Artificial Sequence
  RNA Oligomer
cacuaaugaaguugggaac

SEQ ID NO: 9849 - RNA, 19 nt, Artificial Sequence
  RNA Oligomer
gaaugaccuuguugcauga

SEQ ID NO: 9850 - RNA, 19 nt, Artificial Sequence
  RNA Oligomer
ugaaugaccuuguugcaug

SEQ ID NO: 9851 - RNA, 19 nt, Artificial Sequence
  RNA Oligomer
agcauuacauuuccaaaug

SEQ ID NO: 9852 - RNA, 19 nt, Artificial Sequence
  RNA Oligomer
caaguuuuucagaaagcau

SEQ ID NO: 9853 - RNA, 19 nt, Artificial Sequence
  RNA Oligomer
ucaaguuuuucagaaagca

SEQ ID NO: 9854 - RNA, 19 nt, Artificial Sequence
  RNA Oligomer
gguaacauccuuucuauug

SEQ ID NO: 9855 - RNA, 19 nt, Artificial Sequence
  RNA Oligomer
ccuuuauugugaucuauca

SEQ ID NO: 9856 - RNA, 19 nt, Artificial Sequence
  RNA Oligomer
gcugaagauuuuggagggu

SEQ ID NO: 9857 - RNA, 19 nt, Artificial Sequence
  RNA Oligomer
cuggugcagagcugaagau

SEQ ID NO: 9858 - RNA, 19 nt, Artificial Sequence
  RNA Oligomer
agcuccuugacuccuugug

SEQ ID NO: 9859 - RNA, 19 nt, Artificial Sequence
  RNA Oligomer
ugaggauucaucuugcaca

SEQ ID NO: 9860 - RNA, 19 nt, Artificial Sequence
  RNA Oligomer
ccugaggauucaucuugca

SEQ ID NO: 9861 - RNA, 19 nt, Artificial Sequence
  RNA Oligomer
gucaaguacacugaaauuc

SEQ ID NO: 9862 - RNA, 19 nt, Artificial Sequence
  RNA Oligomer
uugacaaaaacagcacuuu

SEQ ID NO: 9863 - RNA, 19 nt, Artificial Sequence
  RNA Oligomer
gguccaugugaugcucaau

SEQ ID NO: 9864 - RNA, 19 nt, Artificial Sequence
  RNA Oligomer
aucagccacuaaugaaguu

SEQ ID NO: 9865 - RNA, 19 nt, Artificial Sequence
  RNA Oligomer
cauuacugaagaagacuau

SEQ ID NO: 9866 - RNA, 19 nt, Artificial Sequence
  RNA Oligomer
ggaggugcaguuucagaac

SEQ ID NO: 9867 - RNA, 19 nt, Artificial Sequence
  RNA Oligomer
ugggaugcuuucaagggug

SEQ ID NO: 9868 - RNA, 19 nt, Artificial Sequence
  RNA Oligomer
gugaagaaaagugaaugcu

SEQ ID NO: 9869 - RNA, 19 nt, Artificial Sequence
  RNA Oligomer
agaagguucagacacuaga

SEQ ID NO: 9870 - RNA, 19 nt, Artificial Sequence
  RNA Oligomer
ucaaguacacugaaauuca

SEQ ID NO: 9871 - RNA, 19 nt, Artificial Sequence
  RNA Oligomer
ucagccacuaaugaaguug

SEQ ID NO: 9872 - RNA, 19 nt, Artificial Sequence
  RNA Oligomer
acauuuccaaaugaaugac

SEQ ID NO: 9873 - RNA, 19 nt, Artificial Sequence
  RNA Oligomer
cugaagauuuuggaggguc

SEQ ID NO: 9874 - RNA, 19 nt, Artificial Sequence
  RNA Oligomer
agauucuucuuuggagcag

SEQ ID NO: 9875 - RNA, 19 nt, Artificial Sequence
  RNA Oligomer
cucagaccguaccuugcaa

SEQ ID NO: 9876 - RNA, 19 nt, Artificial Sequence
  RNA Oligomer
gcagagcugaagauuuugg

SEQ ID NO: 9877 - RNA, 19 nt, Artificial Sequence
  RNA Oligomer
guugcaugauguauuuuug

SEQ ID NO: 9878 - RNA, 19 nt, Artificial Sequence
  RNA Oligomer
ggaguguggaaguccauaa

SEQ ID NO: 9879 - RNA, 19 nt, Artificial Sequence
  RNA Oligomer
cuauggccaacugcgaguu

SEQ ID NO: 9880 - RNA, 19 nt, Artificial Sequence
  RNA Oligomer
accuuuauugugaucuauc

SEQ ID NO: 9881 - RNA, 19 nt, Artificial Sequence
  RNA Oligomer
cagagcugaagauuuugga

SEQ ID NO: 9882 - RNA, 19 nt, Artificial Sequence
  RNA Oligomer
ccaggaucccaccauaaaa

SEQ ID NO: 9883 - RNA, 19 nt, Artificial Sequence
  RNA Oligomer
agaccguaccuugcaacaa

SEQ ID NO: 9884 - RNA, 19 nt, Artificial Sequence
  RNA Oligomer
ucagaccguaccuugcaac

SEQ ID NO: 9885 - RNA, 19 nt, Artificial Sequence
  RNA Oligomer
ccauaaacuucauggucau

SEQ ID NO: 9886 - RNA, 19 nt, Artificial Sequence
  RNA Oligomer
cagauagucaaaccauaaa

SEQ ID NO: 9887 - RNA, 19 nt, Artificial Sequence
  RNA Oligomer
gagacauguagacugccaa

SEQ ID NO: 9888 - RNA, 19 nt, Artificial Sequence
  RNA Oligomer
agaauaucuacagaccuga

SEQ ID NO: 9889 - RNA, 19 nt, Artificial Sequence
  RNA Oligomer
guguggaaguccauaauuu

SEQ ID NO: 9890 - RNA, 19 nt, Artificial Sequence
  RNA Oligomer
cugaaauucauccugagau

SEQ ID NO: 9891 - RNA, 19 nt, Artificial Sequence
  RNA Oligomer
cagagacuuaugccaggau

SEQ ID NO: 9892 - RNA, 19 nt, Artificial Sequence
  RNA Oligomer
gaguguggaaguccauaau

SEQ ID NO: 9893 - RNA, 19 nt, Artificial Sequence
  RNA Oligomer
uggagcagaauaaaagauc

SEQ ID NO: 9894 - RNA, 19 nt, Artificial Sequence
  RNA Oligomer
ccuuccuacagauagucaa

SEQ ID NO: 9895 - RNA, 19 nt, Artificial Sequence
  RNA Oligomer
ucacuuuaauucucaugug

SEQ ID NO: 9896 - RNA, 19 nt, Artificial Sequence
  RNA Oligomer
caagaauaucuacagaccu

SEQ ID NO: 9897 - RNA, 19 nt, Artificial Sequence
  RNA Oligomer
agagacuuaugccaggauc

SEQ ID NO: 9898 - RNA, 19 nt, Artificial Sequence
  RNA Oligomer
gugaauucaacacuuccaa

SEQ ID NO: 9899 - RNA, 19 nt, Artificial Sequence
  RNA Oligomer
uuggagcagaauaaaagau

SEQ ID NO: 9900 - RNA, 19 nt, Artificial Sequence
  RNA Oligomer
agauagucaaaccauaaac

SEQ ID NO: 9901 - RNA, 19 nt, Artificial Sequence
  RNA Oligomer
acagauagucaaaccauaa

SEQ ID NO: 9902 - RNA, 19 nt, Artificial Sequence
  RNA Oligomer
ucauacaugacucagcaua

SEQ ID NO: 9903 - RNA, 19 nt, Artificial Sequence
  RNA Oligomer
caccauaaaagagcuggaa

SEQ ID NO: 9904 - RNA, 19 nt, Artificial Sequence
  RNA Oligomer
acacugaaauucauccuga

SEQ ID NO: 9905 - RNA, 19 nt, Artificial Sequence
  RNA Oligomer
caacaacccuguuucagua

SEQ ID NO: 9906 - RNA, 19 nt, Artificial Sequence
  RNA Oligomer
ccacuaaugaaguugggaa

SEQ ID NO: 9907 - RNA, 19 nt, Artificial Sequence
  RNA Oligomer
cugccaaaguguaugggau

SEQ ID NO: 9908 - RNA, 19 nt, Artificial Sequence
  RNA Oligomer
uugguaacauccuuucuau

SEQ ID NO: 9909 - RNA, 19 nt, Artificial Sequence
  RNA Oligomer
ccugacaaguuucuucagu

SEQ ID NO: 9910 - RNA, 19 nt, Artificial Sequence
  RNA Oligomer
gcaagaauaucuacagacc

SEQ ID NO: 9911 - RNA, 19 nt, Artificial Sequence
  RNA Oligomer
ucaauuuuccugcaagaau

SEQ ID NO: 9912 - RNA, 19 nt, Artificial Sequence
  RNA Oligomer
caggaucccaccauaaaag

SEQ ID NO: 9913 - RNA, 19 nt, Artificial Sequence
  RNA Oligomer
ucaguauccugguccugau

SEQ ID NO: 9914 - RNA, 19 nt, Artificial Sequence
  RNA Oligomer
ccaaaugaaugaccuuguu

SEQ ID NO: 9915 - RNA, 19 nt, Artificial Sequence
  RNA Oligomer
ggaauauucaauuuuccug

SEQ ID NO: 9916 - RNA, 19 nt, Artificial Sequence
  RNA Oligomer
cacugaaauucauccugag

SEQ ID NO: 9917 - RNA, 19 nt, Artificial Sequence
  RNA Oligomer
gcgucaaguacacugaaau

SEQ ID NO: 9918 - RNA, 19 nt, Artificial Sequence
  RNA Oligomer
ugcagcaacaacccuguuu

SEQ ID NO: 9919 - RNA, 19 nt, Artificial Sequence
  RNA Oligomer
gcaacaagauucuucuuug

SEQ ID NO: 9920 - RNA, 19 nt, Artificial Sequence
  RNA Oligomer
aagacuaucagccacuaau

SEQ ID NO: 9921 - RNA, 19 nt, Artificial Sequence
  RNA Oligomer
gaagaagacuaucagccac

SEQ ID NO: 9922 - RNA, 19 nt, Artificial Sequence
  RNA Oligomer
acccuuccuacagauaguc

SEQ ID NO: 9923 - RNA, 19 nt, Artificial Sequence
  RNA Oligomer
agacauguagacugccaaa

SEQ ID NO: 9924 - RNA, 19 nt, Artificial Sequence
  RNA Oligomer
ugugaaaaauccugaggau

SEQ ID NO: 9925 - RNA, 19 nt, Artificial Sequence
  RNA Oligomer
cugacaaguuucuucagug

SEQ ID NO: 9926 - RNA, 19 nt, Artificial Sequence
  RNA Oligomer
aguguggaaguccauaauu

SEQ ID NO: 9927 - RNA, 19 nt, Artificial Sequence
  RNA Oligomer
gggaguguggaaguccaua

SEQ ID NO: 9928 - RNA, 19 nt, Artificial Sequence
  RNA Oligomer
cccaucaguucacacaggu

SEQ ID NO: 9929 - RNA, 19 nt, Artificial Sequence
  RNA Oligomer
gcagaauaaaagaucuggc

SEQ ID NO: 9930 - RNA, 19 nt, Artificial Sequence
  RNA Oligomer
gagagcccaacucugucuu

SEQ ID NO: 9931 - RNA, 19 nt, Artificial Sequence
  RNA Oligomer
cuauugaaaaaucaccaca

SEQ ID NO: 9932 - RNA, 19 nt, Artificial Sequence
  RNA Oligomer
cagagacggaagccuuuuu

SEQ ID NO: 9933 - RNA, 19 nt, Artificial Sequence
  RNA Oligomer
ccagagacggaagccuuuu

SEQ ID NO: 9934 - RNA, 19 nt, Artificial Sequence
  RNA Oligomer
ugagacauguagacugcca

SEQ ID NO: 9935 - RNA, 19 nt, Artificial Sequence
  RNA Oligomer
ccuugacuccuugugguuu

SEQ ID NO: 9936 - RNA, 19 nt, Artificial Sequence
  RNA Oligomer
ugcaagaauaucuacagac

SEQ ID NO: 9937 - RNA, 19 nt, Artificial Sequence
  RNA Oligomer
ccauaaaagagcuggaauc

SEQ ID NO: 9938 - RNA, 19 nt, Artificial Sequence
  RNA Oligomer
ccaccauaaaagagcugga

SEQ ID NO: 9939 - RNA, 19 nt, Artificial Sequence
  RNA Oligomer
ccagagacuuaugccagga

SEQ ID NO: 9940 - RNA, 19 nt, Artificial Sequence
  RNA Oligomer
ugcgucaaguacacugaaa

SEQ ID NO: 9941 - RNA, 19 nt, Artificial Sequence
  RNA Oligomer
accauaaacuucaugguca

SEQ ID NO: 9942 - RNA, 19 nt, Artificial Sequence
  RNA Oligomer
cuacagauagucaaaccau

SEQ ID NO: 9943 - RNA, 19 nt, Artificial Sequence
  RNA Oligomer
uuguacccuuccuacagau

SEQ ID NO: 9944 - RNA, 19 nt, Artificial Sequence
  RNA Oligomer
ccaaaguguaugggaugcu

SEQ ID NO: 9945 - RNA, 19 nt, Artificial Sequence
  RNA Oligomer
gacauguagacugccaaag

SEQ ID NO: 9946 - RNA, 19 nt, Artificial Sequence
  RNA Oligomer
uccuugacuccuugugguu

SEQ ID NO: 9947 - RNA, 19 nt, Artificial Sequence
  RNA Oligomer
ccagucgcugugguuguuu

SEQ ID NO: 9948 - RNA, 19 nt, Artificial Sequence
  RNA Oligomer
gugugaaaaauccugagga

SEQ ID NO: 9949 - RNA, 19 nt, Artificial Sequence
  RNA Oligomer
ccugcaagaauaucuacag

SEQ ID NO: 9950 - RNA, 19 nt, Artificial Sequence
  RNA Oligomer
ugaaauucauccugagaug

SEQ ID NO: 9951 - RNA, 19 nt, Artificial Sequence
  RNA Oligomer
ggaucccgcaguaaaaucu

SEQ ID NO: 9952 - RNA, 19 nt, Artificial Sequence
  RNA Oligomer
cgaugcgucaaguacacug

SEQ ID NO: 9953 - RNA, 19 nt, Artificial Sequence
  RNA Oligomer
gcagcaacaacccuguuuc

SEQ ID NO: 9954 - RNA, 19 nt, Artificial Sequence
  RNA Oligomer
cuaucagccacuaaugaag

SEQ ID NO: 9955 - RNA, 19 nt, Artificial Sequence
  RNA Oligomer
ccuacagauagucaaacca

SEQ ID NO: 9956 - RNA, 19 nt, Artificial Sequence
  RNA Oligomer
ucagaaagcauuacauuuc

SEQ ID NO: 9957 - RNA, 19 nt, Artificial Sequence
  RNA Oligomer
agagacggaagccuuuuuc

SEQ ID NO: 9958 - RNA, 19 nt, Artificial Sequence
  RNA Oligomer
acaauaaggucaaugccag

SEQ ID NO: 9959 - RNA, 19 nt, Artificial Sequence
  RNA Oligomer
acaugacucagcauaccug

SEQ ID NO: 9960 - RNA, 19 nt, Artificial Sequence
  RNA Oligomer
cgcugugguuguuuuagcu

SEQ ID NO: 9961 - RNA, 19 nt, Artificial Sequence
  RNA Oligomer
gugaaaaauccugaggauu

SEQ ID NO: 9962 - RNA, 19 nt, Artificial Sequence
  RNA Oligomer
uggaaguccauaauuugca

SEQ ID NO: 9963 - RNA, 19 nt, Artificial Sequence
  RNA Oligomer
cugcagcaacaacccuguu

SEQ ID NO: 9964 - RNA, 19 nt, Artificial Sequence
  RNA Oligomer
ggugaauucaacacuucca

SEQ ID NO: 9965 - RNA, 19 nt, Artificial Sequence
  RNA Oligomer
acaagauucuucuuuggag

SEQ ID NO: 9966 - RNA, 19 nt, Artificial Sequence
  RNA Oligomer
ggaacucagaccguaccuu

SEQ ID NO: 9967 - RNA, 19 nt, Artificial Sequence
  RNA Oligomer
ugcuuucaagggugcauuu

SEQ ID NO: 9968 - RNA, 19 nt, Artificial Sequence
  RNA Oligomer
ucaaaccauaaacuucaug

SEQ ID NO: 9969 - RNA, 19 nt, Artificial Sequence
  RNA Oligomer
uacagauagucaaaccaua

SEQ ID NO: 9970 - RNA, 19 nt, Artificial Sequence
  RNA Oligomer
gucaaugccagagacggaa

SEQ ID NO: 9971 - RNA, 19 nt, Artificial Sequence
  RNA Oligomer
ugacucagcauaccugcug

SEQ ID NO: 9972 - RNA, 19 nt, Artificial Sequence
  RNA Oligomer
ggaucccaccauaaaagag

SEQ ID NO: 9973 - RNA, 19 nt, Artificial Sequence
  RNA Oligomer
ugcaaccagagaagguuca

SEQ ID NO: 9974 - RNA, 19 nt, Artificial Sequence
  RNA Oligomer
cagcacuuuugggagugug

SEQ ID NO: 9975 - RNA, 19 nt, Artificial Sequence
  RNA Oligomer
guauccugguccugauccu

SEQ ID NO: 9976 - RNA, 19 nt, Artificial Sequence
  RNA Oligomer
ccuugcugaugaccucaca

SEQ ID NO: 9977 - RNA, 19 nt, Artificial Sequence
  RNA Oligomer
aggcuaccuugcugaugac

SEQ ID NO: 9978 - RNA, 19 nt, Artificial Sequence
  RNA Oligomer
cccuuccuacagauaguca

SEQ ID NO: 9979 - RNA, 19 nt, Artificial Sequence
  RNA Oligomer
ugguaacauccuuucuauu

SEQ ID NO: 9980 - RNA, 19 nt, Artificial Sequence
  RNA Oligomer
ugaaaaauccugaggauuc

SEQ ID NO: 9981 - RNA, 19 nt, Artificial Sequence
  RNA Oligomer
accauaaaagagcuggaau

SEQ ID NO: 9982 - RNA, 19 nt, Artificial Sequence
  RNA Oligomer
ucccaccauaaaagagcug

SEQ ID NO: 9983 - RNA, 19 nt, Artificial Sequence
  RNA Oligomer
ugccaggaucccaccauaa

SEQ ID NO: 9984 - RNA, 19 nt, Artificial Sequence
  RNA Oligomer
gcaaccagagaagguucag

SEQ ID NO: 9985 - RNA, 19 nt, Artificial Sequence
  RNA Oligomer
guguggugaauucaacacu

SEQ ID NO: 9986 - RNA, 19 nt, Artificial Sequence
  RNA Oligomer
gguguggugaauucaacac

SEQ ID NO: 9987 - RNA, 19 nt, Artificial Sequence
  RNA Oligomer
ccaucaguucacacagguc

SEQ ID NO: 9988 - RNA, 19 nt, Artificial Sequence
  RNA Oligomer
cuucuuuggagcagaauaa

SEQ ID NO: 9989 - RNA, 19 nt, Artificial Sequence
  RNA Oligomer
agaaagcauuacauuucca

SEQ ID NO: 9990 - RNA, 19 nt, Artificial Sequence
  RNA Oligomer
gcacaucugagaucugagc

SEQ ID NO: 9991 - RNA, 19 nt, Artificial Sequence
  RNA Oligomer
uccugcaagaauaucuaca

SEQ ID NO: 9992 - RNA, 19 nt, Artificial Sequence
  RNA Oligomer
guacacugaaauucauccu

SEQ ID NO: 9993 - RNA, 19 nt, Artificial Sequence
  RNA Oligomer
ccaugugaugcucaaugga

SEQ ID NO: 9994 - RNA, 19 nt, Artificial Sequence
  RNA Oligomer
guccaugugaugcucaaug

SEQ ID NO: 9995 - RNA, 19 nt, Artificial Sequence
  RNA Oligomer
cccuguuucaguauucugg

SEQ ID NO: 9996 - RNA, 19 nt, Artificial Sequence
  RNA Oligomer
gcaacaacccuguuucagu

SEQ ID NO: 9997 - RNA, 19 nt, Artificial Sequence
  RNA Oligomer
cuaucaaucuugcccagac

SEQ ID NO: 9998 - RNA, 19 nt, Artificial Sequence
  RNA Oligomer
cucacaugguguggugaau

SEQ ID NO: 9999 - RNA, 19 nt, Artificial Sequence
  RNA Oligomer
accuugcugaugaccucac

SEQ ID NO: 10000 - RNA, 19 nt, Artificial Sequence
  RNA Oligomer
caacaagauucuucuuugg

SEQ ID NO: 10001 - RNA, 19 nt, Artificial Sequence
  RNA Oligomer
ugcaacaagauucuucuuu

SEQ ID NO: 10002 - RNA, 19 nt, Artificial Sequence
  RNA Oligomer
guaccuugcaacaagauuc

SEQ ID NO: 10003 - RNA, 19 nt, Artificial Sequence
  RNA Oligomer
agacuaucagccacuaaug

SEQ ID NO: 10004 - RNA, 19 nt, Artificial Sequence
  RNA Oligomer
uccuugcaacauuacugaa

SEQ ID NO: 10005 - RNA, 19 nt, Artificial Sequence
  RNA Oligomer
augcuuucaagggugcauu

SEQ ID NO: 10006 - RNA, 19 nt, Artificial Sequence
  RNA Oligomer
ccacaauaaggucaaugcc

SEQ ID NO: 10007 - RNA, 19 nt, Artificial Sequence
  RNA Oligomer
acagcacuuuugggagugu

SEQ ID NO: 10008 - RNA, 19 nt, Artificial Sequence
  RNA Oligomer
gacaaaaacagcacuuuug

SEQ ID NO: 10009 - RNA, 19 nt, Artificial Sequence
  RNA Oligomer
ucaguauucuggaaaacgg

SEQ ID NO: 10010 - RNA, 19 nt, Artificial Sequence
  RNA Oligomer
cuguuucaguauucuggaa

SEQ ID NO: 10011 - RNA, 19 nt, Artificial Sequence
  RNA Oligomer
cacaugguguggugaauuc

SEQ ID NO: 10012 - RNA, 19 nt, Artificial Sequence
  RNA Oligomer
ccguaccuugcaacaagau

SEQ ID NO: 10013 - RNA, 19 nt, Artificial Sequence
  RNA Oligomer
gccacuaaugaaguuggga

SEQ ID NO: 10014 - RNA, 19 nt, Artificial Sequence
  RNA Oligomer
ugcaacauuacugaagaag

SEQ ID NO: 10015 - RNA, 19 nt, Artificial Sequence
  RNA Oligomer
gaugcuuucaagggugcau

SEQ ID NO: 10016 - RNA, 19 nt, Artificial Sequence
  RNA Oligomer
ggaugcuuucaagggugca

SEQ ID NO: 10017 - RNA, 19 nt, Artificial Sequence
  RNA Oligomer
gccaaaguguaugggaugc

SEQ ID NO: 10018 - RNA, 19 nt, Artificial Sequence
  RNA Oligomer
uccaaaugaaugaccuugu

SEQ ID NO: 10019 - RNA, 19 nt, Artificial Sequence
  RNA Oligomer
cagaaagcauuacauuucc

SEQ ID NO: 10020 - RNA, 19 nt, Artificial Sequence
  RNA Oligomer
ugaucuaucaauagucaag

SEQ ID NO: 10021 - RNA, 19 nt, Artificial Sequence
  RNA Oligomer
caguuucagaacccagcca

SEQ ID NO: 10022 - RNA, 19 nt, Artificial Sequence
  RNA Oligomer
ugggaguguggaaguccau

SEQ ID NO: 10023 - RNA, 19 nt, Artificial Sequence
  RNA Oligomer
cacuuuugggaguguggaa

SEQ ID NO: 10024 - RNA, 19 nt, Artificial Sequence
  RNA Oligomer
gcacuuuugggagugugga

SEQ ID NO: 10025 - RNA, 19 nt, Artificial Sequence
  RNA Oligomer
guuucaguauucuggaaaa

SEQ ID NO: 10026 - RNA, 19 nt, Artificial Sequence
  RNA Oligomer
ucacaugguguggugaauu

SEQ ID NO: 10027 - RNA, 19 nt, Artificial Sequence
  RNA Oligomer
ccucacaugguguggugaa

SEQ ID NO: 10028 - RNA, 19 nt, Artificial Sequence
  RNA Oligomer
gcuaggcuaccuugcugau

SEQ ID NO: 10029 - RNA, 19 nt, Artificial Sequence
  RNA Oligomer
ggagcagaauaaaagaucu

SEQ ID NO: 10030 - RNA, 19 nt, Artificial Sequence
  RNA Oligomer
acuucauggucauggguaa

SEQ ID NO: 10031 - RNA, 19 nt, Artificial Sequence
  RNA Oligomer
gugaucuaucaauagucaa

SEQ ID NO: 10032 - RNA, 19 nt, Artificial Sequence
  RNA Oligomer
ggugcaguuucagaaccca

SEQ ID NO: 10033 - RNA, 19 nt, Artificial Sequence
  RNA Oligomer
ccuugcaacauuacugaag

SEQ ID NO: 10034 - RNA, 19 nt, Artificial Sequence
  RNA Oligomer
caaccagagaagguucaga

SEQ ID NO: 10035 - RNA, 19 nt, Artificial Sequence
  RNA Oligomer
uguuucaguauucuggaaa

SEQ ID NO: 10036 - RNA, 19 nt, Artificial Sequence
  RNA Oligomer
ugaccucacaugguguggu

SEQ ID NO: 10037 - RNA, 19 nt, Artificial Sequence
  RNA Oligomer
cugaugaccucacauggug

SEQ ID NO: 10038 - RNA, 19 nt, Artificial Sequence
  RNA Oligomer
accguaccuugcaacaaga

SEQ ID NO: 10039 - RNA, 19 nt, Artificial Sequence
  RNA Oligomer
ugugaucuaucaauaguca

SEQ ID NO: 10040 - RNA, 19 nt, Artificial Sequence
  RNA Oligomer
ccuugcaacaagauucuuc

SEQ ID NO: 10041 - RNA, 19 nt, Artificial Sequence
  RNA Oligomer
cguaccuugcaacaagauu

SEQ ID NO: 10042 - RNA, 19 nt, Artificial Sequence
  RNA Oligomer
gaccguaccuugcaacaag

SEQ ID NO: 10043 - RNA, 19 nt, Artificial Sequence
  RNA Oligomer
ucuucagugugugaaaaau

SEQ ID NO: 10044 - RNA, 19 nt, Artificial Sequence
  RNA Oligomer
accuugcaacaagauucuu

SEQ ID NO: 10045 - RNA, 19 nt, Artificial Sequence
  RNA Oligomer
gaaaaauccugaggauuca

SEQ ID NO: 10046 - RNA, 19 nt, Artificial Sequence
  RNA Oligomer
aguuucuucagugugugaa

SEQ ID NO: 10047 - RNA, 19 nt, Artificial Sequence
  RNA Oligomer
ugcagaagcugccugugau

SEQ ID NO: 10048 - RNA, 19 nt, Artificial Sequence
  RNA Oligomer
gagcagaauaaaagaucug

SEQ ID NO: 10049 - RNA, 19 nt, Artificial Sequence
  RNA Oligomer
ggaagagaagauuccagag

SEQ ID NO: 10050 - RNA, 19 nt, Artificial Sequence
  RNA Oligomer
uggaagagaagauuccaga

SEQ ID NO: 10051 - RNA, 19 nt, Artificial Sequence
  RNA Oligomer
ccagagaagguucagacac

SEQ ID NO: 10052 - RNA, 19 nt, Artificial Sequence
  RNA Oligomer
guggaagagaagauuccag

SEQ ID NO: 10053 - RNA, 19 nt, Artificial Sequence
  RNA Oligomer
ugccugugaugugguccau

SEQ ID NO: 10054 - RNA, 19 nt, Artificial Sequence
  RNA Oligomer
uuuugaaauaaaugcaccc

SEQ ID NO: 10055 - RNA, 19 nt, Artificial Sequence
  RNA Oligomer
guacaaaaauacaucaugc

SEQ ID NO: 10056 - RNA, 19 nt, Artificial Sequence
  RNA Oligomer
uuucugaaaaacuugagca

SEQ ID NO: 10057 - RNA, 19 nt, Artificial Sequence
  RNA Oligomer
cuuucugaaaaacuugagc

SEQ ID NO: 10058 - RNA, 19 nt, Artificial Sequence
  RNA Oligomer
auaaaaggaucacaugaga

SEQ ID NO: 10059 - RNA, 19 nt, Artificial Sequence
  RNA Oligomer
aaggguacaaaaauacauc

SEQ ID NO: 10060 - RNA, 19 nt, Artificial Sequence
  RNA Oligomer
aggguacaaaaauacauca

SEQ ID NO: 10061 - RNA, 19 nt, Artificial Sequence
  RNA Oligomer
uuccuuuugcuuauaaucg

SEQ ID NO: 10062 - RNA, 19 nt, Artificial Sequence
  RNA Oligomer
aggaaggguacaaaaauac

SEQ ID NO: 10063 - RNA, 19 nt, Artificial Sequence
  RNA Oligomer
cauaaaaggaucacaugag

SEQ ID NO: 10064 - RNA, 19 nt, Artificial Sequence
  RNA Oligomer
uauaaucgauuccagcucu

SEQ ID NO: 10065 - RNA, 19 nt, Artificial Sequence
  RNA Oligomer
aauacaucaugcaacaagg

SEQ ID NO: 10066 - RNA, 19 nt, Artificial Sequence
  RNA Oligomer
uucugaaaaacuugagcau

SEQ ID NO: 10067 - RNA, 19 nt, Artificial Sequence
  RNA Oligomer
aaggaucacaugagaauua

SEQ ID NO: 10068 - RNA, 19 nt, Artificial Sequence
  RNA Oligomer
ucacaugagaauuaaagug

SEQ ID NO: 10069 - RNA, 19 nt, Artificial Sequence
  RNA Oligomer
agaaacuugucaggucugu

SEQ ID NO: 10070 - RNA, 19 nt, Artificial Sequence
  RNA Oligomer
ugucaaagauuuuacugcg

SEQ ID NO: 10071 - RNA, 19 nt, Artificial Sequence
  RNA Oligomer
gucaaagauuuuacugcgg

SEQ ID NO: 10072 - RNA, 19 nt, Artificial Sequence
  RNA Oligomer
ucaaagauuuuacugcggg

SEQ ID NO: 10073 - RNA, 19 nt, Artificial Sequence
  RNA Oligomer
augaaguuuaugguuugac

SEQ ID NO: 10074 - RNA, 19 nt, Artificial Sequence
  RNA Oligomer
gcuuucugaaaaacuugag

SEQ ID NO: 10075 - RNA, 19 nt, Artificial Sequence
  RNA Oligomer
gaagaaacuugucaggucu

SEQ ID NO: 10076 - RNA, 19 nt, Artificial Sequence
  RNA Oligomer
aucuucucuuccaccaugu

SEQ ID NO: 10077 - RNA, 19 nt, Artificial Sequence
  RNA Oligomer
aaauacaucaugcaacaag

SEQ ID NO: 10078 - RNA, 19 nt, Artificial Sequence
  RNA Oligomer
auucacuuuucuucacuug

SEQ ID NO: 10079 - RNA, 19 nt, Artificial Sequence
  RNA Oligomer
uuucuucacuugccuguuc

SEQ ID NO: 10080 - RNA, 19 nt, Artificial Sequence
  RNA Oligomer
gaucacaugagaauuaaag

SEQ ID NO: 10081 - RNA, 19 nt, Artificial Sequence
  RNA Oligomer
guuauuuuaagacuuuggg

SEQ ID NO: 10082 - RNA, 19 nt, Artificial Sequence
  RNA Oligomer
uccuuuugcuuauaaucga

SEQ ID NO: 10083 - RNA, 19 nt, Artificial Sequence
  RNA Oligomer
agucucuggaaucuucucu

SEQ ID NO: 10084 - RNA, 19 nt, Artificial Sequence
  RNA Oligomer
cugaaaaacuugagcauuc

SEQ ID NO: 10085 - RNA, 19 nt, Artificial Sequence
  RNA Oligomer
ugaaaaacuugagcauuca

SEQ ID NO: 10086 - RNA, 19 nt, Artificial Sequence
  RNA Oligomer
aaaaacuugagcauucacu

SEQ ID NO: 10087 - RNA, 19 nt, Artificial Sequence
  RNA Oligomer
uucacuuuucuucacuugc

SEQ ID NO: 10088 - RNA, 19 nt, Artificial Sequence
  RNA Oligomer
ucacuuuucuucacuugcc

SEQ ID NO: 10089 - RNA, 19 nt, Artificial Sequence
  RNA Oligomer
cuuuucuucacuugccugu

SEQ ID NO: 10090 - RNA, 19 nt, Artificial Sequence
  RNA Oligomer
uucuucacuugccuguucu

SEQ ID NO: 10091 - RNA, 19 nt, Artificial Sequence
  RNA Oligomer
gucuacaugucucaucuca

SEQ ID NO: 10092 - RNA, 19 nt, Artificial Sequence
  RNA Oligomer
cacacacugaagaaacuug

SEQ ID NO: 10093 - RNA, 19 nt, Artificial Sequence
  RNA Oligomer
augaauuucaguguacuug

SEQ ID NO: 10094 - RNA, 19 nt, Artificial Sequence
  RNA Oligomer
cugguugcaaauuauggac

SEQ ID NO: 10095 - RNA, 19 nt, Artificial Sequence
  RNA Oligomer
ugggccagaucuuuuauuc

SEQ ID NO: 10096 - RNA, 19 nt, Artificial Sequence
  RNA Oligomer
ucauuuggaaauguaaugc

SEQ ID NO: 10097 - RNA, 19 nt, Artificial Sequence
  RNA Oligomer
aacuugagcauucacuuuu

SEQ ID NO: 10098 - RNA, 19 nt, Artificial Sequence
  RNA Oligomer
acuugagcauucacuuuuc

SEQ ID NO: 10099 - RNA, 19 nt, Artificial Sequence
  RNA Oligomer
uugguguggugauuuuuca

SEQ ID NO: 10100 - RNA, 19 nt, Artificial Sequence
  RNA Oligomer
ucaauagaaaggauguuac

SEQ ID NO: 10101 - RNA, 19 nt, Artificial Sequence
  RNA Oligomer
cuacaugucucaucucagg

SEQ ID NO: 10102 - RNA, 19 nt, Artificial Sequence
  RNA Oligomer
aaaacaaccacagcgacug

SEQ ID NO: 10103 - RNA, 19 nt, Artificial Sequence
  RNA Oligomer
cuuccaccauguaucaccc

SEQ ID NO: 10104 - RNA, 19 nt, Artificial Sequence
  RNA Oligomer
guugcaaauuauggacuuc

SEQ ID NO: 10105 - RNA, 19 nt, Artificial Sequence
  RNA Oligomer
aaaccguuuuccagaauac

SEQ ID NO: 10106 - RNA, 19 nt, Artificial Sequence
  RNA Oligomer
acaucaugcaacaagguca

SEQ ID NO: 10107 - RNA, 19 nt, Artificial Sequence
  RNA Oligomer
uugccuguucuaauaagag

SEQ ID NO: 10108 - RNA, 19 nt, Artificial Sequence
  RNA Oligomer
cagucuacaugucucaucu

SEQ ID NO: 10109 - RNA, 19 nt, Artificial Sequence
  RNA Oligomer
cucaggauuuuucacacac

SEQ ID NO: 10110 - RNA, 19 nt, Artificial Sequence
  RNA Oligomer
auaaucgauuccagcucuu

SEQ ID NO: 10111 - RNA, 19 nt, Artificial Sequence
  RNA Oligomer
ucugguugcaaauuaugga

SEQ ID NO: 10112 - RNA, 19 nt, Artificial Sequence
  RNA Oligomer
uagucuucuucaguaaugu

SEQ ID NO: 10113 - RNA, 19 nt, Artificial Sequence
  RNA Oligomer
uucugaaacugcaccuccc

SEQ ID NO: 10114 - RNA, 19 nt, Artificial Sequence
  RNA Oligomer
uugaaagcaucccauacac

SEQ ID NO: 10115 - RNA, 19 nt, Artificial Sequence
  RNA Oligomer
uacaucaugcaacaagguc

SEQ ID NO: 10116 - RNA, 19 nt, Artificial Sequence
  RNA Oligomer
cuugagcauucacuuuucu

SEQ ID NO: 10117 - RNA, 19 nt, Artificial Sequence
  RNA Oligomer
ugagcauucacuuuucuuc

SEQ ID NO: 10118 - RNA, 19 nt, Artificial Sequence
  RNA Oligomer
guaugcugaugauauaagu

SEQ ID NO: 10119 - RNA, 19 nt, Artificial Sequence
  RNA Oligomer
uacaugucucaucucagga

SEQ ID NO: 10120 - RNA, 19 nt, Artificial Sequence
  RNA Oligomer
ucaaggagcuaaaacaacc

SEQ ID NO: 10121 - RNA, 19 nt, Artificial Sequence
  RNA Oligomer
ugcuuauaaucgauuccag

SEQ ID NO: 10122 - RNA, 19 nt, Artificial Sequence
  RNA Oligomer
aaucuucucuuccaccaug

SEQ ID NO: 10123 - RNA, 19 nt, Artificial Sequence
  RNA Oligomer
uucucugguugcaaauuau

SEQ ID NO: 10124 - RNA, 19 nt, Artificial Sequence
  RNA Oligomer
cucugguugcaaauuaugg

SEQ ID NO: 10125 - RNA, 19 nt, Artificial Sequence
  RNA Oligomer
ugguugcaaauuauggacu

SEQ ID NO: 10126 - RNA, 19 nt, Artificial Sequence
  RNA Oligomer
caaagauuuuacugcggga

SEQ ID NO: 10127 - RNA, 19 nt, Artificial Sequence
  RNA Oligomer
aaagauuuuacugcgggau

SEQ ID NO: 10128 - RNA, 19 nt, Artificial Sequence
  RNA Oligomer
uugagcaucacauggacca

SEQ ID NO: 10129 - RNA, 19 nt, Artificial Sequence
  RNA Oligomer
ugugugaacugaugggcca

SEQ ID NO: 10130 - RNA, 19 nt, Artificial Sequence
  RNA Oligomer
auguugcaaggauguuuug

SEQ ID NO: 10131 - RNA, 19 nt, Artificial Sequence
  RNA Oligomer
auacaucaugcaacaaggu

SEQ ID NO: 10132 - RNA, 19 nt, Artificial Sequence
  RNA Oligomer
uuggaaauguaaugcuuuc

SEQ ID NO: 10133 - RNA, 19 nt, Artificial Sequence
  RNA Oligomer
cacuuuucuucacuugccu

SEQ ID NO: 10134 - RNA, 19 nt, Artificial Sequence
  RNA Oligomer
uuugguguggugauuuuuc

SEQ ID NO: 10135 - RNA, 19 nt, Artificial Sequence
  RNA Oligomer
auaaagguaugcugaugau

SEQ ID NO: 10136 - RNA, 19 nt, Artificial Sequence
  RNA Oligomer
aaaagugcuguuuuuguca

SEQ ID NO: 10137 - RNA, 19 nt, Artificial Sequence
  RNA Oligomer
gaggucaucagcaagguag

SEQ ID NO: 10138 - RNA, 19 nt, Artificial Sequence
  RNA Oligomer
gaguucccaacuucauuag

SEQ ID NO: 10139 - RNA, 19 nt, Artificial Sequence
  RNA Oligomer
guuuugaaauaaaugcacc

SEQ ID NO: 10140 - RNA, 19 nt, Artificial Sequence
  RNA Oligomer
gugaaguaacuuaacauac

SEQ ID NO: 10141 - RNA, 19 nt, Artificial Sequence
  RNA Oligomer
uggcucagaucucagaugu

SEQ ID NO: 10142 - RNA, 19 nt, Artificial Sequence
  RNA Oligomer
ucucagaugugcaagauga

SEQ ID NO: 10143 - RNA, 19 nt, Artificial Sequence
  RNA Oligomer
uuccaccauguaucaccca

SEQ ID NO: 10144 - RNA, 19 nt, Artificial Sequence
  RNA Oligomer
uccaccauguaucacccag

SEQ ID NO: 10145 - RNA, 19 nt, Artificial Sequence
  RNA Oligomer
aguccuuucuccagucugg

SEQ ID NO: 10146 - RNA, 19 nt, Artificial Sequence
  RNA Oligomer
cuggaccugugugaacuga

SEQ ID NO: 10147 - RNA, 19 nt, Artificial Sequence
  RNA Oligomer
guucccaacuucauuagug

SEQ ID NO: 10148 - RNA, 19 nt, Artificial Sequence
  RNA Oligomer
ucaugcaacaaggucauuc

SEQ ID NO: 10149 - RNA, 19 nt, Artificial Sequence
  RNA Oligomer
caugcaacaaggucauuca

SEQ ID NO: 10150 - RNA, 19 nt, Artificial Sequence
  RNA Oligomer
cauuuggaaauguaaugcu

SEQ ID NO: 10151 - RNA, 19 nt, Artificial Sequence
  RNA Oligomer
augcuuucugaaaaacuug

SEQ ID NO: 10152 - RNA, 19 nt, Artificial Sequence
  RNA Oligomer
ugcuuucugaaaaacuuga

SEQ ID NO: 10153 - RNA, 19 nt, Artificial Sequence
  RNA Oligomer
caauagaaaggauguuacc

SEQ ID NO: 10154 - RNA, 19 nt, Artificial Sequence
  RNA Oligomer
ugauagaucacaauaaagg

SEQ ID NO: 10155 - RNA, 19 nt, Artificial Sequence
  RNA Oligomer
acccuccaaaaucuucagc

SEQ ID NO: 10156 - RNA, 19 nt, Artificial Sequence
  RNA Oligomer
aucuucagcucugcaccag

SEQ ID NO: 10157 - RNA, 19 nt, Artificial Sequence
  RNA Oligomer
cacaaggagucaaggagcu

SEQ ID NO: 10158 - RNA, 19 nt, Artificial Sequence
  RNA Oligomer
ugugcaagaugaauccuca

SEQ ID NO: 10159 - RNA, 19 nt, Artificial Sequence
  RNA Oligomer
ugcaagaugaauccucagg

SEQ ID NO: 10160 - RNA, 19 nt, Artificial Sequence
  RNA Oligomer
gaauuucaguguacuugac

SEQ ID NO: 10161 - RNA, 19 nt, Artificial Sequence
  RNA Oligomer
aaagugcuguuuuugucaa

SEQ ID NO: 10162 - RNA, 19 nt, Artificial Sequence
  RNA Oligomer
auugagcaucacauggacc

SEQ ID NO: 10163 - RNA, 19 nt, Artificial Sequence
  RNA Oligomer
aacuucauuaguggcugau

SEQ ID NO: 10164 - RNA, 19 nt, Artificial Sequence
  RNA Oligomer
auagucuucuucaguaaug

SEQ ID NO: 10165 - RNA, 19 nt, Artificial Sequence
  RNA Oligomer
guucugaaacugcaccucc

SEQ ID NO: 10166 - RNA, 19 nt, Artificial Sequence
  RNA Oligomer
cacccuugaaagcauccca

SEQ ID NO: 10167 - RNA, 19 nt, Artificial Sequence
  RNA Oligomer
agcauucacuuuucuucac

SEQ ID NO: 10168 - RNA, 19 nt, Artificial Sequence
  RNA Oligomer
ucuagugucugaaccuucu

SEQ ID NO: 10169 - RNA, 19 nt, Artificial Sequence
  RNA Oligomer
ugaauuucaguguacuuga

SEQ ID NO: 10170 - RNA, 19 nt, Artificial Sequence
  RNA Oligomer
caacuucauuaguggcuga

SEQ ID NO: 10171 - RNA, 19 nt, Artificial Sequence
  RNA Oligomer
gucauucauuuggaaaugu

SEQ ID NO: 10172 - RNA, 19 nt, Artificial Sequence
  RNA Oligomer
gacccuccaaaaucuucag

SEQ ID NO: 10173 - RNA, 19 nt, Artificial Sequence
  RNA Oligomer
cugcuccaaagaagaaucu

SEQ ID NO: 10174 - RNA, 19 nt, Artificial Sequence
  RNA Oligomer
uugcaagguacggucugag

SEQ ID NO: 10175 - RNA, 19 nt, Artificial Sequence
  RNA Oligomer
ccaaaaucuucagcucugc

SEQ ID NO: 10176 - RNA, 19 nt, Artificial Sequence
  RNA Oligomer
caaaaauacaucaugcaac

SEQ ID NO: 10177 - RNA, 19 nt, Artificial Sequence
  RNA Oligomer
uuauggacuuccacacucc

SEQ ID NO: 10178 - RNA, 19 nt, Artificial Sequence
  RNA Oligomer
aacucgcaguuggccauag

SEQ ID NO: 10179 - RNA, 19 nt, Artificial Sequence
  RNA Oligomer
gauagaucacaauaaaggu

SEQ ID NO: 10180 - RNA, 19 nt, Artificial Sequence
  RNA Oligomer
uccaaaaucuucagcucug

SEQ ID NO: 10181 - RNA, 19 nt, Artificial Sequence
  RNA Oligomer
uuuuauggugggauccugg

SEQ ID NO: 10182 - RNA, 19 nt, Artificial Sequence
  RNA Oligomer
uuguugcaagguacggucu

SEQ ID NO: 10183 - RNA, 19 nt, Artificial Sequence
  RNA Oligomer
guugcaagguacggucuga

SEQ ID NO: 10184 - RNA, 19 nt, Artificial Sequence
  RNA Oligomer
augaccaugaaguuuaugg

SEQ ID NO: 10185 - RNA, 19 nt, Artificial Sequence
  RNA Oligomer
uuuaugguuugacuaucug

SEQ ID NO: 10186 - RNA, 19 nt, Artificial Sequence
  RNA Oligomer
uuggcagucuacaugucuc

SEQ ID NO: 10187 - RNA, 19 nt, Artificial Sequence
  RNA Oligomer
ucaggucuguagauauucu

SEQ ID NO: 10188 - RNA, 19 nt, Artificial Sequence
  RNA Oligomer
aaauuauggacuuccacac

SEQ ID NO: 10189 - RNA, 19 nt, Artificial Sequence
  RNA Oligomer
aucucaggaugaauuucag

SEQ ID NO: 10190 - RNA, 19 nt, Artificial Sequence
  RNA Oligomer
auccuggcauaagucucug

SEQ ID NO: 10191 - RNA, 19 nt, Artificial Sequence
  RNA Oligomer
auuauggacuuccacacuc

SEQ ID NO: 10192 - RNA, 19 nt, Artificial Sequence
  RNA Oligomer
gaucuuuuauucugcucca

SEQ ID NO: 10193 - RNA, 19 nt, Artificial Sequence
  RNA Oligomer
uugacuaucuguaggaagg

SEQ ID NO: 10194 - RNA, 19 nt, Artificial Sequence
  RNA Oligomer
cacaugagaauuaaaguga

SEQ ID NO: 10195 - RNA, 19 nt, Artificial Sequence
  RNA Oligomer
aggucuguagauauucuug

SEQ ID NO: 10196 - RNA, 19 nt, Artificial Sequence
  RNA Oligomer
gauccuggcauaagucucu

SEQ ID NO: 10197 - RNA, 19 nt, Artificial Sequence
  RNA Oligomer
uuggaaguguugaauucac

SEQ ID NO: 10198 - RNA, 19 nt, Artificial Sequence
  RNA Oligomer
aucuuuuauucugcuccaa

SEQ ID NO: 10199 - RNA, 19 nt, Artificial Sequence
  RNA Oligomer
guuuaugguuugacuaucu

SEQ ID NO: 10200 - RNA, 19 nt, Artificial Sequence
  RNA Oligomer
uuaugguuugacuaucugu

SEQ ID NO: 10201 - RNA, 19 nt, Artificial Sequence
  RNA Oligomer
uaugcugagucauguauga

SEQ ID NO: 10202 - RNA, 19 nt, Artificial Sequence
  RNA Oligomer
uuccagcucuuuuauggug

SEQ ID NO: 10203 - RNA, 19 nt, Artificial Sequence
  RNA Oligomer
ucaggaugaauuucagugu

SEQ ID NO: 10204 - RNA, 19 nt, Artificial Sequence
  RNA Oligomer
uacugaaacaggguuguug

SEQ ID NO: 10205 - RNA, 19 nt, Artificial Sequence
  RNA Oligomer
uucccaacuucauuagugg

SEQ ID NO: 10206 - RNA, 19 nt, Artificial Sequence
  RNA Oligomer
aucccauacacuuuggcag

SEQ ID NO: 10207 - RNA, 19 nt, Artificial Sequence
  RNA Oligomer
auagaaaggauguuaccaa

SEQ ID NO: 10208 - RNA, 19 nt, Artificial Sequence
  RNA Oligomer
acugaagaaacuugucagg

SEQ ID NO: 10209 - RNA, 19 nt, Artificial Sequence
  RNA Oligomer
ggucuguagauauucuugc

SEQ ID NO: 10210 - RNA, 19 nt, Artificial Sequence
  RNA Oligomer
auucuugcaggaaaauuga

SEQ ID NO: 10211 - RNA, 19 nt, Artificial Sequence
  RNA Oligomer
cuuuuauggugggauccug

SEQ ID NO: 10212 - RNA, 19 nt, Artificial Sequence
  RNA Oligomer
aucaggaccaggauacuga

SEQ ID NO: 10213 - RNA, 19 nt, Artificial Sequence
  RNA Oligomer
aacaaggucauucauuugg

SEQ ID NO: 10214 - RNA, 19 nt, Artificial Sequence
  RNA Oligomer
caggaaaauugaauauucc

SEQ ID NO: 10215 - RNA, 19 nt, Artificial Sequence
  RNA Oligomer
cucaggaugaauuucagug

SEQ ID NO: 10216 - RNA, 19 nt, Artificial Sequence
  RNA Oligomer
auuucaguguacuugacgc

SEQ ID NO: 10217 - RNA, 19 nt, Artificial Sequence
  RNA Oligomer
aaacaggguuguugcugca

SEQ ID NO: 10218 - RNA, 19 nt, Artificial Sequence
  RNA Oligomer
caaagaagaaucuuguugc

SEQ ID NO: 10219 - RNA, 19 nt, Artificial Sequence
  RNA Oligomer
auuaguggcugauagucuu

SEQ ID NO: 10220 - RNA, 19 nt, Artificial Sequence
  RNA Oligomer
guggcugauagucuucuuc

SEQ ID NO: 10221 - RNA, 19 nt, Artificial Sequence
  RNA Oligomer
gacuaucuguaggaagggu

SEQ ID NO: 10222 - RNA, 19 nt, Artificial Sequence
  RNA Oligomer
uuuggcagucuacaugucu

SEQ ID NO: 10223 - RNA, 19 nt, Artificial Sequence
  RNA Oligomer
auccucaggauuuuucaca

SEQ ID NO: 10224 - RNA, 19 nt, Artificial Sequence
  RNA Oligomer
cacugaagaaacuugucag

SEQ ID NO: 10225 - RNA, 19 nt, Artificial Sequence
  RNA Oligomer
aauuauggacuuccacacu

SEQ ID NO: 10226 - RNA, 19 nt, Artificial Sequence
  RNA Oligomer
uauggacuuccacacuccc

SEQ ID NO: 10227 - RNA, 19 nt, Artificial Sequence
  RNA Oligomer
accugugugaacugauggg

SEQ ID NO: 10228 - RNA, 19 nt, Artificial Sequence
  RNA Oligomer
gccagaucuuuuauucugc

SEQ ID NO: 10229 - RNA, 19 nt, Artificial Sequence
  RNA Oligomer
aagacagaguugggcucuc

SEQ ID NO: 10230 - RNA, 19 nt, Artificial Sequence
  RNA Oligomer
uguggugauuuuucaauag

SEQ ID NO: 10231 - RNA, 19 nt, Artificial Sequence
  RNA Oligomer
aaaaaggcuuccgucucug

SEQ ID NO: 10232 - RNA, 19 nt, Artificial Sequence
  RNA Oligomer
aaaaggcuuccgucucugg

SEQ ID NO: 10233 - RNA, 19 nt, Artificial Sequence
  RNA Oligomer
uggcagucuacaugucuca

SEQ ID NO: 10234 - RNA, 19 nt, Artificial Sequence
  RNA Oligomer
aaaccacaaggagucaagg

SEQ ID NO: 10235 - RNA, 19 nt, Artificial Sequence
  RNA Oligomer
gucuguagauauucuugca

SEQ ID NO: 10236 - RNA, 19 nt, Artificial Sequence
  RNA Oligomer
gauuccagcucuuuuaugg

SEQ ID NO: 10237 - RNA, 19 nt, Artificial Sequence
  RNA Oligomer
uccagcucuuuuauggugg

SEQ ID NO: 10238 - RNA, 19 nt, Artificial Sequence
  RNA Oligomer
uccuggcauaagucucugg

SEQ ID NO: 10239 - RNA, 19 nt, Artificial Sequence
  RNA Oligomer
uuucaguguacuugacgca

SEQ ID NO: 10240 - RNA, 19 nt, Artificial Sequence
  RNA Oligomer
ugaccaugaaguuuauggu

SEQ ID NO: 10241 - RNA, 19 nt, Artificial Sequence
  RNA Oligomer
augguuugacuaucuguag

SEQ ID NO: 10242 - RNA, 19 nt, Artificial Sequence
  RNA Oligomer
aucuguaggaaggguacaa

SEQ ID NO: 10243 - RNA, 19 nt, Artificial Sequence
  RNA Oligomer
agcaucccauacacuuugg

SEQ ID NO: 10244 - RNA, 19 nt, Artificial Sequence
  RNA Oligomer
cuuuggcagucuacauguc

SEQ ID NO: 10245 - RNA, 19 nt, Artificial Sequence
  RNA Oligomer
aaccacaaggagucaagga

SEQ ID NO: 10246 - RNA, 19 nt, Artificial Sequence
  RNA Oligomer
aaacaaccacagcgacugg

SEQ ID NO: 10247 - RNA, 19 nt, Artificial Sequence
  RNA Oligomer
uccucaggauuuuucacac

SEQ ID NO: 10248 - RNA, 19 nt, Artificial Sequence
  RNA Oligomer
cuguagauauucuugcagg

SEQ ID NO: 10249 - RNA, 19 nt, Artificial Sequence
  RNA Oligomer
caucucaggaugaauuuca

SEQ ID NO: 10250 - RNA, 19 nt, Artificial Sequence
  RNA Oligomer
agauuuuacugcgggaucc

SEQ ID NO: 10251 - RNA, 19 nt, Artificial Sequence
  RNA Oligomer
caguguacuugacgcaucg

SEQ ID NO: 10252 - RNA, 19 nt, Artificial Sequence
  RNA Oligomer
gaaacaggguuguugcugc

SEQ ID NO: 10253 - RNA, 19 nt, Artificial Sequence
  RNA Oligomer
cuucauuaguggcugauag

SEQ ID NO: 10254 - RNA, 19 nt, Artificial Sequence
  RNA Oligomer
ugguuugacuaucuguagg

SEQ ID NO: 10255 - RNA, 19 nt, Artificial Sequence
  RNA Oligomer
gaaauguaaugcuuucuga

SEQ ID NO: 10256 - RNA, 19 nt, Artificial Sequence
  RNA Oligomer
gaaaaaggcuuccgucucu

SEQ ID NO: 10257 - RNA, 19 nt, Artificial Sequence
  RNA Oligomer
cuggcauugaccuuauugu

SEQ ID NO: 10258 - RNA, 19 nt, Artificial Sequence
  RNA Oligomer
cagguaugcugagucaugu

SEQ ID NO: 10259 - RNA, 19 nt, Artificial Sequence
  RNA Oligomer
agcuaaaacaaccacagcg

SEQ ID NO: 10260 - RNA, 19 nt, Artificial Sequence
  RNA Oligomer
aauccucaggauuuuucac

SEQ ID NO: 10261 - RNA, 19 nt, Artificial Sequence
  RNA Oligomer
ugcaaauuauggacuucca

SEQ ID NO: 10262 - RNA, 19 nt, Artificial Sequence
  RNA Oligomer
aacaggguuguugcugcag

SEQ ID NO: 10263 - RNA, 19 nt, Artificial Sequence
  RNA Oligomer
uggaaguguugaauucacc

SEQ ID NO: 10264 - RNA, 19 nt, Artificial Sequence
  RNA Oligomer
cuccaaagaagaaucuugu

SEQ ID NO: 10265 - RNA, 19 nt, Artificial Sequence
  RNA Oligomer
aagguacggucugaguucc

SEQ ID NO: 10266 - RNA, 19 nt, Artificial Sequence
  RNA Oligomer
aaaugcacccuugaaagca

SEQ ID NO: 10267 - RNA, 19 nt, Artificial Sequence
  RNA Oligomer
caugaaguuuaugguuuga

SEQ ID NO: 10268 - RNA, 19 nt, Artificial Sequence
  RNA Oligomer
uaugguuugacuaucugua

SEQ ID NO: 10269 - RNA, 19 nt, Artificial Sequence
  RNA Oligomer
uuccgucucuggcauugac

SEQ ID NO: 10270 - RNA, 19 nt, Artificial Sequence
  RNA Oligomer
cagcagguaugcugaguca

SEQ ID NO: 10271 - RNA, 19 nt, Artificial Sequence
  RNA Oligomer
cucuuuuauggugggaucc

SEQ ID NO: 10272 - RNA, 19 nt, Artificial Sequence
  RNA Oligomer
ugaaccuucucugguugca

SEQ ID NO: 10273 - RNA, 19 nt, Artificial Sequence
  RNA Oligomer
cacacucccaaaagugcug

SEQ ID NO: 10274 - RNA, 19 nt, Artificial Sequence
  RNA Oligomer
aggaucaggaccaggauac

SEQ ID NO: 10275 - RNA, 19 nt, Artificial Sequence
  RNA Oligomer
ugugaggucaucagcaagg

SEQ ID NO: 10276 - RNA, 19 nt, Artificial Sequence
  RNA Oligomer
gucaucagcaagguagccu

SEQ ID NO: 10277 - RNA, 19 nt, Artificial Sequence
  RNA Oligomer
ugacuaucuguaggaaggg

SEQ ID NO: 10278 - RNA, 19 nt, Artificial Sequence
  RNA Oligomer
aauagaaaggauguuacca

SEQ ID NO: 10279 - RNA, 19 nt, Artificial Sequence
  RNA Oligomer
gaauccucaggauuuuuca

SEQ ID NO: 10280 - RNA, 19 nt, Artificial Sequence
  RNA Oligomer
auuccagcucuuuuauggu

SEQ ID NO: 10281 - RNA, 19 nt, Artificial Sequence
  RNA Oligomer
cagcucuuuuaugguggga

SEQ ID NO: 10282 - RNA, 19 nt, Artificial Sequence
  RNA Oligomer
uuauggugggauccuggca

SEQ ID NO: 10283 - RNA, 19 nt, Artificial Sequence
  RNA Oligomer
cugaaccuucucugguugc

SEQ ID NO: 10284 - RNA, 19 nt, Artificial Sequence
  RNA Oligomer
aguguugaauucaccacac

SEQ ID NO: 10285 - RNA, 19 nt, Artificial Sequence
  RNA Oligomer
guguugaauucaccacacc

SEQ ID NO: 10286 - RNA, 19 nt, Artificial Sequence
  RNA Oligomer
gaccugugugaacugaugg

SEQ ID NO: 10287 - RNA, 19 nt, Artificial Sequence
  RNA Oligomer
uuauucugcuccaaagaag

SEQ ID NO: 10288 - RNA, 19 nt, Artificial Sequence
  RNA Oligomer
uggaaauguaaugcuuucu

SEQ ID NO: 10289 - RNA, 19 nt, Artificial Sequence
  RNA Oligomer
gcucagaucucagaugugc

SEQ ID NO: 10290 - RNA, 19 nt, Artificial Sequence
  RNA Oligomer
uguagauauucuugcagga

SEQ ID NO: 10291 - RNA, 19 nt, Artificial Sequence
  RNA Oligomer
aggaugaauuucaguguac

SEQ ID NO: 10292 - RNA, 19 nt, Artificial Sequence
  RNA Oligomer
uccauugagcaucacaugg

SEQ ID NO: 10293 - RNA, 19 nt, Artificial Sequence
  RNA Oligomer
cauugagcaucacauggac

SEQ ID NO: 10294 - RNA, 19 nt, Artificial Sequence
  RNA Oligomer
ccagaauacugaaacaggg

SEQ ID NO: 10295 - RNA, 19 nt, Artificial Sequence
  RNA Oligomer
acugaaacaggguuguugc

SEQ ID NO: 10296 - RNA, 19 nt, Artificial Sequence
  RNA Oligomer
gucugggcaagauugauag

SEQ ID NO: 10297 - RNA, 19 nt, Artificial Sequence
  RNA Oligomer
auucaccacaccaugugag

SEQ ID NO: 10298 - RNA, 19 nt, Artificial Sequence
  RNA Oligomer
gugaggucaucagcaaggu

SEQ ID NO: 10299 - RNA, 19 nt, Artificial Sequence
  RNA Oligomer
ccaaagaagaaucuuguug

SEQ ID NO: 10300 - RNA, 19 nt, Artificial Sequence
  RNA Oligomer
aaagaagaaucuuguugca

SEQ ID NO: 10301 - RNA, 19 nt, Artificial Sequence
  RNA Oligomer
gaaucuuguugcaagguac

SEQ ID NO: 10302 - RNA, 19 nt, Artificial Sequence
  RNA Oligomer
cauuaguggcugauagucu

SEQ ID NO: 10303 - RNA, 19 nt, Artificial Sequence
  RNA Oligomer
uucaguaauguugcaagga

SEQ ID NO: 10304 - RNA, 19 nt, Artificial Sequence
  RNA Oligomer
aaugcacccuugaaagcau

SEQ ID NO: 10305 - RNA, 19 nt, Artificial Sequence
  RNA Oligomer
ggcauugaccuuauugugg

SEQ ID NO: 10306 - RNA, 19 nt, Artificial Sequence
  RNA Oligomer
acacucccaaaagugcugu

SEQ ID NO: 10307 - RNA, 19 nt, Artificial Sequence
  RNA Oligomer
caaaagugcuguuuuuguc

SEQ ID NO: 10308 - RNA, 19 nt, Artificial Sequence
  RNA Oligomer
ccguuuuccagaauacuga

SEQ ID NO: 10309 - RNA, 19 nt, Artificial Sequence
  RNA Oligomer
uuccagaauacugaaacag

SEQ ID NO: 10310 - RNA, 19 nt, Artificial Sequence
  RNA Oligomer
gaauucaccacaccaugug

SEQ ID NO: 10311 - RNA, 19 nt, Artificial Sequence
  RNA Oligomer
aucuuguugcaagguacgg

SEQ ID NO: 10312 - RNA, 19 nt, Artificial Sequence
  RNA Oligomer
ucccaacuucauuaguggc

SEQ ID NO: 10313 - RNA, 19 nt, Artificial Sequence
  RNA Oligomer
cuucuucaguaauguugca

SEQ ID NO: 10314 - RNA, 19 nt, Artificial Sequence
  RNA Oligomer
augcacccuugaaagcauc

SEQ ID NO: 10315 - RNA, 19 nt, Artificial Sequence
  RNA Oligomer
ugcacccuugaaagcaucc

SEQ ID NO: 10316 - RNA, 19 nt, Artificial Sequence
  RNA Oligomer
gcaucccauacacuuuggc

SEQ ID NO: 10317 - RNA, 19 nt, Artificial Sequence
  RNA Oligomer
acaaggucauucauuugga

SEQ ID NO: 10318 - RNA, 19 nt, Artificial Sequence
  RNA Oligomer
ggaaauguaaugcuuucug

SEQ ID NO: 10319 - RNA, 19 nt, Artificial Sequence
  RNA Oligomer
cuugacuauugauagauca

SEQ ID NO: 10320 - RNA, 19 nt, Artificial Sequence
  RNA Oligomer
uggcuggguucugaaacug

SEQ ID NO: 10321 - RNA, 19 nt, Artificial Sequence
  RNA Oligomer
auggacuuccacacuccca

SEQ ID NO: 10322 - RNA, 19 nt, Artificial Sequence
  RNA Oligomer
uuccacacucccaaaagug

SEQ ID NO: 10323 - RNA, 19 nt, Artificial Sequence
  RNA Oligomer
uccacacucccaaaagugc

SEQ ID NO: 10324 - RNA, 19 nt, Artificial Sequence
  RNA Oligomer
uuuuccagaauacugaaac

SEQ ID NO: 10325 - RNA, 19 nt, Artificial Sequence
  RNA Oligomer
aauucaccacaccauguga

SEQ ID NO: 10326 - RNA, 19 nt, Artificial Sequence
  RNA Oligomer
uucaccacaccaugugagg

SEQ ID NO: 10327 - RNA, 19 nt, Artificial Sequence
  RNA Oligomer
aucagcaagguagccuagc

SEQ ID NO: 10328 - RNA, 19 nt, Artificial Sequence
  RNA Oligomer
agaucuuuuauucugcucc

SEQ ID NO: 10329 - RNA, 19 nt, Artificial Sequence
  RNA Oligomer
uuacccaugaccaugaagu

SEQ ID NO: 10330 - RNA, 19 nt, Artificial Sequence
  RNA Oligomer
uugacuauugauagaucac

SEQ ID NO: 10331 - RNA, 19 nt, Artificial Sequence
  RNA Oligomer
uggguucugaaacugcacc

SEQ ID NO: 10332 - RNA, 19 nt, Artificial Sequence
  RNA Oligomer
cuucaguaauguugcaagg

SEQ ID NO: 10333 - RNA, 19 nt, Artificial Sequence
  RNA Oligomer
ucugaaccuucucugguug

SEQ ID NO: 10334 - RNA, 19 nt, Artificial Sequence
  RNA Oligomer
uuuccagaauacugaaaca

SEQ ID NO: 10335 - RNA, 19 nt, Artificial Sequence
  RNA Oligomer
accacaccaugugagguca

SEQ ID NO: 10336 - RNA, 19 nt, Artificial Sequence
  RNA Oligomer
caccaugugaggucaucag

SEQ ID NO: 10337 - RNA, 19 nt, Artificial Sequence
  RNA Oligomer
ucuuguugcaagguacggu

SEQ ID NO: 10338 - RNA, 19 nt, Artificial Sequence
  RNA Oligomer
ugacuauugauagaucaca

SEQ ID NO: 10339 - RNA, 19 nt, Artificial Sequence
  RNA Oligomer
gaagaaucuuguugcaagg

SEQ ID NO: 10340 - RNA, 19 nt, Artificial Sequence
  RNA Oligomer
aaucuuguugcaagguacg

SEQ ID NO: 10341 - RNA, 19 nt, Artificial Sequence
  RNA Oligomer
cuuguugcaagguacgguc

SEQ ID NO: 10342 - RNA, 19 nt, Artificial Sequence
  RNA Oligomer
auuuuucacacacugaaga

SEQ ID NO: 10343 - RNA, 19 nt, Artificial Sequence
  RNA Oligomer
aagaaucuuguugcaaggu

SEQ ID NO: 10344 - RNA, 19 nt, Artificial Sequence
  RNA Oligomer
ugaauccucaggauuuuuc

SEQ ID NO: 10345 - RNA, 19 nt, Artificial Sequence
  RNA Oligomer
uucacacacugaagaaacu

SEQ ID NO: 10346 - RNA, 19 nt, Artificial Sequence
  RNA Oligomer
aucacaggcagcuucugca

SEQ ID NO: 10347 - RNA, 19 nt, Artificial Sequence
  RNA Oligomer
cagaucuuuuauucugcuc

SEQ ID NO: 10348 - RNA, 19 nt, Artificial Sequence
  RNA Oligomer
cucuggaaucuucucuucc

SEQ ID NO: 10349 - RNA, 19 nt, Artificial Sequence
  RNA Oligomer
ucuggaaucuucucuucca

SEQ ID NO: 10350 - RNA, 19 nt, Artificial Sequence
  RNA Oligomer
gugucugaaccuucucugg

SEQ ID NO: 10351 - RNA, 19 nt, Artificial Sequence
  RNA Oligomer
cuggaaucuucucuuccac

SEQ ID NO: 10352 - RNA, 19 nt, Artificial Sequence
  RNA Oligomer
auggaccacaucacaggca

SEQ ID NO: 10353 - RNA, 19 nt, Artificial Sequence
  RNA Oligomer
gcauagaugaucgaaaauu

SEQ ID NO: 10354 - RNA, 19 nt, Artificial Sequence
  RNA Oligomer
gcaaaauccaauagaagua

SEQ ID NO: 10355 - RNA, 19 nt, Artificial Sequence
  RNA Oligomer
ccauuucuaaagugaccuu

SEQ ID NO: 10356 - RNA, 19 nt, Artificial Sequence
  RNA Oligomer
ccauuguagauugucuuuu

SEQ ID NO: 10357 - RNA, 19 nt, Artificial Sequence
  RNA Oligomer
ccuuauuaaacauguagac

SEQ ID NO: 10358 - RNA, 19 nt, Artificial Sequence
  RNA Oligomer
ccacugauaaaggcuuuau

SEQ ID NO: 10359 - RNA, 19 nt, Artificial Sequence
  RNA Oligomer
cccaggcaauacucaagaa

SEQ ID NO: 10360 - RNA, 19 nt, Artificial Sequence
  RNA Oligomer
gcguuuauuuauaacuggu

SEQ ID NO: 10361 - RNA, 19 nt, Artificial Sequence
  RNA Oligomer
gccaagccauuucuaaagu

SEQ ID NO: 10362 - RNA, 19 nt, Artificial Sequence
  RNA Oligomer
caacaauccaggauauuuu

SEQ ID NO: 10363 - RNA, 19 nt, Artificial Sequence
  RNA Oligomer
acaucaacaauccaggaua

SEQ ID NO: 10364 - RNA, 19 nt, Artificial Sequence
  RNA Oligomer
gcaucauaaucauagcaau

SEQ ID NO: 10365 - RNA, 19 nt, Artificial Sequence
  RNA Oligomer
gcacugaguuuggcauuuu

SEQ ID NO: 10366 - RNA, 19 nt, Artificial Sequence
  RNA Oligomer
ccuuccuucauguccucua

SEQ ID NO: 10367 - RNA, 19 nt, Artificial Sequence
  RNA Oligomer
cccuuauguuuaugaaaag

SEQ ID NO: 10368 - RNA, 19 nt, Artificial Sequence
  RNA Oligomer
caaaccucuuuccuuauua

SEQ ID NO: 10369 - RNA, 19 nt, Artificial Sequence
  RNA Oligomer
ggcaucauaaucauagcaa

SEQ ID NO: 10370 - RNA, 19 nt, Artificial Sequence
  RNA Oligomer
ccaggcaauacucaagaag

SEQ ID NO: 10371 - RNA, 19 nt, Artificial Sequence
  RNA Oligomer
cuacccuuauguuuaugaa

SEQ ID NO: 10372 - RNA, 19 nt, Artificial Sequence
  RNA Oligomer
ccagaaucuaaugcagagu

SEQ ID NO: 10373 - RNA, 19 nt, Artificial Sequence
  RNA Oligomer
caaccucaaaaucaaucaa

SEQ ID NO: 10374 - RNA, 19 nt, Artificial Sequence
  RNA Oligomer
ggaugauggcuuuuauaaa

SEQ ID NO: 10375 - RNA, 19 nt, Artificial Sequence
  RNA Oligomer
gaacuguauuccuuuuaac

SEQ ID NO: 10376 - RNA, 19 nt, Artificial Sequence
  RNA Oligomer
ccaguuuacuuaagguaga

SEQ ID NO: 10377 - RNA, 19 nt, Artificial Sequence
  RNA Oligomer
ccauauuaacacagcugac

SEQ ID NO: 10378 - RNA, 19 nt, Artificial Sequence
  RNA Oligomer
ugguagacaucagcaacaa

SEQ ID NO: 10379 - RNA, 19 nt, Artificial Sequence
  RNA Oligomer
ccaugcucuuuuuguuaaa

SEQ ID NO: 10380 - RNA, 19 nt, Artificial Sequence
  RNA Oligomer
ggauacugcucuuuuacuu

SEQ ID NO: 10381 - RNA, 19 nt, Artificial Sequence
  RNA Oligomer
gcaccauuguagauugucu

SEQ ID NO: 10382 - RNA, 19 nt, Artificial Sequence
  RNA Oligomer
ucaaaccucuuuccuuauu

SEQ ID NO: 10383 - RNA, 19 nt, Artificial Sequence
  RNA Oligomer
ccagaauuuuagacagcaa

SEQ ID NO: 10384 - RNA, 19 nt, Artificial Sequence
  RNA Oligomer
ggcuuuauuagguauaucu

SEQ ID NO: 10385 - RNA, 19 nt, Artificial Sequence
  RNA Oligomer
cacugauaaaggcuuuauu

SEQ ID NO: 10386 - RNA, 19 nt, Artificial Sequence
  RNA Oligomer
acauuucguauggcuauuu

SEQ ID NO: 10387 - RNA, 19 nt, Artificial Sequence
  RNA Oligomer
caacaaccucaaaaucaau

SEQ ID NO: 10388 - RNA, 19 nt, Artificial Sequence
  RNA Oligomer
ucaccuauguuaugcaaaa

SEQ ID NO: 10389 - RNA, 19 nt, Artificial Sequence
  RNA Oligomer
ucacuacucaccuauguua

SEQ ID NO: 10390 - RNA, 19 nt, Artificial Sequence
  RNA Oligomer
caucaacaauccaggauau

SEQ ID NO: 10391 - RNA, 19 nt, Artificial Sequence
  RNA Oligomer
ggaugguucucacuguuuu

SEQ ID NO: 10392 - RNA, 19 nt, Artificial Sequence
  RNA Oligomer
gcacuauauuagguuaagu

SEQ ID NO: 10393 - RNA, 19 nt, Artificial Sequence
  RNA Oligomer
ccaugaugaauucuaguga

SEQ ID NO: 10394 - RNA, 19 nt, Artificial Sequence
  RNA Oligomer
gaaugagguuuuuguuguu

SEQ ID NO: 10395 - RNA, 19 nt, Artificial Sequence
  RNA Oligomer
ggaaugagguuuuuguugu

SEQ ID NO: 10396 - RNA, 19 nt, Artificial Sequence
  RNA Oligomer
ggaacucaaaacacuagaa

SEQ ID NO: 10397 - RNA, 19 nt, Artificial Sequence
  RNA Oligomer
ggcuuaucauuccuugcac

SEQ ID NO: 10398 - RNA, 19 nt, Artificial Sequence
  RNA Oligomer
gggcuuaucauuccuugca

SEQ ID NO: 10399 - RNA, 19 nt, Artificial Sequence
  RNA Oligomer
ccaaaucguaucuuuccaa

SEQ ID NO: 10400 - RNA, 19 nt, Artificial Sequence
  RNA Oligomer
cugugugucuucuuguuuu

SEQ ID NO: 10401 - RNA, 19 nt, Artificial Sequence
  RNA Oligomer
agaaucuaaugcagaguac

SEQ ID NO: 10402 - RNA, 19 nt, Artificial Sequence
  RNA Oligomer
gggaugauggcuuuuauaa

SEQ ID NO: 10403 - RNA, 19 nt, Artificial Sequence
  RNA Oligomer
ugaugguuuuggcauaaua

SEQ ID NO: 10404 - RNA, 19 nt, Artificial Sequence
  RNA Oligomer
gccuaguaaaaaugcucua

SEQ ID NO: 10405 - RNA, 19 nt, Artificial Sequence
  RNA Oligomer
agagaagucuuuggaguua

SEQ ID NO: 10406 - RNA, 19 nt, Artificial Sequence
  RNA Oligomer
caccauuguagauugucuu

SEQ ID NO: 10407 - RNA, 19 nt, Artificial Sequence
  RNA Oligomer
gccauuucuaaagugaccu

SEQ ID NO: 10408 - RNA, 19 nt, Artificial Sequence
  RNA Oligomer
caagccauuucuaaaguga

SEQ ID NO: 10409 - RNA, 19 nt, Artificial Sequence
  RNA Oligomer
gcauuuuucaaaccucuuu

SEQ ID NO: 10410 - RNA, 19 nt, Artificial Sequence
  RNA Oligomer
cacugaguuuggcauuuuu

SEQ ID NO: 10411 - RNA, 19 nt, Artificial Sequence
  RNA Oligomer
caaaauaacuaaaaggcac

SEQ ID NO: 10412 - RNA, 19 nt, Artificial Sequence
  RNA Oligomer
agcuucuauaucugucuua

SEQ ID NO: 10413 - RNA, 19 nt, Artificial Sequence
  RNA Oligomer
aggguugauaaaaguucuu

SEQ ID NO: 10414 - RNA, 19 nt, Artificial Sequence
  RNA Oligomer
ugaauaaaaauggagggau

SEQ ID NO: 10415 - RNA, 19 nt, Artificial Sequence
  RNA Oligomer
ccuaaugucuugcaaaauc

SEQ ID NO: 10416 - RNA, 19 nt, Artificial Sequence
  RNA Oligomer
ggugaucaaguuuguccua

SEQ ID NO: 10417 - RNA, 19 nt, Artificial Sequence
  RNA Oligomer
ggcucagugauucauaugu

SEQ ID NO: 10418 - RNA, 19 nt, Artificial Sequence
  RNA Oligomer
aggcaauacucaagaagga

SEQ ID NO: 10419 - RNA, 19 nt, Artificial Sequence
  RNA Oligomer
gugauuccuauucgauauu

SEQ ID NO: 10420 - RNA, 19 nt, Artificial Sequence
  RNA Oligomer
ugcagcuauuuccaaugug

SEQ ID NO: 10421 - RNA, 19 nt, Artificial Sequence
  RNA Oligomer
ccucuuacuaugaauucuu

SEQ ID NO: 10422 - RNA, 19 nt, Artificial Sequence
  RNA Oligomer
acaaccucaaaaucaauca

SEQ ID NO: 10423 - RNA, 19 nt, Artificial Sequence
  RNA Oligomer
gaaugaguuuacaacagau

SEQ ID NO: 10424 - RNA, 19 nt, Artificial Sequence
  RNA Oligomer
caguuuacuuaagguagaa

SEQ ID NO: 10425 - RNA, 19 nt, Artificial Sequence
  RNA Oligomer
ggaaaaauauugguagaca

SEQ ID NO: 10426 - RNA, 19 nt, Artificial Sequence
  RNA Oligomer
gcugaccuauagaaaaaaa

SEQ ID NO: 10427 - RNA, 19 nt, Artificial Sequence
  RNA Oligomer
cgaaaauagaaaaugccau

SEQ ID NO: 10428 - RNA, 19 nt, Artificial Sequence
  RNA Oligomer
gagaagucuuuggaguuaa

SEQ ID NO: 10429 - RNA, 19 nt, Artificial Sequence
  RNA Oligomer
acaaaaaguuggacgacau

SEQ ID NO: 10430 - RNA, 19 nt, Artificial Sequence
  RNA Oligomer
ugccaagccauuucuaaag

SEQ ID NO: 10431 - RNA, 19 nt, Artificial Sequence
  RNA Oligomer
ucaacaauccaggauauuu

SEQ ID NO: 10432 - RNA, 19 nt, Artificial Sequence
  RNA Oligomer
aacaucaacaauccaggau

SEQ ID NO: 10433 - RNA, 19 nt, Artificial Sequence
  RNA Oligomer
cccacauaucaaaauaacu

SEQ ID NO: 10434 - RNA, 19 nt, Artificial Sequence
  RNA Oligomer
ucccacauaucaaaauaac

SEQ ID NO: 10435 - RNA, 19 nt, Artificial Sequence
  RNA Oligomer
gcugaaauuuaggaugguu

SEQ ID NO: 10436 - RNA, 19 nt, Artificial Sequence
  RNA Oligomer
gugugaagauucaucauua

SEQ ID NO: 10437 - RNA, 19 nt, Artificial Sequence
  RNA Oligomer
ugcauagaugaucgaaaau

SEQ ID NO: 10438 - RNA, 19 nt, Artificial Sequence
  RNA Oligomer
augcauagaugaucgaaaa

SEQ ID NO: 10439 - RNA, 19 nt, Artificial Sequence
  RNA Oligomer
guguaaauaaguagcuucu

SEQ ID NO: 10440 - RNA, 19 nt, Artificial Sequence
  RNA Oligomer
ggguugauaaaaguucuug

SEQ ID NO: 10441 - RNA, 19 nt, Artificial Sequence
  RNA Oligomer
gguauaggaaagacugaau

SEQ ID NO: 10442 - RNA, 19 nt, Artificial Sequence
  RNA Oligomer
cuugcaaaauccaauagaa

SEQ ID NO: 10443 - RNA, 19 nt, Artificial Sequence
  RNA Oligomer
ugcuugucuuugagaaauu

SEQ ID NO: 10444 - RNA, 19 nt, Artificial Sequence
  RNA Oligomer
ggauuucugaacuaugguu

SEQ ID NO: 10445 - RNA, 19 nt, Artificial Sequence
  RNA Oligomer
gaacucaaaacacuagaaa

SEQ ID NO: 10446 - RNA, 19 nt, Artificial Sequence
  RNA Oligomer
agauuccucagcccuucaa

SEQ ID NO: 10447 - RNA, 19 nt, Artificial Sequence
  RNA Oligomer
cuggcucagugauucauau

SEQ ID NO: 10448 - RNA, 19 nt, Artificial Sequence
  RNA Oligomer
ccauuccaaaucguaucuu

SEQ ID NO: 10449 - RNA, 19 nt, Artificial Sequence
  RNA Oligomer
ggcuauuuccauuccaaau

SEQ ID NO: 10450 - RNA, 19 nt, Artificial Sequence
  RNA Oligomer
gugucuucuuguuuuucua

SEQ ID NO: 10451 - RNA, 19 nt, Artificial Sequence
  RNA Oligomer
ccugcagcuauuuccaaug

SEQ ID NO: 10452 - RNA, 19 nt, Artificial Sequence
  RNA Oligomer
uggauauuguucguaaucu

SEQ ID NO: 10453 - RNA, 19 nt, Artificial Sequence
  RNA Oligomer
agaaugaguuuacaacaga

SEQ ID NO: 10454 - RNA, 19 nt, Artificial Sequence
  RNA Oligomer
gguagaaagaaugaguuua

SEQ ID NO: 10455 - RNA, 19 nt, Artificial Sequence
  RNA Oligomer
cugaugguuuuggcauaau

SEQ ID NO: 10456 - RNA, 19 nt, Artificial Sequence
  RNA Oligomer
ugcguuuauuuauaacugg

SEQ ID NO: 10457 - RNA, 19 nt, Artificial Sequence
  RNA Oligomer
caauccaggauauuuuucu

SEQ ID NO: 10458 - RNA, 19 nt, Artificial Sequence
  RNA Oligomer
ggugugaagauucaucauu

SEQ ID NO: 10459 - RNA, 19 nt, Artificial Sequence
  RNA Oligomer
ugaucgaaaauuacggaaa

SEQ ID NO: 10460 - RNA, 19 nt, Artificial Sequence
  RNA Oligomer
gcagguauaaauuugaaca

SEQ ID NO: 10461 - RNA, 19 nt, Artificial Sequence
  RNA Oligomer
ugaauagucugcagguaua

SEQ ID NO: 10462 - RNA, 19 nt, Artificial Sequence
  RNA Oligomer
cuauaucugucuuagucua

SEQ ID NO: 10463 - RNA, 19 nt, Artificial Sequence
  RNA Oligomer
cccuuggauuucacuugca

SEQ ID NO: 10464 - RNA, 19 nt, Artificial Sequence
  RNA Oligomer
agagcuggcauguaauucu

SEQ ID NO: 10465 - RNA, 19 nt, Artificial Sequence
  RNA Oligomer
aggcuuuauuagguauauc

SEQ ID NO: 10466 - RNA, 19 nt, Artificial Sequence
  RNA Oligomer
agcuggauuucugaacuau

SEQ ID NO: 10467 - RNA, 19 nt, Artificial Sequence
  RNA Oligomer
gaaaaagcauugaauggaa

SEQ ID NO: 10468 - RNA, 19 nt, Artificial Sequence
  RNA Oligomer
gggaaaggaacucaaaaca

SEQ ID NO: 10469 - RNA, 19 nt, Artificial Sequence
  RNA Oligomer
gcccuucaaaucucagaug

SEQ ID NO: 10470 - RNA, 19 nt, Artificial Sequence
  RNA Oligomer
ggaacuggugauuuuggaa

SEQ ID NO: 10471 - RNA, 19 nt, Artificial Sequence
  RNA Oligomer
ugccuuccuucauguccuc

SEQ ID NO: 10472 - RNA, 19 nt, Artificial Sequence
  RNA Oligomer
guauguauuuuuggaacug

SEQ ID NO: 10473 - RNA, 19 nt, Artificial Sequence
  RNA Oligomer
gcacuuacacugcuugcuu

SEQ ID NO: 10474 - RNA, 19 nt, Artificial Sequence
  RNA Oligomer
agaaaagcaagagacugua

SEQ ID NO: 10475 - RNA, 19 nt, Artificial Sequence
  RNA Oligomer
ccaauaacagcacuuacac

SEQ ID NO: 10476 - RNA, 19 nt, Artificial Sequence
  RNA Oligomer
uccaauaacagcacuuaca

SEQ ID NO: 10477 - RNA, 19 nt, Artificial Sequence
  RNA Oligomer
ucguaucuuuccaauaaca

SEQ ID NO: 10478 - RNA, 19 nt, Artificial Sequence
  RNA Oligomer
gcuauuuccauuccaaauc

SEQ ID NO: 10479 - RNA, 19 nt, Artificial Sequence
  RNA Oligomer
ugugugucuucuuguuuuu

SEQ ID NO: 10480 - RNA, 19 nt, Artificial Sequence
  RNA Oligomer
ugcugugugucuucuuguu

SEQ ID NO: 10481 - RNA, 19 nt, Artificial Sequence
  RNA Oligomer
cccuucuauuugucugcug

SEQ ID NO: 10482 - RNA, 19 nt, Artificial Sequence
  RNA Oligomer
gauggauauuguucguaau

SEQ ID NO: 10483 - RNA, 19 nt, Artificial Sequence
  RNA Oligomer
uccagaaucuaaugcagag

SEQ ID NO: 10484 - RNA, 19 nt, Artificial Sequence
  RNA Oligomer
ucaaucaauauccagaauc

SEQ ID NO: 10485 - RNA, 19 nt, Artificial Sequence
  RNA Oligomer
ccuuuuaacagauccaaac

SEQ ID NO: 10486 - RNA, 19 nt, Artificial Sequence
  RNA Oligomer
gaaagaaugaguuuacaac

SEQ ID NO: 10487 - RNA, 19 nt, Artificial Sequence
  RNA Oligomer
guagaaagaaugaguuuac

SEQ ID NO: 10488 - RNA, 19 nt, Artificial Sequence
  RNA Oligomer
cuggucuagagaagucuuu

SEQ ID NO: 10489 - RNA, 19 nt, Artificial Sequence
  RNA Oligomer
gcuggauacugcucuuuua

SEQ ID NO: 10490 - RNA, 19 nt, Artificial Sequence
  RNA Oligomer
guggaaaagauaaggaaaa

SEQ ID NO: 10491 - RNA, 19 nt, Artificial Sequence
  RNA Oligomer
accauuguagauugucuuu

SEQ ID NO: 10492 - RNA, 19 nt, Artificial Sequence
  RNA Oligomer
ucagauaauaucuuugcac

SEQ ID NO: 10493 - RNA, 19 nt, Artificial Sequence
  RNA Oligomer
ggcuuuguuuuucuaaagg

SEQ ID NO: 10494 - RNA, 19 nt, Artificial Sequence
  RNA Oligomer
caaaggcuuuguuuuucua

SEQ ID NO: 10495 - RNA, 19 nt, Artificial Sequence
  RNA Oligomer
ucauaaucauagcaaucca

SEQ ID NO: 10496 - RNA, 19 nt, Artificial Sequence
  RNA Oligomer
cuucccacauaucaaaaua

SEQ ID NO: 10497 - RNA, 19 nt, Artificial Sequence
  RNA Oligomer
cugugcugauaguacccuu

SEQ ID NO: 10498 - RNA, 19 nt, Artificial Sequence
  RNA Oligomer
gaucgaaaauuacggaaaa

SEQ ID NO: 10499 - RNA, 19 nt, Artificial Sequence
  RNA Oligomer
acaaugcauagaugaucga

SEQ ID NO: 10500 - RNA, 19 nt, Artificial Sequence
  RNA Oligomer
gaacaaugcauagaugauc

SEQ ID NO: 10501 - RNA, 19 nt, Artificial Sequence
  RNA Oligomer
ugaacaaugcauagaugau

SEQ ID NO: 10502 - RNA, 19 nt, Artificial Sequence
  RNA Oligomer
cugcagguauaaauuugaa

SEQ ID NO: 10503 - RNA, 19 nt, Artificial Sequence
  RNA Oligomer
cuaguguaaauaaguagcu

SEQ ID NO: 10504 - RNA, 19 nt, Artificial Sequence
  RNA Oligomer
ugcacuauauuagguuaag

SEQ ID NO: 10505 - RNA, 19 nt, Artificial Sequence
  RNA Oligomer
gguugauaaaaguucuuga

SEQ ID NO: 10506 - RNA, 19 nt, Artificial Sequence
  RNA Oligomer
ccuuggauuucacuugcau

SEQ ID NO: 10507 - RNA, 19 nt, Artificial Sequence
  RNA Oligomer
ggcauguaauucuuccucu

SEQ ID NO: 10508 - RNA, 19 nt, Artificial Sequence
  RNA Oligomer
gaagucuugagcuauucag

SEQ ID NO: 10509 - RNA, 19 nt, Artificial Sequence
  RNA Oligomer
gggaaugagguuuuuguug

SEQ ID NO: 10510 - RNA, 19 nt, Artificial Sequence
  RNA Oligomer
ccaguggugcagaagucuu

SEQ ID NO: 10511 - RNA, 19 nt, Artificial Sequence
  RNA Oligomer
accuaaugucuugcaaaau

SEQ ID NO: 10512 - RNA, 19 nt, Artificial Sequence
  RNA Oligomer
ccgugacugagggaaacau

SEQ ID NO: 10513 - RNA, 19 nt, Artificial Sequence
  RNA Oligomer
gcuuaucauuccuugcacu

SEQ ID NO: 10514 - RNA, 19 nt, Artificial Sequence
  RNA Oligomer
cguguuagggcuuaucauu

SEQ ID NO: 10515 - RNA, 19 nt, Artificial Sequence
  RNA Oligomer
ggaagaucacugggauuga

SEQ ID NO: 10516 - RNA, 19 nt, Artificial Sequence
  RNA Oligomer
acccaggcaauacucaaga

SEQ ID NO: 10517 - RNA, 19 nt, Artificial Sequence
  RNA Oligomer
cgauggagauugggaaacu

SEQ ID NO: 10518 - RNA, 19 nt, Artificial Sequence
  RNA Oligomer
gaaaagcaagagacuguau

SEQ ID NO: 10519 - RNA, 19 nt, Artificial Sequence
  RNA Oligomer
gcugugugucuucuuguuu

SEQ ID NO: 10520 - RNA, 19 nt, Artificial Sequence
  RNA Oligomer
agcaaagagugauggauau

SEQ ID NO: 10521 - RNA, 19 nt, Artificial Sequence
  RNA Oligomer
ccacgugguaaaagcauuu

SEQ ID NO: 10522 - RNA, 19 nt, Artificial Sequence
  RNA Oligomer
agggaugauggcuuuuaua

SEQ ID NO: 10523 - RNA, 19 nt, Artificial Sequence
  RNA Oligomer
aagggaugauggcuuuuau

SEQ ID NO: 10524 - RNA, 19 nt, Artificial Sequence
  RNA Oligomer
gacuccuccaguuuacuua

SEQ ID NO: 10525 - RNA, 19 nt, Artificial Sequence
  RNA Oligomer
ccauagguaaaaugcugac

SEQ ID NO: 10526 - RNA, 19 nt, Artificial Sequence
  RNA Oligomer
agaagucuuuggaguuaac

SEQ ID NO: 10527 - RNA, 19 nt, Artificial Sequence
  RNA Oligomer
cacuacucaccuauguuau

SEQ ID NO: 10528 - RNA, 19 nt, Artificial Sequence
  RNA Oligomer
gucacuacucaccuauguu

SEQ ID NO: 10529 - RNA, 19 nt, Artificial Sequence
  RNA Oligomer
aaaugucacuacucaccua

SEQ ID NO: 10530 - RNA, 19 nt, Artificial Sequence
  RNA Oligomer
aggaaaaugucacuacuca

SEQ ID NO: 10531 - RNA, 19 nt, Artificial Sequence
  RNA Oligomer
ccuacaguaucaguggaaa

SEQ ID NO: 10532 - RNA, 19 nt, Artificial Sequence
  RNA Oligomer
ggacgacauugaguagagu

SEQ ID NO: 10533 - RNA, 19 nt, Artificial Sequence
  RNA Oligomer
caaaaaguuggacgacauu

SEQ ID NO: 10534 - RNA, 19 nt, Artificial Sequence
  RNA Oligomer
gcaaagguacacagaacac

SEQ ID NO: 10535 - RNA, 19 nt, Artificial Sequence
  RNA Oligomer
ucgcaccauuguagauugu

SEQ ID NO: 10536 - RNA, 19 nt, Artificial Sequence
  RNA Oligomer
cauuucuaaagugaccuua

SEQ ID NO: 10537 - RNA, 19 nt, Artificial Sequence
  RNA Oligomer
cuggccuuacguaauauau

SEQ ID NO: 10538 - RNA, 19 nt, Artificial Sequence
  RNA Oligomer
ucuggccuuacguaauaua

SEQ ID NO: 10539 - RNA, 19 nt, Artificial Sequence
  RNA Oligomer
aggcuuuguuuuucuaaag

SEQ ID NO: 10540 - RNA, 19 nt, Artificial Sequence
  RNA Oligomer
ucaaaggcuuuguuuuucu

SEQ ID NO: 10541 - RNA, 19 nt, Artificial Sequence
  RNA Oligomer
gguucucacuguuuuucug

SEQ ID NO: 10542 - RNA, 19 nt, Artificial Sequence
  RNA Oligomer
gaagauucaucauuaugug

SEQ ID NO: 10543 - RNA, 19 nt, Artificial Sequence
  RNA Oligomer
cgaaaauuacggaaaauca

SEQ ID NO: 10544 - RNA, 19 nt, Artificial Sequence
  RNA Oligomer
gcuucuauaucugucuuag

SEQ ID NO: 10545 - RNA, 19 nt, Artificial Sequence
  RNA Oligomer
gaaggguugauaaaaguuc

SEQ ID NO: 10546 - RNA, 19 nt, Artificial Sequence
  RNA Oligomer
cagaagucuugagcuauuc

SEQ ID NO: 10547 - RNA, 19 nt, Artificial Sequence
  RNA Oligomer
agggaaugagguuuuuguu

SEQ ID NO: 10548 - RNA, 19 nt, Artificial Sequence
  RNA Oligomer
agggcugaguuaagugaaa

SEQ ID NO: 10549 - RNA, 19 nt, Artificial Sequence
  RNA Oligomer
ugucuugcaaaauccaaua

SEQ ID NO: 10550 - RNA, 19 nt, Artificial Sequence
  RNA Oligomer
cuaaugucuugcaaaaucc

SEQ ID NO: 10551 - RNA, 19 nt, Artificial Sequence
  RNA Oligomer
ggucccugacucuuauuuu

SEQ ID NO: 10552 - RNA, 19 nt, Artificial Sequence
  RNA Oligomer
ggcugggaaaggaacucaa

SEQ ID NO: 10553 - RNA, 19 nt, Artificial Sequence
  RNA Oligomer
uggugaucaaguuuguccu

SEQ ID NO: 10554 - RNA, 19 nt, Artificial Sequence
  RNA Oligomer
acguguuagggcuuaucau

SEQ ID NO: 10555 - RNA, 19 nt, Artificial Sequence
  RNA Oligomer
cuacguguuagggcuuauc

SEQ ID NO: 10556 - RNA, 19 nt, Artificial Sequence
  RNA Oligomer
agcccuucaaaucucagau

SEQ ID NO: 10557 - RNA, 19 nt, Artificial Sequence
  RNA Oligomer
uggaacuggugauuuugga

SEQ ID NO: 10558 - RNA, 19 nt, Artificial Sequence
  RNA Oligomer
ggagauugggaaacuuaac

SEQ ID NO: 10559 - RNA, 19 nt, Artificial Sequence
  RNA Oligomer
ugugauuccuauucgauau

SEQ ID NO: 10560 - RNA, 19 nt, Artificial Sequence
  RNA Oligomer
acacuugugauuccuauuc

SEQ ID NO: 10561 - RNA, 19 nt, Artificial Sequence
  RNA Oligomer
gagacuguauguauuuuug

SEQ ID NO: 10562 - RNA, 19 nt, Artificial Sequence
  RNA Oligomer
ugguguuauugcugccauu

SEQ ID NO: 10563 - RNA, 19 nt, Artificial Sequence
  RNA Oligomer
cacuuacacugcuugcuuu

SEQ ID NO: 10564 - RNA, 19 nt, Artificial Sequence
  RNA Oligomer
cuauuuccauuccaaaucg

SEQ ID NO: 10565 - RNA, 19 nt, Artificial Sequence
  RNA Oligomer
uacauuucguauggcuauu

SEQ ID NO: 10566 - RNA, 19 nt, Artificial Sequence
  RNA Oligomer
agacguaaucuacccuuau

SEQ ID NO: 10567 - RNA, 19 nt, Artificial Sequence
  RNA Oligomer
uguucguaaucuuggacuu

SEQ ID NO: 10568 - RNA, 19 nt, Artificial Sequence
  RNA Oligomer
gugauggauauuguucgua

SEQ ID NO: 10569 - RNA, 19 nt, Artificial Sequence
  RNA Oligomer
uaagggaugauggcuuuua

SEQ ID NO: 10570 - RNA, 19 nt, Artificial Sequence
  RNA Oligomer
gcugauauguuuccuguau

SEQ ID NO: 10571 - RNA, 19 nt, Artificial Sequence
  RNA Oligomer
gcgaacuguauuccuuuua

SEQ ID NO: 10572 - RNA, 19 nt, Artificial Sequence
  RNA Oligomer
ucagcaacaaccucaaaau

SEQ ID NO: 10573 - RNA, 19 nt, Artificial Sequence
  RNA Oligomer
agguagaaagaaugaguuu

SEQ ID NO: 10574 - RNA, 19 nt, Artificial Sequence
  RNA Oligomer
gaaagcccaaguucuccuu

SEQ ID NO: 10575 - RNA, 19 nt, Artificial Sequence
  RNA Oligomer
ccaaagaaagcccaaguuc

SEQ ID NO: 10576 - RNA, 19 nt, Artificial Sequence
  RNA Oligomer
cucugaugguuuuggcaua

SEQ ID NO: 10577 - RNA, 19 nt, Artificial Sequence
  RNA Oligomer
agagcacucugaugguuuu

SEQ ID NO: 10578 - RNA, 19 nt, Artificial Sequence
  RNA Oligomer
ugcugaccuauagaaaaaa

SEQ ID NO: 10579 - RNA, 19 nt, Artificial Sequence
  RNA Oligomer
guaaaaugcugaccuauag

SEQ ID NO: 10580 - RNA, 19 nt, Artificial Sequence
  RNA Oligomer
gguaaaaugcugaccuaua

SEQ ID NO: 10581 - RNA, 19 nt, Artificial Sequence
  RNA Oligomer
accaugcucuuuuuguuaa

SEQ ID NO: 10582 - RNA, 19 nt, Artificial Sequence
  RNA Oligomer
gcaaaacaguuaggugugc

SEQ ID NO: 10583 - RNA, 19 nt, Artificial Sequence
  RNA Oligomer
acucaccuauguuaugcaa

SEQ ID NO: 10584 - RNA, 19 nt, Artificial Sequence
  RNA Oligomer
ugucacuacucaccuaugu

SEQ ID NO: 10585 - RNA, 19 nt, Artificial Sequence
  RNA Oligomer
ggaaaaugucacuacucac

SEQ ID NO: 10586 - RNA, 19 nt, Artificial Sequence
  RNA Oligomer
caguggaaaagauaaggaa

SEQ ID NO: 10587 - RNA, 19 nt, Artificial Sequence
  RNA Oligomer
caguaucaguggaaaagau

SEQ ID NO: 10588 - RNA, 19 nt, Artificial Sequence
  RNA Oligomer
ugaguagagucaugguaua

SEQ ID NO: 10589 - RNA, 19 nt, Artificial Sequence
  RNA Oligomer
caaagguacacagaacaca

SEQ ID NO: 10590 - RNA, 19 nt, Artificial Sequence
  RNA Oligomer
cgcaccauuguagauuguc

SEQ ID NO: 10591 - RNA, 19 nt, Artificial Sequence
  RNA Oligomer
ggaugaggguguugcuuuc

SEQ ID NO: 10592 - RNA, 19 nt, Artificial Sequence
  RNA Oligomer
accauuggaugaggguguu

SEQ ID NO: 10593 - RNA, 19 nt, Artificial Sequence
  RNA Oligomer
cagauaauaucuuugcacu

SEQ ID NO: 10594 - RNA, 19 nt, Artificial Sequence
  RNA Oligomer
aucacaucaaauaggcauu

SEQ ID NO: 10595 - RNA, 19 nt, Artificial Sequence
  RNA Oligomer
ucuucccacauaucaaaau

SEQ ID NO: 10596 - RNA, 19 nt, Artificial Sequence
  RNA Oligomer
agucuggcaucauaaucau

SEQ ID NO: 10597 - RNA, 19 nt, Artificial Sequence
  RNA Oligomer
caagaagucuggcaucaua

SEQ ID NO: 10598 - RNA, 19 nt, Artificial Sequence
  RNA Oligomer
ccuugcugaaauuuaggau

SEQ ID NO: 10599 - RNA, 19 nt, Artificial Sequence
  RNA Oligomer
uagcuucuauaucugucuu

SEQ ID NO: 10600 - RNA, 19 nt, Artificial Sequence
  RNA Oligomer
cuauucagaagcagccaag

SEQ ID NO: 10601 - RNA, 19 nt, Artificial Sequence
  RNA Oligomer
agaaggguugauaaaaguu

SEQ ID NO: 10602 - RNA, 19 nt, Artificial Sequence
  RNA Oligomer
caaagaaggguugauaaaa

SEQ ID NO: 10603 - RNA, 19 nt, Artificial Sequence
  RNA Oligomer
caauaagcaaagaaggguu

SEQ ID NO: 10604 - RNA, 19 nt, Artificial Sequence
  RNA Oligomer
gcaauaagcaaagaagggu

SEQ ID NO: 10605 - RNA, 19 nt, Artificial Sequence
  RNA Oligomer
cugaauaaaaauggaggga

SEQ ID NO: 10606 - RNA, 19 nt, Artificial Sequence
  RNA Oligomer
agguauaggaaagacugaa

SEQ ID NO: 10607 - RNA, 19 nt, Artificial Sequence
  RNA Oligomer
agauauuuacugagaggaa

SEQ ID NO: 10608 - RNA, 19 nt, Artificial Sequence
  RNA Oligomer
gucuugcaaaauccaauag

SEQ ID NO: 10609 - RNA, 19 nt, Artificial Sequence
  RNA Oligomer
cccugacucuuauuuuccc

SEQ ID NO: 10610 - RNA, 19 nt, Artificial Sequence
  RNA Oligomer
gucccugacucuuauuuuc

SEQ ID NO: 10611 - RNA, 19 nt, Artificial Sequence
  RNA Oligomer
gaacaccauuuuaucucag

SEQ ID NO: 10612 - RNA, 19 nt, Artificial Sequence
  RNA Oligomer
agaacaccauuuuaucuca

SEQ ID NO: 10613 - RNA, 19 nt, Artificial Sequence
  RNA Oligomer
ggaaaggaacucaaaacac

SEQ ID NO: 10614 - RNA, 19 nt, Artificial Sequence
  RNA Oligomer
uccuaaucaugccaugugu

SEQ ID NO: 10615 - RNA, 19 nt, Artificial Sequence
  RNA Oligomer
uggaagaucacugggauug

SEQ ID NO: 10616 - RNA, 19 nt, Artificial Sequence
  RNA Oligomer
acuggugauuuuggaagau

SEQ ID NO: 10617 - RNA, 19 nt, Artificial Sequence
  RNA Oligomer
agaauccauuuagcaccuc

SEQ ID NO: 10618 - RNA, 19 nt, Artificial Sequence
  RNA Oligomer
cuguauguauuuuuggaac

SEQ ID NO: 10619 - RNA, 19 nt, Artificial Sequence
  RNA Oligomer
agcaagagacuguauguau

SEQ ID NO: 10620 - RNA, 19 nt, Artificial Sequence
  RNA Oligomer
cuuuccaauaacagcacuu

SEQ ID NO: 10621 - RNA, 19 nt, Artificial Sequence
  RNA Oligomer
cguaaucuacccuuauguu

SEQ ID NO: 10622 - RNA, 19 nt, Artificial Sequence
  RNA Oligomer
acguaaucuacccuuaugu

SEQ ID NO: 10623 - RNA, 19 nt, Artificial Sequence
  RNA Oligomer
cccugcagcuauuuccaau

SEQ ID NO: 10624 - RNA, 19 nt, Artificial Sequence
  RNA Oligomer
cucuuacuaugaauucuuc

SEQ ID NO: 10625 - RNA, 19 nt, Artificial Sequence
  RNA Oligomer
acgugguaaaagcauuuaa

SEQ ID NO: 10626 - RNA, 19 nt, Artificial Sequence
  RNA Oligomer
cugauauguuuccuguauu

SEQ ID NO: 10627 - RNA, 19 nt, Artificial Sequence
  RNA Oligomer
cagaugaaaauaagugcuu

SEQ ID NO: 10628 - RNA, 19 nt, Artificial Sequence
  RNA Oligomer
aagguagaaagaaugaguu

SEQ ID NO: 10629 - RNA, 19 nt, Artificial Sequence
  RNA Oligomer
ugacuccuccaguuuacuu

SEQ ID NO: 10630 - RNA, 19 nt, Artificial Sequence
  RNA Oligomer
aaguucuccuucuguccuu

SEQ ID NO: 10631 - RNA, 19 nt, Artificial Sequence
  RNA Oligomer
ucaccgaaaauagaaaaug

SEQ ID NO: 10632 - RNA, 19 nt, Artificial Sequence
  RNA Oligomer
agaagagaguaauguguuu

SEQ ID NO: 10633 - RNA, 19 nt, Artificial Sequence
  RNA Oligomer
cuagagaagucuuuggagu

SEQ ID NO: 10634 - RNA, 19 nt, Artificial Sequence
  RNA Oligomer
gcauugguugauuaaaguu

SEQ ID NO: 10635 - RNA, 19 nt, Artificial Sequence
  RNA Oligomer
cucaccuauguuaugcaaa

SEQ ID NO: 10636 - RNA, 19 nt, Artificial Sequence
  RNA Oligomer
cagagagcauuaugauuuu

SEQ ID NO: 10637 - RNA, 19 nt, Artificial Sequence
  RNA Oligomer
ugcaaagguacacagaaca

SEQ ID NO: 10638 - RNA, 19 nt, Artificial Sequence
  RNA Oligomer
cuaaagugaccuuaucaau

SEQ ID NO: 10639 - RNA, 19 nt, Artificial Sequence
  RNA Oligomer
ucuaaagugaccuuaucaa

SEQ ID NO: 10640 - RNA, 19 nt, Artificial Sequence
  RNA Oligomer
ggccuuacguaauauauuu

SEQ ID NO: 10641 - RNA, 19 nt, Artificial Sequence
  RNA Oligomer
cuaaaaggcacugaguuug

SEQ ID NO: 10642 - RNA, 19 nt, Artificial Sequence
  RNA Oligomer
uggcaucauaaucauagca

SEQ ID NO: 10643 - RNA, 19 nt, Artificial Sequence
  RNA Oligomer
ugugcugauaguacccuuu

SEQ ID NO: 10644 - RNA, 19 nt, Artificial Sequence
  RNA Oligomer
guuuuucugugcugauagu

SEQ ID NO: 10645 - RNA, 19 nt, Artificial Sequence
  RNA Oligomer
cugaaauuuaggaugguuc

SEQ ID NO: 10646 - RNA, 19 nt, Artificial Sequence
  RNA Oligomer
ugcugaaauuuaggauggu

SEQ ID NO: 10647 - RNA, 19 nt, Artificial Sequence
  RNA Oligomer
ucgaaaauuacggaaaauc

SEQ ID NO: 10648 - RNA, 19 nt, Artificial Sequence
  RNA Oligomer
caaugcauagaugaucgaa

SEQ ID NO: 10649 - RNA, 19 nt, Artificial Sequence
  RNA Oligomer
auagucugcagguauaaau

SEQ ID NO: 10650 - RNA, 19 nt, Artificial Sequence
  RNA Oligomer
gaauuuuagacagcaagcu

SEQ ID NO: 10651 - RNA, 19 nt, Artificial Sequence
  RNA Oligomer
aaagaaggguugauaaaag

SEQ ID NO: 10652 - RNA, 19 nt, Artificial Sequence
  RNA Oligomer
ugaauucuagugaaaugac

SEQ ID NO: 10653 - RNA, 19 nt, Artificial Sequence
  RNA Oligomer
gggcugaguuaagugaaag

SEQ ID NO: 10654 - RNA, 19 nt, Artificial Sequence
  RNA Oligomer
ucuugcaaaauccaauaga

SEQ ID NO: 10655 - RNA, 19 nt, Artificial Sequence
  RNA Oligomer
gagauugagacuagccuug

SEQ ID NO: 10656 - RNA, 19 nt, Artificial Sequence
  RNA Oligomer
ugagauugagacuagccuu

SEQ ID NO: 10657 - RNA, 19 nt, Artificial Sequence
  RNA Oligomer
ugacucuuauuuucccaga

SEQ ID NO: 10658 - RNA, 19 nt, Artificial Sequence
  RNA Oligomer
ccugacucuuauuuuccca

SEQ ID NO: 10659 - RNA, 19 nt, Artificial Sequence
  RNA Oligomer
ccauuuuaucucagguuag

SEQ ID NO: 10660 - RNA, 19 nt, Artificial Sequence
  RNA Oligomer
gcuugucuuugagaaauug

SEQ ID NO: 10661 - RNA, 19 nt, Artificial Sequence
  RNA Oligomer
uugcuugucuuugagaaau

SEQ ID NO: 10662 - RNA, 19 nt, Artificial Sequence
  RNA Oligomer
ccuaaucaugccaugugua

SEQ ID NO: 10663 - RNA, 19 nt, Artificial Sequence
  RNA Oligomer
guccuaaucaugccaugug

SEQ ID NO: 10664 - RNA, 19 nt, Artificial Sequence
  RNA Oligomer
ccucagcccuucaaaucuc

SEQ ID NO: 10665 - RNA, 19 nt, Artificial Sequence
  RNA Oligomer
cuggugauuuuggaagauc

SEQ ID NO: 10666 - RNA, 19 nt, Artificial Sequence
  RNA Oligomer
uguuuguacucuugggaau

SEQ ID NO: 10667 - RNA, 19 nt, Artificial Sequence
  RNA Oligomer
gaacuggugauuuuggaag

SEQ ID NO: 10668 - RNA, 19 nt, Artificial Sequence
  RNA Oligomer
cagugauucauauguggcu

SEQ ID NO: 10669 - RNA, 19 nt, Artificial Sequence
  RNA Oligomer
gagaauccauuuagcaccu

SEQ ID NO: 10670 - RNA, 19 nt, Artificial Sequence
  RNA Oligomer
ggagaauccauuuagcacc

SEQ ID NO: 10671 - RNA, 19 nt, Artificial Sequence
  RNA Oligomer
gacuguauguauuuuugga

SEQ ID NO: 10672 - RNA, 19 nt, Artificial Sequence
  RNA Oligomer
ccucccugguguuauugcu

SEQ ID NO: 10673 - RNA, 19 nt, Artificial Sequence
  RNA Oligomer
cagaaaagcaagagacugu

SEQ ID NO: 10674 - RNA, 19 nt, Artificial Sequence
  RNA Oligomer
cauuucguauggcuauuuc

SEQ ID NO: 10675 - RNA, 19 nt, Artificial Sequence
  RNA Oligomer
guguuauaagagacguaau

SEQ ID NO: 10676 - RNA, 19 nt, Artificial Sequence
  RNA Oligomer
cuauuguguuauaagagac

SEQ ID NO: 10677 - RNA, 19 nt, Artificial Sequence
  RNA Oligomer
ugugucuucuuguuuuucu

SEQ ID NO: 10678 - RNA, 19 nt, Artificial Sequence
  RNA Oligomer
uccucuuacuaugaauucu

SEQ ID NO: 10679 - RNA, 19 nt, Artificial Sequence
  RNA Oligomer
cacuuccucuuacuaugaa

SEQ ID NO: 10680 - RNA, 19 nt, Artificial Sequence
  RNA Oligomer
cgugguaaaagcauuuaac

SEQ ID NO: 10681 - RNA, 19 nt, Artificial Sequence
  RNA Oligomer
guuaagggaugauggcuuu

SEQ ID NO: 10682 - RNA, 19 nt, Artificial Sequence
  RNA Oligomer
cuaaacuucuuuacugcug

SEQ ID NO: 10683 - RNA, 19 nt, Artificial Sequence
  RNA Oligomer
ggcgaacuguauuccuuuu

SEQ ID NO: 10684 - RNA, 19 nt, Artificial Sequence
  RNA Oligomer
ucugaugguuuuggcauaa

SEQ ID NO: 10685 - RNA, 19 nt, Artificial Sequence
  RNA Oligomer
gaguaguuaaaagcaauuc

SEQ ID NO: 10686 - RNA, 19 nt, Artificial Sequence
  RNA Oligomer
agaguaauguguuuauccu

SEQ ID NO: 10687 - RNA, 19 nt, Artificial Sequence
  RNA Oligomer
gaagagaguaauguguuua

SEQ ID NO: 10688 - RNA, 19 nt, Artificial Sequence
  RNA Oligomer
gaguuaaccaugcucuuuu

SEQ ID NO: 10689 - RNA, 19 nt, Artificial Sequence
  RNA Oligomer
ggcuggucuagagaagucu

SEQ ID NO: 10690 - RNA, 19 nt, Artificial Sequence
  RNA Oligomer
cuugagcauugguugauua

SEQ ID NO: 10691 - RNA, 19 nt, Artificial Sequence
  RNA Oligomer
acuugagcauugguugauu

SEQ ID NO: 10692 - RNA, 19 nt, Artificial Sequence
  RNA Oligomer
caaaacaguuaggugugcu

SEQ ID NO: 10693 - RNA, 19 nt, Artificial Sequence
  RNA Oligomer
agauaaggaaaaugucacu

SEQ ID NO: 10694 - RNA, 19 nt, Artificial Sequence
  RNA Oligomer
ucaguggaaaagauaagga

SEQ ID NO: 10695 - RNA, 19 nt, Artificial Sequence
  RNA Oligomer
cuacaguaucaguggaaaa

SEQ ID NO: 10696 - RNA, 19 nt, Artificial Sequence
  RNA Oligomer
ccauuggaugaggguguug

SEQ ID NO: 10697 - RNA, 19 nt, Artificial Sequence
  RNA Oligomer
aucuggccuuacguaauau

SEQ ID NO: 10698 - RNA, 19 nt, Artificial Sequence
  RNA Oligomer
gcuuuguuuuucuaaaggc

SEQ ID NO: 10699 - RNA, 19 nt, Artificial Sequence
  RNA Oligomer
gucuggcaucauaaucaua

SEQ ID NO: 10700 - RNA, 19 nt, Artificial Sequence
  RNA Oligomer
aggaugguucucacuguuu

SEQ ID NO: 10701 - RNA, 19 nt, Artificial Sequence
  RNA Oligomer
ugaaauuuaggaugguucu

SEQ ID NO: 10702 - RNA, 19 nt, Artificial Sequence
  RNA Oligomer
caaauccuugcugaaauuu

SEQ ID NO: 10703 - RNA, 19 nt, Artificial Sequence
  RNA Oligomer
gaauagucugcagguauaa

SEQ ID NO: 10704 - RNA, 19 nt, Artificial Sequence
  RNA Oligomer
cagaauuuuagacagcaag

SEQ ID NO: 10705 - RNA, 19 nt, Artificial Sequence
  RNA Oligomer
agcaaagaaggguugauaa

SEQ ID NO: 10706 - RNA, 19 nt, Artificial Sequence
  RNA Oligomer
uggcauguaauucuuccuc

SEQ ID NO: 10707 - RNA, 19 nt, Artificial Sequence
  RNA Oligomer
cuggcauguaauucuuccu

SEQ ID NO: 10708 - RNA, 19 nt, Artificial Sequence
  RNA Oligomer
cguaucuauagagcuggca

SEQ ID NO: 10709 - RNA, 19 nt, Artificial Sequence
  RNA Oligomer
gucuuggauacauacguau

SEQ ID NO: 10710 - RNA, 19 nt, Artificial Sequence
  RNA Oligomer
cugagaggaacuauuuuua

SEQ ID NO: 10711 - RNA, 19 nt, Artificial Sequence
  RNA Oligomer
cugaggaagugggucacau

SEQ ID NO: 10712 - RNA, 19 nt, Artificial Sequence
  RNA Oligomer
gcuuuauuagguauaucug

SEQ ID NO: 10713 - RNA, 19 nt, Artificial Sequence
  RNA Oligomer
guuucacacuaaagaguuu

SEQ ID NO: 10714 - RNA, 19 nt, Artificial Sequence
  RNA Oligomer
acauacuggaagagaacac

SEQ ID NO: 10715 - RNA, 19 nt, Artificial Sequence
  RNA Oligomer
agaaauugacugacauacu

SEQ ID NO: 10716 - RNA, 19 nt, Artificial Sequence
  RNA Oligomer
gagaaauugacugacauac

SEQ ID NO: 10717 - RNA, 19 nt, Artificial Sequence
  RNA Oligomer
uugagaaauugacugacau

SEQ ID NO: 10718 - RNA, 19 nt, Artificial Sequence
  RNA Oligomer
cauugcuugucuuugagaa

SEQ ID NO: 10719 - RNA, 19 nt, Artificial Sequence
  RNA Oligomer
ucugaacuaugguuuugaa

SEQ ID NO: 10720 - RNA, 19 nt, Artificial Sequence
  RNA Oligomer
gcuggauuucugaacuaug

SEQ ID NO: 10721 - RNA, 19 nt, Artificial Sequence
  RNA Oligomer
ugggaaaggaacucaaaac

SEQ ID NO: 10722 - RNA, 19 nt, Artificial Sequence
  RNA Oligomer
cacugggauugaaaaugcu

SEQ ID NO: 10723 - RNA, 19 nt, Artificial Sequence
  RNA Oligomer
uccugcagccuacguguua

SEQ ID NO: 10724 - RNA, 19 nt, Artificial Sequence
  RNA Oligomer
aaaucucagaugguaucuu

SEQ ID NO: 10725 - RNA, 19 nt, Artificial Sequence
  RNA Oligomer
cuguuuguacucuugggaa

SEQ ID NO: 10726 - RNA, 19 nt, Artificial Sequence
  RNA Oligomer
uggagauugggaaacuuaa

SEQ ID NO: 10727 - RNA, 19 nt, Artificial Sequence
  RNA Oligomer
cuugaccacuggaugcuuu

SEQ ID NO: 10728 - RNA, 19 nt, Artificial Sequence
  RNA Oligomer
aagcaagagacuguaugua

SEQ ID NO: 10729 - RNA, 19 nt, Artificial Sequence
  RNA Oligomer
uccaaaucguaucuuucca

SEQ ID NO: 10730 - RNA, 19 nt, Artificial Sequence
  RNA Oligomer
uguguuauaagagacguaa

SEQ ID NO: 10731 - RNA, 19 nt, Artificial Sequence
  RNA Oligomer
uuguguuauaagagacgua

SEQ ID NO: 10732 - RNA, 19 nt, Artificial Sequence
  RNA Oligomer
ccuucuauuugucugcugu

SEQ ID NO: 10733 - RNA, 19 nt, Artificial Sequence
  RNA Oligomer
uggcagccaaagaaauuga

SEQ ID NO: 10734 - RNA, 19 nt, Artificial Sequence
  RNA Oligomer
caagcaaagagugauggau

SEQ ID NO: 10735 - RNA, 19 nt, Artificial Sequence
  RNA Oligomer
guguggaaaugacagcaaa

SEQ ID NO: 10736 - RNA, 19 nt, Artificial Sequence
  RNA Oligomer
guaaaagcauuuaacacca

SEQ ID NO: 10737 - RNA, 19 nt, Artificial Sequence
  RNA Oligomer
cacgugguaaaagcauuua

SEQ ID NO: 10738 - RNA, 19 nt, Artificial Sequence
  RNA Oligomer
aaacuucuuuacugcugau

SEQ ID NO: 10739 - RNA, 19 nt, Artificial Sequence
  RNA Oligomer
cgaacuguauuccuuuuaa

SEQ ID NO: 10740 - RNA, 19 nt, Artificial Sequence
  RNA Oligomer
gcuuugggcgaacuguauu

SEQ ID NO: 10741 - RNA, 19 nt, Artificial Sequence
  RNA Oligomer
acaucagcaacaaccucaa

SEQ ID NO: 10742 - RNA, 19 nt, Artificial Sequence
  RNA Oligomer
gcacucugaugguuuuggc

SEQ ID NO: 10743 - RNA, 19 nt, Artificial Sequence
  RNA Oligomer
uggaaaaauauugguagac

SEQ ID NO: 10744 - RNA, 19 nt, Artificial Sequence
  RNA Oligomer
augcugaccuauagaaaaa

SEQ ID NO: 10745 - RNA, 19 nt, Artificial Sequence
  RNA Oligomer
ccgaaaauagaaaaugcca

SEQ ID NO: 10746 - RNA, 19 nt, Artificial Sequence
  RNA Oligomer
agagaguaauguguuuauc

SEQ ID NO: 10747 - RNA, 19 nt, Artificial Sequence
  RNA Oligomer
gcuggucuagagaagucuu

SEQ ID NO: 10748 - RNA, 19 nt, Artificial Sequence
  RNA Oligomer
uacuugagcauugguugau

SEQ ID NO: 10749 - RNA, 19 nt, Artificial Sequence
  RNA Oligomer
gauaaggaaaaugucacua

SEQ ID NO: 10750 - RNA, 19 nt, Artificial Sequence
  RNA Oligomer
ggauacaaaaaguuggacg

SEQ ID NO: 10751 - RNA, 19 nt, Artificial Sequence
  RNA Oligomer
gcaaggauacaaaaaguug

SEQ ID NO: 10752 - RNA, 19 nt, Artificial Sequence
  RNA Oligomer
gcuccuucaacuuaucuuu

SEQ ID NO: 10753 - RNA, 19 nt, Artificial Sequence
  RNA Oligomer
cacaucaaauaggcauuuu

SEQ ID NO: 10754 - RNA, 19 nt, Artificial Sequence
  RNA Oligomer
ucacaucaaauaggcauuu

SEQ ID NO: 10755 - RNA, 19 nt, Artificial Sequence
  RNA Oligomer
gaucuucccacauaucaaa

SEQ ID NO: 10756 - RNA, 19 nt, Artificial Sequence
  RNA Oligomer
agaagucuggcaucauaau

SEQ ID NO: 10757 - RNA, 19 nt, Artificial Sequence
  RNA Oligomer
gaaauuuggaucuuucuca

SEQ ID NO: 10758 - RNA, 19 nt, Artificial Sequence
  RNA Oligomer
ggaaaaucauagggcagag

SEQ ID NO: 10759 - RNA, 19 nt, Artificial Sequence
  RNA Oligomer
cggaaaaucauagggcaga

SEQ ID NO: 10760 - RNA, 19 nt, Artificial Sequence
  RNA Oligomer
ugcagguauaaauuugaac

SEQ ID NO: 10761 - RNA, 19 nt, Artificial Sequence
  RNA Oligomer
guaucuauagagcuggcau

SEQ ID NO: 10762 - RNA, 19 nt, Artificial Sequence
  RNA Oligomer
cagauauuuacugagagga

SEQ ID NO: 10763 - RNA, 19 nt, Artificial Sequence
  RNA Oligomer
agguauaucugaggaagug

SEQ ID NO: 10764 - RNA, 19 nt, Artificial Sequence
  RNA Oligomer
caagggcugaguuaaguga

SEQ ID NO: 10765 - RNA, 19 nt, Artificial Sequence
  RNA Oligomer
gcaacaugcaugaccuaau

SEQ ID NO: 10766 - RNA, 19 nt, Artificial Sequence
  RNA Oligomer
gguuucacacuaaagaguu

SEQ ID NO: 10767 - RNA, 19 nt, Artificial Sequence
  RNA Oligomer
cugagauugagacuagccu

SEQ ID NO: 10768 - RNA, 19 nt, Artificial Sequence
  RNA Oligomer
gugugguuauucuguuguu

SEQ ID NO: 10769 - RNA, 19 nt, Artificial Sequence
  RNA Oligomer
cgugacugagggaaacauu

SEQ ID NO: 10770 - RNA, 19 nt, Artificial Sequence
  RNA Oligomer
cuggauuucugaacuaugg

SEQ ID NO: 10771 - RNA, 19 nt, Artificial Sequence
  RNA Oligomer
agaaaaagcauugaaugga

SEQ ID NO: 10772 - RNA, 19 nt, Artificial Sequence
  RNA Oligomer
aggaacucaaaacacuaga

SEQ ID NO: 10773 - RNA, 19 nt, Artificial Sequence
  RNA Oligomer
cugggaaaggaacucaaaa

SEQ ID NO: 10774 - RNA, 19 nt, Artificial Sequence
  RNA Oligomer
gcugggaaaggaacucaaa

SEQ ID NO: 10775 - RNA, 19 nt, Artificial Sequence
  RNA Oligomer
agaucacugggauugaaaa

SEQ ID NO: 10776 - RNA, 19 nt, Artificial Sequence
  RNA Oligomer
ucaaaucucagaugguauc

SEQ ID NO: 10777 - RNA, 19 nt, Artificial Sequence
  RNA Oligomer
cuucaaaucucagauggua

SEQ ID NO: 10778 - RNA, 19 nt, Artificial Sequence
  RNA Oligomer
cagcccuucaaaucucaga

SEQ ID NO: 10779 - RNA, 19 nt, Artificial Sequence
  RNA Oligomer
ugauuuuggaagaucacug

SEQ ID NO: 10780 - RNA, 19 nt, Artificial Sequence
  RNA Oligomer
gauggagauugggaaacuu

SEQ ID NO: 10781 - RNA, 19 nt, Artificial Sequence
  RNA Oligomer
cacuugugauuccuauucg

SEQ ID NO: 10782 - RNA, 19 nt, Artificial Sequence
  RNA Oligomer
gcuugaccacuggaugcuu

SEQ ID NO: 10783 - RNA, 19 nt, Artificial Sequence
  RNA Oligomer
uccauuccaaaucguaucu

SEQ ID NO: 10784 - RNA, 19 nt, Artificial Sequence
  RNA Oligomer
uguuauaagagacguaauc

SEQ ID NO: 10785 - RNA, 19 nt, Artificial Sequence
  RNA Oligomer
cugugcugugugucuucuu

SEQ ID NO: 10786 - RNA, 19 nt, Artificial Sequence
  RNA Oligomer
gcugugcugugugucuucu

SEQ ID NO: 10787 - RNA, 19 nt, Artificial Sequence
  RNA Oligomer
cuauuugucugcugugcug

SEQ ID NO: 10788 - RNA, 19 nt, Artificial Sequence
  RNA Oligomer
ucauggcagccaaagaaau

SEQ ID NO: 10789 - RNA, 19 nt, Artificial Sequence
  RNA Oligomer
cuuccucuuacuaugaauu

SEQ ID NO: 10790 - RNA, 19 nt, Artificial Sequence
  RNA Oligomer
uguuaagggaugauggcuu

SEQ ID NO: 10791 - RNA, 19 nt, Artificial Sequence
  RNA Oligomer
ugauauguuuccuguauuc

SEQ ID NO: 10792 - RNA, 19 nt, Artificial Sequence
  RNA Oligomer
acagaugaaaauaagugcu

SEQ ID NO: 10793 - RNA, 19 nt, Artificial Sequence
  RNA Oligomer
caacagaugaaaauaagug

SEQ ID NO: 10794 - RNA, 19 nt, Artificial Sequence
  RNA Oligomer
gcauuuccagaccugaccu

SEQ ID NO: 10795 - RNA, 19 nt, Artificial Sequence
  RNA Oligomer
aaaaugcugaccuauagaa

SEQ ID NO: 10796 - RNA, 19 nt, Artificial Sequence
  RNA Oligomer
uccauagguaaaaugcuga

SEQ ID NO: 10797 - RNA, 19 nt, Artificial Sequence
  RNA Oligomer
caccgaaaauagaaaaugc

SEQ ID NO: 10798 - RNA, 19 nt, Artificial Sequence
  RNA Oligomer
guguuuauccuggcucaua

SEQ ID NO: 10799 - RNA, 19 nt, Artificial Sequence
  RNA Oligomer
aguuaaccaugcucuuuuu

SEQ ID NO: 10800 - RNA, 19 nt, Artificial Sequence
  RNA Oligomer
aggcuggucuagagaaguc

SEQ ID NO: 10801 - RNA, 19 nt, Artificial Sequence
  RNA Oligomer
agcauugguugauuaaagu

SEQ ID NO: 10802 - RNA, 19 nt, Artificial Sequence
  RNA Oligomer
gagcauugguugauuaaag

SEQ ID NO: 10803 - RNA, 19 nt, Artificial Sequence
  RNA Oligomer
ugagcauugguugauuaaa

SEQ ID NO: 10804 - RNA, 19 nt, Artificial Sequence
  RNA Oligomer
uggacgacauugaguagag

SEQ ID NO: 10805 - RNA, 19 nt, Artificial Sequence
  RNA Oligomer
ugaggguguugcuuucauc

SEQ ID NO: 10806 - RNA, 19 nt, Artificial Sequence
  RNA Oligomer
uggaugaggguguugcuuu

SEQ ID NO: 10807 - RNA, 19 nt, Artificial Sequence
  RNA Oligomer
ugauaauguugccaagcca

SEQ ID NO: 10808 - RNA, 19 nt, Artificial Sequence
  RNA Oligomer
agauaauaucuuugcacug

SEQ ID NO: 10809 - RNA, 19 nt, Artificial Sequence
  RNA Oligomer
ccucuuuccuuauuaaaca

SEQ ID NO: 10810 - RNA, 19 nt, Artificial Sequence
  RNA Oligomer
ugaucuucccacauaucaa

SEQ ID NO: 10811 - RNA, 19 nt, Artificial Sequence
  RNA Oligomer
gccuuaugcaugaucuucc

SEQ ID NO: 10812 - RNA, 19 nt, Artificial Sequence
  RNA Oligomer
gaaaacuuguauagaugca

SEQ ID NO: 10813 - RNA, 19 nt, Artificial Sequence
  RNA Oligomer
aggugugaagauucaucau

SEQ ID NO: 10814 - RNA, 19 nt, Artificial Sequence
  RNA Oligomer
agagaggugugaagauuca

SEQ ID NO: 10815 - RNA, 19 nt, Artificial Sequence
  RNA Oligomer
gucugcagguauaaauuug

SEQ ID NO: 10816 - RNA, 19 nt, Artificial Sequence
  RNA Oligomer
accagaauuuuagacagca

SEQ ID NO: 10817 - RNA, 19 nt, Artificial Sequence
  RNA Oligomer
gaaaccagaauuuuagaca

SEQ ID NO: 10818 - RNA, 19 nt, Artificial Sequence
  RNA Oligomer
gaauaaaaauggagggaua

SEQ ID NO: 10819 - RNA, 19 nt, Artificial Sequence
  RNA Oligomer
acugagaggaacuauuuuu

SEQ ID NO: 10820 - RNA, 19 nt, Artificial Sequence
  RNA Oligomer
guggugcagaagucuugag

SEQ ID NO: 10821 - RNA, 19 nt, Artificial Sequence
  RNA Oligomer
gaguuaagugaaaggaaaa

SEQ ID NO: 10822 - RNA, 19 nt, Artificial Sequence
  RNA Oligomer
cugaguuaagugaaaggaa

SEQ ID NO: 10823 - RNA, 19 nt, Artificial Sequence
  RNA Oligomer
gcugaguuaagugaaagga

SEQ ID NO: 10824 - RNA, 19 nt, Artificial Sequence
  RNA Oligomer
ggcugaguuaagugaaagg

SEQ ID NO: 10825 - RNA, 19 nt, Artificial Sequence
  RNA Oligomer
ugguuucacacuaaagagu

SEQ ID NO: 10826 - RNA, 19 nt, Artificial Sequence
  RNA Oligomer
cugacucuuauuuucccag

SEQ ID NO: 10827 - RNA, 19 nt, Artificial Sequence
  RNA Oligomer
gucuuugagaaauugacug

SEQ ID NO: 10828 - RNA, 19 nt, Artificial Sequence
  RNA Oligomer
guuauggagaaaacuugua

SEQ ID NO: 10829 - RNA, 19 nt, Artificial Sequence
  RNA Oligomer
gauuucugaacuaugguuu

SEQ ID NO: 10830 - RNA, 19 nt, Artificial Sequence
  RNA Oligomer
ucacugggauugaaaaugc

SEQ ID NO: 10831 - RNA, 19 nt, Artificial Sequence
  RNA Oligomer
cucagcccuucaaaucuca

SEQ ID NO: 10832 - RNA, 19 nt, Artificial Sequence
  RNA Oligomer
gcuuugggaauacuugggu

SEQ ID NO: 10833 - RNA, 19 nt, Artificial Sequence
  RNA Oligomer
ucauauguggcuuugggaa

SEQ ID NO: 10834 - RNA, 19 nt, Artificial Sequence
  RNA Oligomer
acacugcuugcuuugguuu

SEQ ID NO: 10835 - RNA, 19 nt, Artificial Sequence
  RNA Oligomer
uacacugcuugcuuugguu

SEQ ID NO: 10836 - RNA, 19 nt, Artificial Sequence
  RNA Oligomer
acuuccucuuacuaugaau

SEQ ID NO: 10837 - RNA, 19 nt, Artificial Sequence
  RNA Oligomer
agguguuuguguguggaaa

SEQ ID NO: 10838 - RNA, 19 nt, Artificial Sequence
  RNA Oligomer
gcagguguuugugugugga

SEQ ID NO: 10839 - RNA, 19 nt, Artificial Sequence
  RNA Oligomer
gugguaaaagcauuuaaca

SEQ ID NO: 10840 - RNA, 19 nt, Artificial Sequence
  RNA Oligomer
cuuuacugcugauauguuu

SEQ ID NO: 10841 - RNA, 19 nt, Artificial Sequence
  RNA Oligomer
cagauccaaacuauuuuac

SEQ ID NO: 10842 - RNA, 19 nt, Artificial Sequence
  RNA Oligomer
cauuuccagaccugaccuu

SEQ ID NO: 10843 - RNA, 19 nt, Artificial Sequence
  RNA Oligomer
aaagagcacucugaugguu

SEQ ID NO: 10844 - RNA, 19 nt, Artificial Sequence
  RNA Oligomer
ccugaguaguuaaaagcaa

SEQ ID NO: 10845 - RNA, 19 nt, Artificial Sequence
  RNA Oligomer
caugcucuuuuuguuaaag

SEQ ID NO: 10846 - RNA, 19 nt, Artificial Sequence
  RNA Oligomer
uaaccaugcucuuuuuguu

SEQ ID NO: 10847 - RNA, 19 nt, Artificial Sequence
  RNA Oligomer
gauuaaaguuuagguacca

SEQ ID NO: 10848 - RNA, 19 nt, Artificial Sequence
  RNA Oligomer
ugauuaaaguuuagguacc

SEQ ID NO: 10849 - RNA, 19 nt, Artificial Sequence
  RNA Oligomer
gagagcauuaugauuuucu

SEQ ID NO: 10850 - RNA, 19 nt, Artificial Sequence
  RNA Oligomer
aggauacaaaaaguuggac

SEQ ID NO: 10851 - RNA, 19 nt, Artificial Sequence
  RNA Oligomer
agagagcauuaugauuuuc

SEQ ID NO: 10852 - RNA, 19 nt, Artificial Sequence
  RNA Oligomer
auaacugguugcaaaggua

SEQ ID NO: 10853 - RNA, 19 nt, Artificial Sequence
  RNA Oligomer
aauuuucgaucaucuaugc

SEQ ID NO: 10854 - RNA, 19 nt, Artificial Sequence
  RNA Oligomer
uacuucuauuggauuuugc

SEQ ID NO: 10855 - RNA, 19 nt, Artificial Sequence
  RNA Oligomer
aaggucacuuuagaaaugg

SEQ ID NO: 10856 - RNA, 19 nt, Artificial Sequence
  RNA Oligomer
aaaagacaaucuacaaugg

SEQ ID NO: 10857 - RNA, 19 nt, Artificial Sequence
  RNA Oligomer
gucuacauguuuaauaagg

SEQ ID NO: 10858 - RNA, 19 nt, Artificial Sequence
  RNA Oligomer
auaaagccuuuaucagugg

SEQ ID NO: 10859 - RNA, 19 nt, Artificial Sequence
  RNA Oligomer
uucuugaguauugccuggg

SEQ ID NO: 10860 - RNA, 19 nt, Artificial Sequence
  RNA Oligomer
accaguuauaaauaaacgc

SEQ ID NO: 10861 - RNA, 19 nt, Artificial Sequence
  RNA Oligomer
acuuuagaaauggcuuggc

SEQ ID NO: 10862 - RNA, 19 nt, Artificial Sequence
  RNA Oligomer
aaaauauccuggauuguug

SEQ ID NO: 10863 - RNA, 19 nt, Artificial Sequence
  RNA Oligomer
uauccuggauuguugaugu

SEQ ID NO: 10864 - RNA, 19 nt, Artificial Sequence
  RNA Oligomer
auugcuaugauuaugaugc

SEQ ID NO: 10865 - RNA, 19 nt, Artificial Sequence
  RNA Oligomer
aaaaugccaaacucagugc

SEQ ID NO: 10866 - RNA, 19 nt, Artificial Sequence
  RNA Oligomer
uagaggacaugaaggaagg

SEQ ID NO: 10867 - RNA, 19 nt, Artificial Sequence
  RNA Oligomer
cuuuucauaaacauaaggg

SEQ ID NO: 10868 - RNA, 19 nt, Artificial Sequence
  RNA Oligomer
uaauaaggaaagagguuug

SEQ ID NO: 10869 - RNA, 19 nt, Artificial Sequence
  RNA Oligomer
uugcuaugauuaugaugcc

SEQ ID NO: 10870 - RNA, 19 nt, Artificial Sequence
  RNA Oligomer
cuucuugaguauugccugg

SEQ ID NO: 10871 - RNA, 19 nt, Artificial Sequence
  RNA Oligomer
uucauaaacauaaggguag

SEQ ID NO: 10872 - RNA, 19 nt, Artificial Sequence
  RNA Oligomer
acucugcauuagauucugg

SEQ ID NO: 10873 - RNA, 19 nt, Artificial Sequence
  RNA Oligomer
uugauugauuuugagguug

SEQ ID NO: 10874 - RNA, 19 nt, Artificial Sequence
  RNA Oligomer
uuuauaaaagccaucaucc

SEQ ID NO: 10875 - RNA, 19 nt, Artificial Sequence
  RNA Oligomer
guuaaaaggaauacaguuc

SEQ ID NO: 10876 - RNA, 19 nt, Artificial Sequence
  RNA Oligomer
ucuaccuuaaguaaacugg

SEQ ID NO: 10877 - RNA, 19 nt, Artificial Sequence
  RNA Oligomer
gucagcuguguuaauaugg

SEQ ID NO: 10878 - RNA, 19 nt, Artificial Sequence
  RNA Oligomer
uuguugcugaugucuacca

SEQ ID NO: 10879 - RNA, 19 nt, Artificial Sequence
  RNA Oligomer
uuuaacaaaaagagcaugg

SEQ ID NO: 10880 - RNA, 19 nt, Artificial Sequence
  RNA Oligomer
aaguaaaagagcaguaucc

SEQ ID NO: 10881 - RNA, 19 nt, Artificial Sequence
  RNA Oligomer
agacaaucuacaauggugc

SEQ ID NO: 10882 - RNA, 19 nt, Artificial Sequence
  RNA Oligomer
aauaaggaaagagguuuga

SEQ ID NO: 10883 - RNA, 19 nt, Artificial Sequence
  RNA Oligomer
uugcugucuaaaauucugg

SEQ ID NO: 10884 - RNA, 19 nt, Artificial Sequence
  RNA Oligomer
agauauaccuaauaaagcc

SEQ ID NO: 10885 - RNA, 19 nt, Artificial Sequence
  RNA Oligomer
aauaaagccuuuaucagug

SEQ ID NO: 10886 - RNA, 19 nt, Artificial Sequence
  RNA Oligomer
aaauagccauacgaaaugu

SEQ ID NO: 10887 - RNA, 19 nt, Artificial Sequence
  RNA Oligomer
auugauuuugagguuguug

SEQ ID NO: 10888 - RNA, 19 nt, Artificial Sequence
  RNA Oligomer
uuuugcauaacauagguga

SEQ ID NO: 10889 - RNA, 19 nt, Artificial Sequence
  RNA Oligomer
uaacauaggugaguaguga

SEQ ID NO: 10890 - RNA, 19 nt, Artificial Sequence
  RNA Oligomer
auauccuggauuguugaug

SEQ ID NO: 10891 - RNA, 19 nt, Artificial Sequence
  RNA Oligomer
aaaacagugagaaccaucc

SEQ ID NO: 10892 - RNA, 19 nt, Artificial Sequence
  RNA Oligomer
acuuaaccuaauauagugc

SEQ ID NO: 10893 - RNA, 19 nt, Artificial Sequence
  RNA Oligomer
ucacuagaauucaucaugg

SEQ ID NO: 10894 - RNA, 19 nt, Artificial Sequence
  RNA Oligomer
aacaacaaaaaccucauuc

SEQ ID NO: 10895 - RNA, 19 nt, Artificial Sequence
  RNA Oligomer
acaacaaaaaccucauucc

SEQ ID NO: 10896 - RNA, 19 nt, Artificial Sequence
  RNA Oligomer
uucuaguguuuugaguucc

SEQ ID NO: 10897 - RNA, 19 nt, Artificial Sequence
  RNA Oligomer
gugcaaggaaugauaagcc

SEQ ID NO: 10898 - RNA, 19 nt, Artificial Sequence
  RNA Oligomer
ugcaaggaaugauaagccc

SEQ ID NO: 10899 - RNA, 19 nt, Artificial Sequence
  RNA Oligomer
uuggaaagauacgauuugg

SEQ ID NO: 10900 - RNA, 19 nt, Artificial Sequence
  RNA Oligomer
aaaacaagaagacacacag

SEQ ID NO: 10901 - RNA, 19 nt, Artificial Sequence
  RNA Oligomer
guacucugcauuagauucu

SEQ ID NO: 10902 - RNA, 19 nt, Artificial Sequence
  RNA Oligomer
uuauaaaagccaucauccc

SEQ ID NO: 10903 - RNA, 19 nt, Artificial Sequence
  RNA Oligomer
uauuaugccaaaaccauca

SEQ ID NO: 10904 - RNA, 19 nt, Artificial Sequence
  RNA Oligomer
uagagcauuuuuacuaggc

SEQ ID NO: 10905 - RNA, 19 nt, Artificial Sequence
  RNA Oligomer
uaacuccaaagacuucucu

SEQ ID NO: 10906 - RNA, 19 nt, Artificial Sequence
  RNA Oligomer
aagacaaucuacaauggug

SEQ ID NO: 10907 - RNA, 19 nt, Artificial Sequence
  RNA Oligomer
aggucacuuuagaaauggc

SEQ ID NO: 10908 - RNA, 19 nt, Artificial Sequence
  RNA Oligomer
ucacuuuagaaauggcuug

SEQ ID NO: 10909 - RNA, 19 nt, Artificial Sequence
  RNA Oligomer
aaagagguuugaaaaaugc

SEQ ID NO: 10910 - RNA, 19 nt, Artificial Sequence
  RNA Oligomer
aaaaaugccaaacucagug

SEQ ID NO: 10911 - RNA, 19 nt, Artificial Sequence
  RNA Oligomer
gugccuuuuaguuauuuug

SEQ ID NO: 10912 - RNA, 19 nt, Artificial Sequence
  RNA Oligomer
uaagacagauauagaagcu

SEQ ID NO: 10913 - RNA, 19 nt, Artificial Sequence
  RNA Oligomer
aagaacuuuuaucaacccu

SEQ ID NO: 10914 - RNA, 19 nt, Artificial Sequence
  RNA Oligomer
aucccuccauuuuuauuca

SEQ ID NO: 10915 - RNA, 19 nt, Artificial Sequence
  RNA Oligomer
gauuuugcaagacauuagg

SEQ ID NO: 10916 - RNA, 19 nt, Artificial Sequence
  RNA Oligomer
uaggacaaacuugaucacc

SEQ ID NO: 10917 - RNA, 19 nt, Artificial Sequence
  RNA Oligomer
acauaugaaucacugagcc

SEQ ID NO: 10918 - RNA, 19 nt, Artificial Sequence
  RNA Oligomer
uccuucuugaguauugccu

SEQ ID NO: 10919 - RNA, 19 nt, Artificial Sequence
  RNA Oligomer
aauaucgaauaggaaucac

SEQ ID NO: 10920 - RNA, 19 nt, Artificial Sequence
  RNA Oligomer
cacauuggaaauagcugca

SEQ ID NO: 10921 - RNA, 19 nt, Artificial Sequence
  RNA Oligomer
aagaauucauaguaagagg

SEQ ID NO: 10922 - RNA, 19 nt, Artificial Sequence
  RNA Oligomer
ugauugauuuugagguugu

SEQ ID NO: 10923 - RNA, 19 nt, Artificial Sequence
  RNA Oligomer
aucuguuguaaacucauuc

SEQ ID NO: 10924 - RNA, 19 nt, Artificial Sequence
  RNA Oligomer
uucuaccuuaaguaaacug

SEQ ID NO: 10925 - RNA, 19 nt, Artificial Sequence
  RNA Oligomer
ugucuaccaauauuuuucc

SEQ ID NO: 10926 - RNA, 19 nt, Artificial Sequence
  RNA Oligomer
uuuuuuucuauaggucagc

SEQ ID NO: 10927 - RNA, 19 nt, Artificial Sequence
  RNA Oligomer
auggcauuuucuauuuucg

SEQ ID NO: 10928 - RNA, 19 nt, Artificial Sequence
  RNA Oligomer
uuaacuccaaagacuucuc

SEQ ID NO: 10929 - RNA, 19 nt, Artificial Sequence
  RNA Oligomer
augucguccaacuuuuugu

SEQ ID NO: 10930 - RNA, 19 nt, Artificial Sequence
  RNA Oligomer
cuuuagaaauggcuuggca

SEQ ID NO: 10931 - RNA, 19 nt, Artificial Sequence
  RNA Oligomer
aaauauccuggauuguuga

SEQ ID NO: 10932 - RNA, 19 nt, Artificial Sequence
  RNA Oligomer
auccuggauuguugauguu

SEQ ID NO: 10933 - RNA, 19 nt, Artificial Sequence
  RNA Oligomer
aguuauuuugauauguggg

SEQ ID NO: 10934 - RNA, 19 nt, Artificial Sequence
  RNA Oligomer
guuauuuugauauguggga

SEQ ID NO: 10935 - RNA, 19 nt, Artificial Sequence
  RNA Oligomer
aaccauccuaaauuucagc

SEQ ID NO: 10936 - RNA, 19 nt, Artificial Sequence
  RNA Oligomer
uaaugaugaaucuucacac

SEQ ID NO: 10937 - RNA, 19 nt, Artificial Sequence
  RNA Oligomer
auuuucgaucaucuaugca

SEQ ID NO: 10938 - RNA, 19 nt, Artificial Sequence
  RNA Oligomer
uuuucgaucaucuaugcau

SEQ ID NO: 10939 - RNA, 19 nt, Artificial Sequence
  RNA Oligomer
agaagcuacuuauuuacac

SEQ ID NO: 10940 - RNA, 19 nt, Artificial Sequence
  RNA Oligomer
caagaacuuuuaucaaccc

SEQ ID NO: 10941 - RNA, 19 nt, Artificial Sequence
  RNA Oligomer
auucagucuuuccuauacc

SEQ ID NO: 10942 - RNA, 19 nt, Artificial Sequence
  RNA Oligomer
uucuauuggauuuugcaag

SEQ ID NO: 10943 - RNA, 19 nt, Artificial Sequence
  RNA Oligomer
aauuucucaaagacaagca

SEQ ID NO: 10944 - RNA, 19 nt, Artificial Sequence
  RNA Oligomer
aaccauaguucagaaaucc

SEQ ID NO: 10945 - RNA, 19 nt, Artificial Sequence
  RNA Oligomer
uuucuaguguuuugaguuc

SEQ ID NO: 10946 - RNA, 19 nt, Artificial Sequence
  RNA Oligomer
uugaagggcugaggaaucu

SEQ ID NO: 10947 - RNA, 19 nt, Artificial Sequence
  RNA Oligomer
auaugaaucacugagccag

SEQ ID NO: 10948 - RNA, 19 nt, Artificial Sequence
  RNA Oligomer
aagauacgauuuggaaugg

SEQ ID NO: 10949 - RNA, 19 nt, Artificial Sequence
  RNA Oligomer
auuuggaauggaaauagcc

SEQ ID NO: 10950 - RNA, 19 nt, Artificial Sequence
  RNA Oligomer
uagaaaaacaagaagacac

SEQ ID NO: 10951 - RNA, 19 nt, Artificial Sequence
  RNA Oligomer
cauuggaaauagcugcagg

SEQ ID NO: 10952 - RNA, 19 nt, Artificial Sequence
  RNA Oligomer
agauuacgaacaauaucca

SEQ ID NO: 10953 - RNA, 19 nt, Artificial Sequence
  RNA Oligomer
ucuguuguaaacucauucu

SEQ ID NO: 10954 - RNA, 19 nt, Artificial Sequence
  RNA Oligomer
uaaacucauucuuucuacc

SEQ ID NO: 10955 - RNA, 19 nt, Artificial Sequence
  RNA Oligomer
auuaugccaaaaccaucag

SEQ ID NO: 10956 - RNA, 19 nt, Artificial Sequence
  RNA Oligomer
ccaguuauaaauaaacgca

SEQ ID NO: 10957 - RNA, 19 nt, Artificial Sequence
  RNA Oligomer
agaaaaauauccuggauug

SEQ ID NO: 10958 - RNA, 19 nt, Artificial Sequence
  RNA Oligomer
aaugaugaaucuucacacc

SEQ ID NO: 10959 - RNA, 19 nt, Artificial Sequence
  RNA Oligomer
uuuccguaauuuucgauca

SEQ ID NO: 10960 - RNA, 19 nt, Artificial Sequence
  RNA Oligomer
uguucaaauuuauaccugc

SEQ ID NO: 10961 - RNA, 19 nt, Artificial Sequence
  RNA Oligomer
uauaccugcagacuauuca

SEQ ID NO: 10962 - RNA, 19 nt, Artificial Sequence
  RNA Oligomer
uagacuaagacagauauag

SEQ ID NO: 10963 - RNA, 19 nt, Artificial Sequence
  RNA Oligomer
ugcaagugaaauccaaggg

SEQ ID NO: 10964 - RNA, 19 nt, Artificial Sequence
  RNA Oligomer
agaauuacaugccagcucu

SEQ ID NO: 10965 - RNA, 19 nt, Artificial Sequence
  RNA Oligomer
gauauaccuaauaaagccu

SEQ ID NO: 10966 - RNA, 19 nt, Artificial Sequence
  RNA Oligomer
auaguucagaaauccagcu

SEQ ID NO: 10967 - RNA, 19 nt, Artificial Sequence
  RNA Oligomer
uuccauucaaugcuuuuuc

SEQ ID NO: 10968 - RNA, 19 nt, Artificial Sequence
  RNA Oligomer
uguuuugaguuccuuuccc

SEQ ID NO: 10969 - RNA, 19 nt, Artificial Sequence
  RNA Oligomer
caucugagauuugaagggc

SEQ ID NO: 10970 - RNA, 19 nt, Artificial Sequence
  RNA Oligomer
uuccaaaaucaccaguucc

SEQ ID NO: 10971 - RNA, 19 nt, Artificial Sequence
  RNA Oligomer
gaggacaugaaggaaggca

SEQ ID NO: 10972 - RNA, 19 nt, Artificial Sequence
  RNA Oligomer
caguuccaaaaauacauac

SEQ ID NO: 10973 - RNA, 19 nt, Artificial Sequence
  RNA Oligomer
aagcaagcaguguaagugc

SEQ ID NO: 10974 - RNA, 19 nt, Artificial Sequence
  RNA Oligomer
uacagucucuugcuuuucu

SEQ ID NO: 10975 - RNA, 19 nt, Artificial Sequence
  RNA Oligomer
guguaagugcuguuauugg

SEQ ID NO: 10976 - RNA, 19 nt, Artificial Sequence
  RNA Oligomer
uguaagugcuguuauugga

SEQ ID NO: 10977 - RNA, 19 nt, Artificial Sequence
  RNA Oligomer
uguuauuggaaagauacga

SEQ ID NO: 10978 - RNA, 19 nt, Artificial Sequence
  RNA Oligomer
gauuuggaauggaaauagc

SEQ ID NO: 10979 - RNA, 19 nt, Artificial Sequence
  RNA Oligomer
aaaaacaagaagacacaca

SEQ ID NO: 10980 - RNA, 19 nt, Artificial Sequence
  RNA Oligomer
aacaagaagacacacagca

SEQ ID NO: 10981 - RNA, 19 nt, Artificial Sequence
  RNA Oligomer
cagcagacaaauagaaggg

SEQ ID NO: 10982 - RNA, 19 nt, Artificial Sequence
  RNA Oligomer
auuacgaacaauauccauc

SEQ ID NO: 10983 - RNA, 19 nt, Artificial Sequence
  RNA Oligomer
cucugcauuagauucugga

SEQ ID NO: 10984 - RNA, 19 nt, Artificial Sequence
  RNA Oligomer
gauucuggauauugauuga

SEQ ID NO: 10985 - RNA, 19 nt, Artificial Sequence
  RNA Oligomer
guuuggaucuguuaaaagg

SEQ ID NO: 10986 - RNA, 19 nt, Artificial Sequence
  RNA Oligomer
guuguaaacucauucuuuc

SEQ ID NO: 10987 - RNA, 19 nt, Artificial Sequence
  RNA Oligomer
guaaacucauucuuucuac

SEQ ID NO: 10988 - RNA, 19 nt, Artificial Sequence
  RNA Oligomer
aaagacuucucuagaccag

SEQ ID NO: 10989 - RNA, 19 nt, Artificial Sequence
  RNA Oligomer
uaaaagagcaguauccagc

SEQ ID NO: 10990 - RNA, 19 nt, Artificial Sequence
  RNA Oligomer
uuuuccuuaucuuuuccac

SEQ ID NO: 10991 - RNA, 19 nt, Artificial Sequence
  RNA Oligomer
aaagacaaucuacaauggu

SEQ ID NO: 10992 - RNA, 19 nt, Artificial Sequence
  RNA Oligomer
gugcaaagauauuaucuga

SEQ ID NO: 10993 - RNA, 19 nt, Artificial Sequence
  RNA Oligomer
ccuuuagaaaaacaaagcc

SEQ ID NO: 10994 - RNA, 19 nt, Artificial Sequence
  RNA Oligomer
uagaaaaacaaagccuuug

SEQ ID NO: 10995 - RNA, 19 nt, Artificial Sequence
  RNA Oligomer
uggauugcuaugauuauga

SEQ ID NO: 10996 - RNA, 19 nt, Artificial Sequence
  RNA Oligomer
uauuuugauaugugggaag

SEQ ID NO: 10997 - RNA, 19 nt, Artificial Sequence
  RNA Oligomer
aaggguacuaucagcacag

SEQ ID NO: 10998 - RNA, 19 nt, Artificial Sequence
  RNA Oligomer
uuuuccguaauuuucgauc

SEQ ID NO: 10999 - RNA, 19 nt, Artificial Sequence
  RNA Oligomer
ucgaucaucuaugcauugu

SEQ ID NO: 11000 - RNA, 19 nt, Artificial Sequence
  RNA Oligomer
gaucaucuaugcauuguuc

SEQ ID NO: 11001 - RNA, 19 nt, Artificial Sequence
  RNA Oligomer
aucaucuaugcauuguuca

SEQ ID NO: 11002 - RNA, 19 nt, Artificial Sequence
  RNA Oligomer
uucaaauuuauaccugcag

SEQ ID NO: 11003 - RNA, 19 nt, Artificial Sequence
  RNA Oligomer
agcuacuuauuuacacuag

SEQ ID NO: 11004 - RNA, 19 nt, Artificial Sequence
  RNA Oligomer
cuuaaccuaauauagugca

SEQ ID NO: 11005 - RNA, 19 nt, Artificial Sequence
  RNA Oligomer
ucaagaacuuuuaucaacc

SEQ ID NO: 11006 - RNA, 19 nt, Artificial Sequence
  RNA Oligomer
augcaagugaaauccaagg

SEQ ID NO: 11007 - RNA, 19 nt, Artificial Sequence
  RNA Oligomer
agaggaagaauuacaugcc

SEQ ID NO: 11008 - RNA, 19 nt, Artificial Sequence
  RNA Oligomer
cugaauagcucaagacuuc

SEQ ID NO: 11009 - RNA, 19 nt, Artificial Sequence
  RNA Oligomer
caacaaaaaccucauuccc

SEQ ID NO: 11010 - RNA, 19 nt, Artificial Sequence
  RNA Oligomer
aagacuucugcaccacugg

SEQ ID NO: 11011 - RNA, 19 nt, Artificial Sequence
  RNA Oligomer
auuuugcaagacauuaggu

SEQ ID NO: 11012 - RNA, 19 nt, Artificial Sequence
  RNA Oligomer
auguuucccucagucacgg

SEQ ID NO: 11013 - RNA, 19 nt, Artificial Sequence
  RNA Oligomer
agugcaaggaaugauaagc

SEQ ID NO: 11014 - RNA, 19 nt, Artificial Sequence
  RNA Oligomer
aaugauaagcccuaacacg

SEQ ID NO: 11015 - RNA, 19 nt, Artificial Sequence
  RNA Oligomer
ucaaucccagugaucuucc

SEQ ID NO: 11016 - RNA, 19 nt, Artificial Sequence
  RNA Oligomer
ucuugaguauugccugggu

SEQ ID NO: 11017 - RNA, 19 nt, Artificial Sequence
  RNA Oligomer
aguuucccaaucuccaucg

SEQ ID NO: 11018 - RNA, 19 nt, Artificial Sequence
  RNA Oligomer
auacagucucuugcuuuuc

SEQ ID NO: 11019 - RNA, 19 nt, Artificial Sequence
  RNA Oligomer
aaacaagaagacacacagc

SEQ ID NO: 11020 - RNA, 19 nt, Artificial Sequence
  RNA Oligomer
auauccaucacucuuugcu

SEQ ID NO: 11021 - RNA, 19 nt, Artificial Sequence
  RNA Oligomer
aaaugcuuuuaccacgugg

SEQ ID NO: 11022 - RNA, 19 nt, Artificial Sequence
  RNA Oligomer
uauaaaagccaucaucccu

SEQ ID NO: 11023 - RNA, 19 nt, Artificial Sequence
  RNA Oligomer
auaaaagccaucaucccuu

SEQ ID NO: 11024 - RNA, 19 nt, Artificial Sequence
  RNA Oligomer
uaaguaaacuggaggaguc

SEQ ID NO: 11025 - RNA, 19 nt, Artificial Sequence
  RNA Oligomer
gucagcauuuuaccuaugg

SEQ ID NO: 11026 - RNA, 19 nt, Artificial Sequence
  RNA Oligomer
guuaacuccaaagacuucu

SEQ ID NO: 11027 - RNA, 19 nt, Artificial Sequence
  RNA Oligomer
auaacauaggugaguagug

SEQ ID NO: 11028 - RNA, 19 nt, Artificial Sequence
  RNA Oligomer
aacauaggugaguagugac

SEQ ID NO: 11029 - RNA, 19 nt, Artificial Sequence
  RNA Oligomer
uaggugaguagugacauuu

SEQ ID NO: 11030 - RNA, 19 nt, Artificial Sequence
  RNA Oligomer
ugaguagugacauuuuccu

SEQ ID NO: 11031 - RNA, 19 nt, Artificial Sequence
  RNA Oligomer
uuuccacugauacuguagg

SEQ ID NO: 11032 - RNA, 19 nt, Artificial Sequence
  RNA Oligomer
acucuacucaaugucgucc

SEQ ID NO: 11033 - RNA, 19 nt, Artificial Sequence
  RNA Oligomer
aaugucguccaacuuuuug

SEQ ID NO: 11034 - RNA, 19 nt, Artificial Sequence
  RNA Oligomer
guguucuguguaccuuugc

SEQ ID NO: 11035 - RNA, 19 nt, Artificial Sequence
  RNA Oligomer
acaaucuacaauggugcga

SEQ ID NO: 11036 - RNA, 19 nt, Artificial Sequence
  RNA Oligomer
uaaggucacuuuagaaaug

SEQ ID NO: 11037 - RNA, 19 nt, Artificial Sequence
  RNA Oligomer
auauauuacguaaggccag

SEQ ID NO: 11038 - RNA, 19 nt, Artificial Sequence
  RNA Oligomer
uauauuacguaaggccaga

SEQ ID NO: 11039 - RNA, 19 nt, Artificial Sequence
  RNA Oligomer
cuuuagaaaaacaaagccu

SEQ ID NO: 11040 - RNA, 19 nt, Artificial Sequence
  RNA Oligomer
agaaaaacaaagccuuuga

SEQ ID NO: 11041 - RNA, 19 nt, Artificial Sequence
  RNA Oligomer
cagaaaaacagugagaacc

SEQ ID NO: 11042 - RNA, 19 nt, Artificial Sequence
  RNA Oligomer
cacauaaugaugaaucuuc

SEQ ID NO: 11043 - RNA, 19 nt, Artificial Sequence
  RNA Oligomer
ugauuuuccguaauuuucg

SEQ ID NO: 11044 - RNA, 19 nt, Artificial Sequence
  RNA Oligomer
cuaagacagauauagaagc

SEQ ID NO: 11045 - RNA, 19 nt, Artificial Sequence
  RNA Oligomer
gaacuuuuaucaacccuuc

SEQ ID NO: 11046 - RNA, 19 nt, Artificial Sequence
  RNA Oligomer
gaauagcucaagacuucug

SEQ ID NO: 11047 - RNA, 19 nt, Artificial Sequence
  RNA Oligomer
aacaaaaaccucauucccu

SEQ ID NO: 11048 - RNA, 19 nt, Artificial Sequence
  RNA Oligomer
uuucacuuaacucagcccu

SEQ ID NO: 11049 - RNA, 19 nt, Artificial Sequence
  RNA Oligomer
uauuggauuuugcaagaca

SEQ ID NO: 11050 - RNA, 19 nt, Artificial Sequence
  RNA Oligomer
ggauuuugcaagacauuag

SEQ ID NO: 11051 - RNA, 19 nt, Artificial Sequence
  RNA Oligomer
aaaauaagagucagggacc

SEQ ID NO: 11052 - RNA, 19 nt, Artificial Sequence
  RNA Oligomer
uugaguuccuuucccagcc

SEQ ID NO: 11053 - RNA, 19 nt, Artificial Sequence
  RNA Oligomer
aggacaaacuugaucacca

SEQ ID NO: 11054 - RNA, 19 nt, Artificial Sequence
  RNA Oligomer
augauaagcccuaacacgu

SEQ ID NO: 11055 - RNA, 19 nt, Artificial Sequence
  RNA Oligomer
gauaagcccuaacacguag

SEQ ID NO: 11056 - RNA, 19 nt, Artificial Sequence
  RNA Oligomer
aucugagauuugaagggcu

SEQ ID NO: 11057 - RNA, 19 nt, Artificial Sequence
  RNA Oligomer
uccaaaaucaccaguucca

SEQ ID NO: 11058 - RNA, 19 nt, Artificial Sequence
  RNA Oligomer
guuaaguuucccaaucucc

SEQ ID NO: 11059 - RNA, 19 nt, Artificial Sequence
  RNA Oligomer
auaucgaauaggaaucaca

SEQ ID NO: 11060 - RNA, 19 nt, Artificial Sequence
  RNA Oligomer
gaauaggaaucacaagugu

SEQ ID NO: 11061 - RNA, 19 nt, Artificial Sequence
  RNA Oligomer
caaaaauacauacagucuc

SEQ ID NO: 11062 - RNA, 19 nt, Artificial Sequence
  RNA Oligomer
aauggcagcaauaacacca

SEQ ID NO: 11063 - RNA, 19 nt, Artificial Sequence
  RNA Oligomer
aaagcaagcaguguaagug

SEQ ID NO: 11064 - RNA, 19 nt, Artificial Sequence
  RNA Oligomer
cgauuuggaauggaaauag

SEQ ID NO: 11065 - RNA, 19 nt, Artificial Sequence
  RNA Oligomer
aauagccauacgaaaugua

SEQ ID NO: 11066 - RNA, 19 nt, Artificial Sequence
  RNA Oligomer
auaaggguagauuacgucu

SEQ ID NO: 11067 - RNA, 19 nt, Artificial Sequence
  RNA Oligomer
aaguccaagauuacgaaca

SEQ ID NO: 11068 - RNA, 19 nt, Artificial Sequence
  RNA Oligomer
uacgaacaauauccaucac

SEQ ID NO: 11069 - RNA, 19 nt, Artificial Sequence
  RNA Oligomer
uaaaagccaucaucccuua

SEQ ID NO: 11070 - RNA, 19 nt, Artificial Sequence
  RNA Oligomer
auacaggaaacauaucagc

SEQ ID NO: 11071 - RNA, 19 nt, Artificial Sequence
  RNA Oligomer
uaaaaggaauacaguucgc

SEQ ID NO: 11072 - RNA, 19 nt, Artificial Sequence
  RNA Oligomer
auuuugagguuguugcuga

SEQ ID NO: 11073 - RNA, 19 nt, Artificial Sequence
  RNA Oligomer
aaacucauucuuucuaccu

SEQ ID NO: 11074 - RNA, 19 nt, Artificial Sequence
  RNA Oligomer
aaggagaacuugggcuuuc

SEQ ID NO: 11075 - RNA, 19 nt, Artificial Sequence
  RNA Oligomer
gaacuugggcuuucuuugg

SEQ ID NO: 11076 - RNA, 19 nt, Artificial Sequence
  RNA Oligomer
uaugccaaaaccaucagag

SEQ ID NO: 11077 - RNA, 19 nt, Artificial Sequence
  RNA Oligomer
aaaaccaucagagugcucu

SEQ ID NO: 11078 - RNA, 19 nt, Artificial Sequence
  RNA Oligomer
uuuuuucuauaggucagca

SEQ ID NO: 11079 - RNA, 19 nt, Artificial Sequence
  RNA Oligomer
cuauaggucagcauuuuac

SEQ ID NO: 11080 - RNA, 19 nt, Artificial Sequence
  RNA Oligomer
uauaggucagcauuuuacc

SEQ ID NO: 11081 - RNA, 19 nt, Artificial Sequence
  RNA Oligomer
uuaacaaaaagagcauggu

SEQ ID NO: 11082 - RNA, 19 nt, Artificial Sequence
  RNA Oligomer
gcacaccuaacuguuuugc

SEQ ID NO: 11083 - RNA, 19 nt, Artificial Sequence
  RNA Oligomer
uugcauaacauaggugagu

SEQ ID NO: 11084 - RNA, 19 nt, Artificial Sequence
  RNA Oligomer
acauaggugaguagugaca

SEQ ID NO: 11085 - RNA, 19 nt, Artificial Sequence
  RNA Oligomer
gugaguagugacauuuucc

SEQ ID NO: 11086 - RNA, 19 nt, Artificial Sequence
  RNA Oligomer
uuccuuaucuuuuccacug

SEQ ID NO: 11087 - RNA, 19 nt, Artificial Sequence
  RNA Oligomer
aucuuuuccacugauacug

SEQ ID NO: 11088 - RNA, 19 nt, Artificial Sequence
  RNA Oligomer
uauaccaugacucuacuca

SEQ ID NO: 11089 - RNA, 19 nt, Artificial Sequence
  RNA Oligomer
uguguucuguguaccuuug

SEQ ID NO: 11090 - RNA, 19 nt, Artificial Sequence
  RNA Oligomer
gacaaucuacaauggugcg

SEQ ID NO: 11091 - RNA, 19 nt, Artificial Sequence
  RNA Oligomer
gaaagcaacacccucaucc

SEQ ID NO: 11092 - RNA, 19 nt, Artificial Sequence
  RNA Oligomer
aacacccucauccaauggu

SEQ ID NO: 11093 - RNA, 19 nt, Artificial Sequence
  RNA Oligomer
agugcaaagauauuaucug

SEQ ID NO: 11094 - RNA, 19 nt, Artificial Sequence
  RNA Oligomer
aaugccuauuugaugugau

SEQ ID NO: 11095 - RNA, 19 nt, Artificial Sequence
  RNA Oligomer
auuuugauaugugggaaga

SEQ ID NO: 11096 - RNA, 19 nt, Artificial Sequence
  RNA Oligomer
augauuaugaugccagacu

SEQ ID NO: 11097 - RNA, 19 nt, Artificial Sequence
  RNA Oligomer
uaugaugccagacuucuug

SEQ ID NO: 11098 - RNA, 19 nt, Artificial Sequence
  RNA Oligomer
auccuaaauuucagcaagg

SEQ ID NO: 11099 - RNA, 19 nt, Artificial Sequence
  RNA Oligomer
aagacagauauagaagcua

SEQ ID NO: 11100 - RNA, 19 nt, Artificial Sequence
  RNA Oligomer
cuuggcugcuucugaauag

SEQ ID NO: 11101 - RNA, 19 nt, Artificial Sequence
  RNA Oligomer
aacuuuuaucaacccuucu

SEQ ID NO: 11102 - RNA, 19 nt, Artificial Sequence
  RNA Oligomer
uuuuaucaacccuucuuug

SEQ ID NO: 11103 - RNA, 19 nt, Artificial Sequence
  RNA Oligomer
aacccuucuuugcuuauug

SEQ ID NO: 11104 - RNA, 19 nt, Artificial Sequence
  RNA Oligomer
acccuucuuugcuuauugc

SEQ ID NO: 11105 - RNA, 19 nt, Artificial Sequence
  RNA Oligomer
ucccuccauuuuuauucag

SEQ ID NO: 11106 - RNA, 19 nt, Artificial Sequence
  RNA Oligomer
uucagucuuuccuauaccu

SEQ ID NO: 11107 - RNA, 19 nt, Artificial Sequence
  RNA Oligomer
uuccucucaguaaauaucu

SEQ ID NO: 11108 - RNA, 19 nt, Artificial Sequence
  RNA Oligomer
cuauuggauuuugcaagac

SEQ ID NO: 11109 - RNA, 19 nt, Artificial Sequence
  RNA Oligomer
gggaaaauaagagucaggg

SEQ ID NO: 11110 - RNA, 19 nt, Artificial Sequence
  RNA Oligomer
gaaaauaagagucagggac

SEQ ID NO: 11111 - RNA, 19 nt, Artificial Sequence
  RNA Oligomer
cugagauaaaaugguguuc

SEQ ID NO: 11112 - RNA, 19 nt, Artificial Sequence
  RNA Oligomer
ugagauaaaaugguguucu

SEQ ID NO: 11113 - RNA, 19 nt, Artificial Sequence
  RNA Oligomer
guguuuugaguuccuuucc

SEQ ID NO: 11114 - RNA, 19 nt, Artificial Sequence
  RNA Oligomer
acacauggcaugauuagga

SEQ ID NO: 11115 - RNA, 19 nt, Artificial Sequence
  RNA Oligomer
caaucccagugaucuucca

SEQ ID NO: 11116 - RNA, 19 nt, Artificial Sequence
  RNA Oligomer
aucuuccaaaaucaccagu

SEQ ID NO: 11117 - RNA, 19 nt, Artificial Sequence
  RNA Oligomer
gaggugcuaaauggauucu

SEQ ID NO: 11118 - RNA, 19 nt, Artificial Sequence
  RNA Oligomer
guuccaaaaauacauacag

SEQ ID NO: 11119 - RNA, 19 nt, Artificial Sequence
  RNA Oligomer
auacauacagucucuugcu

SEQ ID NO: 11120 - RNA, 19 nt, Artificial Sequence
  RNA Oligomer
aagugcuguuauuggaaag

SEQ ID NO: 11121 - RNA, 19 nt, Artificial Sequence
  RNA Oligomer
aacauaaggguagauuacg

SEQ ID NO: 11122 - RNA, 19 nt, Artificial Sequence
  RNA Oligomer
acauaaggguagauuacgu

SEQ ID NO: 11123 - RNA, 19 nt, Artificial Sequence
  RNA Oligomer
auuggaaauagcugcaggg

SEQ ID NO: 11124 - RNA, 19 nt, Artificial Sequence
  RNA Oligomer
gaagaauucauaguaagag

SEQ ID NO: 11125 - RNA, 19 nt, Artificial Sequence
  RNA Oligomer
uuaaaugcuuuuaccacgu

SEQ ID NO: 11126 - RNA, 19 nt, Artificial Sequence
  RNA Oligomer
aauacaggaaacauaucag

SEQ ID NO: 11127 - RNA, 19 nt, Artificial Sequence
  RNA Oligomer
aagcacuuauuuucaucug

SEQ ID NO: 11128 - RNA, 19 nt, Artificial Sequence
  RNA Oligomer
aacucauucuuucuaccuu

SEQ ID NO: 11129 - RNA, 19 nt, Artificial Sequence
  RNA Oligomer
aaguaaacuggaggaguca

SEQ ID NO: 11130 - RNA, 19 nt, Artificial Sequence
  RNA Oligomer
aaggacagaaggagaacuu

SEQ ID NO: 11131 - RNA, 19 nt, Artificial Sequence
  RNA Oligomer
cauuuucuauuuucgguga

SEQ ID NO: 11132 - RNA, 19 nt, Artificial Sequence
  RNA Oligomer
aaacacauuacucucuucu

SEQ ID NO: 11133 - RNA, 19 nt, Artificial Sequence
  RNA Oligomer
acuccaaagacuucucuag

SEQ ID NO: 11134 - RNA, 19 nt, Artificial Sequence
  RNA Oligomer
aacuuuaaucaaccaaugc

SEQ ID NO: 11135 - RNA, 19 nt, Artificial Sequence
  RNA Oligomer
uuugcauaacauaggugag

SEQ ID NO: 11136 - RNA, 19 nt, Artificial Sequence
  RNA Oligomer
aaaaucauaaugcucucug

SEQ ID NO: 11137 - RNA, 19 nt, Artificial Sequence
  RNA Oligomer
uguucuguguaccuuugca

SEQ ID NO: 11138 - RNA, 19 nt, Artificial Sequence
  RNA Oligomer
auugauaaggucacuuuag

SEQ ID NO: 11139 - RNA, 19 nt, Artificial Sequence
  RNA Oligomer
uugauaaggucacuuuaga

SEQ ID NO: 11140 - RNA, 19 nt, Artificial Sequence
  RNA Oligomer
aaauauauuacguaaggcc

SEQ ID NO: 11141 - RNA, 19 nt, Artificial Sequence
  RNA Oligomer
caaacucagugccuuuuag

SEQ ID NO: 11142 - RNA, 19 nt, Artificial Sequence
  RNA Oligomer
ugcuaugauuaugaugcca

SEQ ID NO: 11143 - RNA, 19 nt, Artificial Sequence
  RNA Oligomer
aaaggguacuaucagcaca

SEQ ID NO: 11144 - RNA, 19 nt, Artificial Sequence
  RNA Oligomer
acuaucagcacagaaaaac

SEQ ID NO: 11145 - RNA, 19 nt, Artificial Sequence
  RNA Oligomer
gaaccauccuaaauuucag

SEQ ID NO: 11146 - RNA, 19 nt, Artificial Sequence
  RNA Oligomer
accauccuaaauuucagca

SEQ ID NO: 11147 - RNA, 19 nt, Artificial Sequence
  RNA Oligomer
gauuuuccguaauuuucga

SEQ ID NO: 11148 - RNA, 19 nt, Artificial Sequence
  RNA Oligomer
uucgaucaucuaugcauug

SEQ ID NO: 11149 - RNA, 19 nt, Artificial Sequence
  RNA Oligomer
auuuauaccugcagacuau

SEQ ID NO: 11150 - RNA, 19 nt, Artificial Sequence
  RNA Oligomer
agcuugcugucuaaaauuc

SEQ ID NO: 11151 - RNA, 19 nt, Artificial Sequence
  RNA Oligomer
cuuuuaucaacccuucuuu

SEQ ID NO: 11152 - RNA, 19 nt, Artificial Sequence
  RNA Oligomer
gucauuucacuagaauuca

SEQ ID NO: 11153 - RNA, 19 nt, Artificial Sequence
  RNA Oligomer
cuuucacuuaacucagccc

SEQ ID NO: 11154 - RNA, 19 nt, Artificial Sequence
  RNA Oligomer
ucuauuggauuuugcaaga

SEQ ID NO: 11155 - RNA, 19 nt, Artificial Sequence
  RNA Oligomer
caaggcuagucucaaucuc

SEQ ID NO: 11156 - RNA, 19 nt, Artificial Sequence
  RNA Oligomer
aaggcuagucucaaucuca

SEQ ID NO: 11157 - RNA, 19 nt, Artificial Sequence
  RNA Oligomer
ucugggaaaauaagaguca

SEQ ID NO: 11158 - RNA, 19 nt, Artificial Sequence
  RNA Oligomer
ugggaaaauaagagucagg

SEQ ID NO: 11159 - RNA, 19 nt, Artificial Sequence
  RNA Oligomer
cuaaccugagauaaaaugg

SEQ ID NO: 11160 - RNA, 19 nt, Artificial Sequence
  RNA Oligomer
caauuucucaaagacaagc

SEQ ID NO: 11161 - RNA, 19 nt, Artificial Sequence
  RNA Oligomer
auuucucaaagacaagcaa

SEQ ID NO: 11162 - RNA, 19 nt, Artificial Sequence
  RNA Oligomer
uacacauggcaugauuagg

SEQ ID NO: 11163 - RNA, 19 nt, Artificial Sequence
  RNA Oligomer
cacauggcaugauuaggac

SEQ ID NO: 11164 - RNA, 19 nt, Artificial Sequence
  RNA Oligomer
gagauuugaagggcugagg

SEQ ID NO: 11165 - RNA, 19 nt, Artificial Sequence
  RNA Oligomer
gaucuuccaaaaucaccag

SEQ ID NO: 11166 - RNA, 19 nt, Artificial Sequence
  RNA Oligomer
auucccaagaguacaaaca

SEQ ID NO: 11167 - RNA, 19 nt, Artificial Sequence
  RNA Oligomer
cuuccaaaaucaccaguuc

SEQ ID NO: 11168 - RNA, 19 nt, Artificial Sequence
  RNA Oligomer
agccacauaugaaucacug

SEQ ID NO: 11169 - RNA, 19 nt, Artificial Sequence
  RNA Oligomer
aggugcuaaauggauucuc

SEQ ID NO: 11170 - RNA, 19 nt, Artificial Sequence
  RNA Oligomer
ggugcuaaauggauucucc

SEQ ID NO: 11171 - RNA, 19 nt, Artificial Sequence
  RNA Oligomer
uccaaaaauacauacaguc

SEQ ID NO: 11172 - RNA, 19 nt, Artificial Sequence
  RNA Oligomer
agcaauaacaccagggagg

SEQ ID NO: 11173 - RNA, 19 nt, Artificial Sequence
  RNA Oligomer
acagucucuugcuuuucug

SEQ ID NO: 11174 - RNA, 19 nt, Artificial Sequence
  RNA Oligomer
gaaauagccauacgaaaug

SEQ ID NO: 11175 - RNA, 19 nt, Artificial Sequence
  RNA Oligomer
auuacgucucuuauaacac

SEQ ID NO: 11176 - RNA, 19 nt, Artificial Sequence
  RNA Oligomer
gucucuuauaacacaauag

SEQ ID NO: 11177 - RNA, 19 nt, Artificial Sequence
  RNA Oligomer
agaaaaacaagaagacaca

SEQ ID NO: 11178 - RNA, 19 nt, Artificial Sequence
  RNA Oligomer
agaauucauaguaagagga

SEQ ID NO: 11179 - RNA, 19 nt, Artificial Sequence
  RNA Oligomer
uucauaguaagaggaagug

SEQ ID NO: 11180 - RNA, 19 nt, Artificial Sequence
  RNA Oligomer
guuaaaugcuuuuaccacg

SEQ ID NO: 11181 - RNA, 19 nt, Artificial Sequence
  RNA Oligomer
aaagccaucaucccuuaac

SEQ ID NO: 11182 - RNA, 19 nt, Artificial Sequence
  RNA Oligomer
cagcaguaaagaaguuuag

SEQ ID NO: 11183 - RNA, 19 nt, Artificial Sequence
  RNA Oligomer
aaaaggaauacaguucgcc

SEQ ID NO: 11184 - RNA, 19 nt, Artificial Sequence
  RNA Oligomer
uuaugccaaaaccaucaga

SEQ ID NO: 11185 - RNA, 19 nt, Artificial Sequence
  RNA Oligomer
gaauugcuuuuaacuacuc

SEQ ID NO: 11186 - RNA, 19 nt, Artificial Sequence
  RNA Oligomer
aggauaaacacauuacucu

SEQ ID NO: 11187 - RNA, 19 nt, Artificial Sequence
  RNA Oligomer
uaaacacauuacucucuuc

SEQ ID NO: 11188 - RNA, 19 nt, Artificial Sequence
  RNA Oligomer
aaaagagcaugguuaacuc

SEQ ID NO: 11189 - RNA, 19 nt, Artificial Sequence
  RNA Oligomer
agacuucucuagaccagcc

SEQ ID NO: 11190 - RNA, 19 nt, Artificial Sequence
  RNA Oligomer
uaaucaaccaaugcucaag

SEQ ID NO: 11191 - RNA, 19 nt, Artificial Sequence
  RNA Oligomer
aaucaaccaaugcucaagu

SEQ ID NO: 11192 - RNA, 19 nt, Artificial Sequence
  RNA Oligomer
agcacaccuaacuguuuug

SEQ ID NO: 11193 - RNA, 19 nt, Artificial Sequence
  RNA Oligomer
agugacauuuuccuuaucu

SEQ ID NO: 11194 - RNA, 19 nt, Artificial Sequence
  RNA Oligomer
uccuuaucuuuuccacuga

SEQ ID NO: 11195 - RNA, 19 nt, Artificial Sequence
  RNA Oligomer
uuuuccacugauacuguag

SEQ ID NO: 11196 - RNA, 19 nt, Artificial Sequence
  RNA Oligomer
caacacccucauccaaugg

SEQ ID NO: 11197 - RNA, 19 nt, Artificial Sequence
  RNA Oligomer
auauuacguaaggccagau

SEQ ID NO: 11198 - RNA, 19 nt, Artificial Sequence
  RNA Oligomer
gccuuuagaaaaacaaagc

SEQ ID NO: 11199 - RNA, 19 nt, Artificial Sequence
  RNA Oligomer
uaugauuaugaugccagac

SEQ ID NO: 11200 - RNA, 19 nt, Artificial Sequence
  RNA Oligomer
aaacagugagaaccauccu

SEQ ID NO: 11201 - RNA, 19 nt, Artificial Sequence
  RNA Oligomer
agaaccauccuaaauuuca

SEQ ID NO: 11202 - RNA, 19 nt, Artificial Sequence
  RNA Oligomer
aaauuucagcaaggauuug

SEQ ID NO: 11203 - RNA, 19 nt, Artificial Sequence
  RNA Oligomer
uuauaccugcagacuauuc

SEQ ID NO: 11204 - RNA, 19 nt, Artificial Sequence
  RNA Oligomer
cuugcugucuaaaauucug

SEQ ID NO: 11205 - RNA, 19 nt, Artificial Sequence
  RNA Oligomer
uuaucaacccuucuuugcu

SEQ ID NO: 11206 - RNA, 19 nt, Artificial Sequence
  RNA Oligomer
gaggaagaauuacaugcca

SEQ ID NO: 11207 - RNA, 19 nt, Artificial Sequence
  RNA Oligomer
aggaagaauuacaugccag

SEQ ID NO: 11208 - RNA, 19 nt, Artificial Sequence
  RNA Oligomer
ugccagcucuauagauacg

SEQ ID NO: 11209 - RNA, 19 nt, Artificial Sequence
  RNA Oligomer
auacguauguauccaagac

SEQ ID NO: 11210 - RNA, 19 nt, Artificial Sequence
  RNA Oligomer
uaaaaauaguuccucucag

SEQ ID NO: 11211 - RNA, 19 nt, Artificial Sequence
  RNA Oligomer
augugacccacuuccucag

SEQ ID NO: 11212 - RNA, 19 nt, Artificial Sequence
  RNA Oligomer
cagauauaccuaauaaagc

SEQ ID NO: 11213 - RNA, 19 nt, Artificial Sequence
  RNA Oligomer
aaacucuuuagugugaaac

SEQ ID NO: 11214 - RNA, 19 nt, Artificial Sequence
  RNA Oligomer
guguucucuuccaguaugu

SEQ ID NO: 11215 - RNA, 19 nt, Artificial Sequence
  RNA Oligomer
aguaugucagucaauuucu

SEQ ID NO: 11216 - RNA, 19 nt, Artificial Sequence
  RNA Oligomer
guaugucagucaauuucuc

SEQ ID NO: 11217 - RNA, 19 nt, Artificial Sequence
  RNA Oligomer
augucagucaauuucucaa

SEQ ID NO: 11218 - RNA, 19 nt, Artificial Sequence
  RNA Oligomer
uucucaaagacaagcaaug

SEQ ID NO: 11219 - RNA, 19 nt, Artificial Sequence
  RNA Oligomer
uucaaaaccauaguucaga

SEQ ID NO: 11220 - RNA, 19 nt, Artificial Sequence
  RNA Oligomer
cauaguucagaaauccagc

SEQ ID NO: 11221 - RNA, 19 nt, Artificial Sequence
  RNA Oligomer
guuuugaguuccuuuccca

SEQ ID NO: 11222 - RNA, 19 nt, Artificial Sequence
  RNA Oligomer
agcauuuucaaucccagug

SEQ ID NO: 11223 - RNA, 19 nt, Artificial Sequence
  RNA Oligomer
uaacacguaggcugcagga

SEQ ID NO: 11224 - RNA, 19 nt, Artificial Sequence
  RNA Oligomer
aagauaccaucugagauuu

SEQ ID NO: 11225 - RNA, 19 nt, Artificial Sequence
  RNA Oligomer
uucccaagaguacaaacag

SEQ ID NO: 11226 - RNA, 19 nt, Artificial Sequence
  RNA Oligomer
uuaaguuucccaaucucca

SEQ ID NO: 11227 - RNA, 19 nt, Artificial Sequence
  RNA Oligomer
aaagcauccaguggucaag

SEQ ID NO: 11228 - RNA, 19 nt, Artificial Sequence
  RNA Oligomer
uacauacagucucuugcuu

SEQ ID NO: 11229 - RNA, 19 nt, Artificial Sequence
  RNA Oligomer
uggaaagauacgauuugga

SEQ ID NO: 11230 - RNA, 19 nt, Artificial Sequence
  RNA Oligomer
uuacgucucuuauaacaca

SEQ ID NO: 11231 - RNA, 19 nt, Artificial Sequence
  RNA Oligomer
uacgucucuuauaacacaa

SEQ ID NO: 11232 - RNA, 19 nt, Artificial Sequence
  RNA Oligomer
acagcagacaaauagaagg

SEQ ID NO: 11233 - RNA, 19 nt, Artificial Sequence
  RNA Oligomer
ucaauuucuuuggcugcca

SEQ ID NO: 11234 - RNA, 19 nt, Artificial Sequence
  RNA Oligomer
auccaucacucuuugcuug

SEQ ID NO: 11235 - RNA, 19 nt, Artificial Sequence
  RNA Oligomer
uuugcugucauuuccacac

SEQ ID NO: 11236 - RNA, 19 nt, Artificial Sequence
  RNA Oligomer
ugguguuaaaugcuuuuac

SEQ ID NO: 11237 - RNA, 19 nt, Artificial Sequence
  RNA Oligomer
uaaaugcuuuuaccacgug

SEQ ID NO: 11238 - RNA, 19 nt, Artificial Sequence
  RNA Oligomer
aucagcaguaaagaaguuu

SEQ ID NO: 11239 - RNA, 19 nt, Artificial Sequence
  RNA Oligomer
uuaaaaggaauacaguucg

SEQ ID NO: 11240 - RNA, 19 nt, Artificial Sequence
  RNA Oligomer
aauacaguucgcccaaagc

SEQ ID NO: 11241 - RNA, 19 nt, Artificial Sequence
  RNA Oligomer
uugagguuguugcugaugu

SEQ ID NO: 11242 - RNA, 19 nt, Artificial Sequence
  RNA Oligomer
gccaaaaccaucagagugc

SEQ ID NO: 11243 - RNA, 19 nt, Artificial Sequence
  RNA Oligomer
gucuaccaauauuuuucca

SEQ ID NO: 11244 - RNA, 19 nt, Artificial Sequence
  RNA Oligomer
uuuuucuauaggucagcau

SEQ ID NO: 11245 - RNA, 19 nt, Artificial Sequence
  RNA Oligomer
uggcauuuucuauuuucgg

SEQ ID NO: 11246 - RNA, 19 nt, Artificial Sequence
  RNA Oligomer
gauaaacacauuacucucu

SEQ ID NO: 11247 - RNA, 19 nt, Artificial Sequence
  RNA Oligomer
aagacuucucuagaccagc

SEQ ID NO: 11248 - RNA, 19 nt, Artificial Sequence
  RNA Oligomer
aucaaccaaugcucaagua

SEQ ID NO: 11249 - RNA, 19 nt, Artificial Sequence
  RNA Oligomer
uagugacauuuuccuuauc

SEQ ID NO: 11250 - RNA, 19 nt, Artificial Sequence
  RNA Oligomer
cguccaacuuuuuguaucc

SEQ ID NO: 11251 - RNA, 19 nt, Artificial Sequence
  RNA Oligomer
caacuuuuuguauccuugc

SEQ ID NO: 11252 - RNA, 19 nt, Artificial Sequence
  RNA Oligomer
aaagauaaguugaaggagc

SEQ ID NO: 11253 - RNA, 19 nt, Artificial Sequence
  RNA Oligomer
aaaaugccuauuugaugug

SEQ ID NO: 11254 - RNA, 19 nt, Artificial Sequence
  RNA Oligomer
aaaugccuauuugauguga

SEQ ID NO: 11255 - RNA, 19 nt, Artificial Sequence
  RNA Oligomer
uuugauaugugggaagauc

SEQ ID NO: 11256 - RNA, 19 nt, Artificial Sequence
  RNA Oligomer
auuaugaugccagacuucu

SEQ ID NO: 11257 - RNA, 19 nt, Artificial Sequence
  RNA Oligomer
ugagaaagauccaaauuuc

SEQ ID NO: 11258 - RNA, 19 nt, Artificial Sequence
  RNA Oligomer
cucugcccuaugauuuucc

SEQ ID NO: 11259 - RNA, 19 nt, Artificial Sequence
  RNA Oligomer
ucugcccuaugauuuuccg

SEQ ID NO: 11260 - RNA, 19 nt, Artificial Sequence
  RNA Oligomer
guucaaauuuauaccugca

SEQ ID NO: 11261 - RNA, 19 nt, Artificial Sequence
  RNA Oligomer
augccagcucuauagauac

SEQ ID NO: 11262 - RNA, 19 nt, Artificial Sequence
  RNA Oligomer
uccucucaguaaauaucug

SEQ ID NO: 11263 - RNA, 19 nt, Artificial Sequence
  RNA Oligomer
cacuuccucagauauaccu

SEQ ID NO: 11264 - RNA, 19 nt, Artificial Sequence
  RNA Oligomer
ucacuuaacucagcccuug

SEQ ID NO: 11265 - RNA, 19 nt, Artificial Sequence
  RNA Oligomer
auuaggucaugcauguugc

SEQ ID NO: 11266 - RNA, 19 nt, Artificial Sequence
  RNA Oligomer
aacucuuuagugugaaacc

SEQ ID NO: 11267 - RNA, 19 nt, Artificial Sequence
  RNA Oligomer
aggcuagucucaaucucag

SEQ ID NO: 11268 - RNA, 19 nt, Artificial Sequence
  RNA Oligomer
aacaacagaauaaccacac

SEQ ID NO: 11269 - RNA, 19 nt, Artificial Sequence
  RNA Oligomer
aauguuucccucagucacg

SEQ ID NO: 11270 - RNA, 19 nt, Artificial Sequence
  RNA Oligomer
ccauaguucagaaauccag

SEQ ID NO: 11271 - RNA, 19 nt, Artificial Sequence
  RNA Oligomer
uccauucaaugcuuuuucu

SEQ ID NO: 11272 - RNA, 19 nt, Artificial Sequence
  RNA Oligomer
ucuaguguuuugaguuccu

SEQ ID NO: 11273 - RNA, 19 nt, Artificial Sequence
  RNA Oligomer
uuuugaguuccuuucccag

SEQ ID NO: 11274 - RNA, 19 nt, Artificial Sequence
  RNA Oligomer
uuugaguuccuuucccagc

SEQ ID NO: 11275 - RNA, 19 nt, Artificial Sequence
  RNA Oligomer
uuuucaaucccagugaucu

SEQ ID NO: 11276 - RNA, 19 nt, Artificial Sequence
  RNA Oligomer
gauaccaucugagauuuga

SEQ ID NO: 11277 - RNA, 19 nt, Artificial Sequence
  RNA Oligomer
uaccaucugagauuugaag

SEQ ID NO: 11278 - RNA, 19 nt, Artificial Sequence
  RNA Oligomer
ucugagauuugaagggcug

SEQ ID NO: 11279 - RNA, 19 nt, Artificial Sequence
  RNA Oligomer
cagugaucuuccaaaauca

SEQ ID NO: 11280 - RNA, 19 nt, Artificial Sequence
  RNA Oligomer
aaguuucccaaucuccauc

SEQ ID NO: 11281 - RNA, 19 nt, Artificial Sequence
  RNA Oligomer
cgaauaggaaucacaagug

SEQ ID NO: 11282 - RNA, 19 nt, Artificial Sequence
  RNA Oligomer
aagcauccaguggucaagc

SEQ ID NO: 11283 - RNA, 19 nt, Artificial Sequence
  RNA Oligomer
agauacgauuuggaaugga

SEQ ID NO: 11284 - RNA, 19 nt, Artificial Sequence
  RNA Oligomer
gauuacgucucuuauaaca

SEQ ID NO: 11285 - RNA, 19 nt, Artificial Sequence
  RNA Oligomer
aagaagacacacagcacag

SEQ ID NO: 11286 - RNA, 19 nt, Artificial Sequence
  RNA Oligomer
agaagacacacagcacagc

SEQ ID NO: 11287 - RNA, 19 nt, Artificial Sequence
  RNA Oligomer
cagcacagcagacaaauag

SEQ ID NO: 11288 - RNA, 19 nt, Artificial Sequence
  RNA Oligomer
auuucuuuggcugccauga

SEQ ID NO: 11289 - RNA, 19 nt, Artificial Sequence
  RNA Oligomer
aauucauaguaagaggaag

SEQ ID NO: 11290 - RNA, 19 nt, Artificial Sequence
  RNA Oligomer
aagccaucaucccuuaaca

SEQ ID NO: 11291 - RNA, 19 nt, Artificial Sequence
  RNA Oligomer
gaauacaggaaacauauca

SEQ ID NO: 11292 - RNA, 19 nt, Artificial Sequence
  RNA Oligomer
agcacuuauuuucaucugu

SEQ ID NO: 11293 - RNA, 19 nt, Artificial Sequence
  RNA Oligomer
cacuuauuuucaucuguug

SEQ ID NO: 11294 - RNA, 19 nt, Artificial Sequence
  RNA Oligomer
aggucaggucuggaaaugc

SEQ ID NO: 11295 - RNA, 19 nt, Artificial Sequence
  RNA Oligomer
uucuauaggucagcauuuu

SEQ ID NO: 11296 - RNA, 19 nt, Artificial Sequence
  RNA Oligomer
ucagcauuuuaccuaugga

SEQ ID NO: 11297 - RNA, 19 nt, Artificial Sequence
  RNA Oligomer
gcauuuucuauuuucggug

SEQ ID NO: 11298 - RNA, 19 nt, Artificial Sequence
  RNA Oligomer
uaugagccaggauaaacac

SEQ ID NO: 11299 - RNA, 19 nt, Artificial Sequence
  RNA Oligomer
aaaaagagcaugguuaacu

SEQ ID NO: 11300 - RNA, 19 nt, Artificial Sequence
  RNA Oligomer
gacuucucuagaccagccu

SEQ ID NO: 11301 - RNA, 19 nt, Artificial Sequence
  RNA Oligomer
acuuuaaucaaccaaugcu

SEQ ID NO: 11302 - RNA, 19 nt, Artificial Sequence
  RNA Oligomer
cuuuaaucaaccaaugcuc

SEQ ID NO: 11303 - RNA, 19 nt, Artificial Sequence
  RNA Oligomer
uuuaaucaaccaaugcuca

SEQ ID NO: 11304 - RNA, 19 nt, Artificial Sequence
  RNA Oligomer
cucuacucaaugucgucca

SEQ ID NO: 11305 - RNA, 19 nt, Artificial Sequence
  RNA Oligomer
gaugaaagcaacacccuca

SEQ ID NO: 11306 - RNA, 19 nt, Artificial Sequence
  RNA Oligomer
aaagcaacacccucaucca

SEQ ID NO: 11307 - RNA, 19 nt, Artificial Sequence
  RNA Oligomer
uggcuuggcaacauuauca

SEQ ID NO: 11308 - RNA, 19 nt, Artificial Sequence
  RNA Oligomer
cagugcaaagauauuaucu

SEQ ID NO: 11309 - RNA, 19 nt, Artificial Sequence
  RNA Oligomer
uguuuaauaaggaaagagg

SEQ ID NO: 11310 - RNA, 19 nt, Artificial Sequence
  RNA Oligomer
uugauaugugggaagauca

SEQ ID NO: 11311 - RNA, 19 nt, Artificial Sequence
  RNA Oligomer
ggaagaucaugcauaaggc

SEQ ID NO: 11312 - RNA, 19 nt, Artificial Sequence
  RNA Oligomer
ugcaucuauacaaguuuuc

SEQ ID NO: 11313 - RNA, 19 nt, Artificial Sequence
  RNA Oligomer
augaugaaucuucacaccu

SEQ ID NO: 11314 - RNA, 19 nt, Artificial Sequence
  RNA Oligomer
ugaaucuucacaccucucu

SEQ ID NO: 11315 - RNA, 19 nt, Artificial Sequence
  RNA Oligomer
caaauuuauaccugcagac

SEQ ID NO: 11316 - RNA, 19 nt, Artificial Sequence
  RNA Oligomer
ugcugucuaaaauucuggu

SEQ ID NO: 11317 - RNA, 19 nt, Artificial Sequence
  RNA Oligomer
ugucuaaaauucugguuuc

SEQ ID NO: 11318 - RNA, 19 nt, Artificial Sequence
  RNA Oligomer
uaucccuccauuuuuauuc

SEQ ID NO: 11319 - RNA, 19 nt, Artificial Sequence
  RNA Oligomer
aaaaauaguuccucucagu

SEQ ID NO: 11320 - RNA, 19 nt, Artificial Sequence
  RNA Oligomer
cucaagacuucugcaccac

SEQ ID NO: 11321 - RNA, 19 nt, Artificial Sequence
  RNA Oligomer
uuuuccuuucacuuaacuc

SEQ ID NO: 11322 - RNA, 19 nt, Artificial Sequence
  RNA Oligomer
uuccuuucacuuaacucag

SEQ ID NO: 11323 - RNA, 19 nt, Artificial Sequence
  RNA Oligomer
uccuuucacuuaacucagc

SEQ ID NO: 11324 - RNA, 19 nt, Artificial Sequence
  RNA Oligomer
ccuuucacuuaacucagcc

SEQ ID NO: 11325 - RNA, 19 nt, Artificial Sequence
  RNA Oligomer
acucuuuagugugaaacca

SEQ ID NO: 11326 - RNA, 19 nt, Artificial Sequence
  RNA Oligomer
cugggaaaauaagagucag

SEQ ID NO: 11327 - RNA, 19 nt, Artificial Sequence
  RNA Oligomer
cagucaauuucucaaagac

SEQ ID NO: 11328 - RNA, 19 nt, Artificial Sequence
  RNA Oligomer
uacaaguuuucuccauaac

SEQ ID NO: 11329 - RNA, 19 nt, Artificial Sequence
  RNA Oligomer
aaaccauaguucagaaauc

SEQ ID NO: 11330 - RNA, 19 nt, Artificial Sequence
  RNA Oligomer
gcauuuucaaucccaguga

SEQ ID NO: 11331 - RNA, 19 nt, Artificial Sequence
  RNA Oligomer
ugagauuugaagggcugag

SEQ ID NO: 11332 - RNA, 19 nt, Artificial Sequence
  RNA Oligomer
acccaaguauucccaaagc

SEQ ID NO: 11333 - RNA, 19 nt, Artificial Sequence
  RNA Oligomer
uucccaaagccacauauga

SEQ ID NO: 11334 - RNA, 19 nt, Artificial Sequence
  RNA Oligomer
aaaccaaagcaagcagugu

SEQ ID NO: 11335 - RNA, 19 nt, Artificial Sequence
  RNA Oligomer
aaccaaagcaagcagugua

SEQ ID NO: 11336 - RNA, 19 nt, Artificial Sequence
  RNA Oligomer
auucauaguaagaggaagu

SEQ ID NO: 11337 - RNA, 19 nt, Artificial Sequence
  RNA Oligomer
uuuccacacacaaacaccu

SEQ ID NO: 11338 - RNA, 19 nt, Artificial Sequence
  RNA Oligomer
uccacacacaaacaccugc

SEQ ID NO: 11339 - RNA, 19 nt, Artificial Sequence
  RNA Oligomer
uguuaaaugcuuuuaccac

SEQ ID NO: 11340 - RNA, 19 nt, Artificial Sequence
  RNA Oligomer
aaacauaucagcaguaaag

SEQ ID NO: 11341 - RNA, 19 nt, Artificial Sequence
  RNA Oligomer
guaaaauaguuuggaucug

SEQ ID NO: 11342 - RNA, 19 nt, Artificial Sequence
  RNA Oligomer
aaggucaggucuggaaaug

SEQ ID NO: 11343 - RNA, 19 nt, Artificial Sequence
  RNA Oligomer
aaccaucagagugcucuuu

SEQ ID NO: 11344 - RNA, 19 nt, Artificial Sequence
  RNA Oligomer
uugcuuuuaacuacucagg

SEQ ID NO: 11345 - RNA, 19 nt, Artificial Sequence
  RNA Oligomer
cuuuaacaaaaagagcaug

SEQ ID NO: 11346 - RNA, 19 nt, Artificial Sequence
  RNA Oligomer
aacaaaaagagcaugguua

SEQ ID NO: 11347 - RNA, 19 nt, Artificial Sequence
  RNA Oligomer
ugguaccuaaacuuuaauc

SEQ ID NO: 11348 - RNA, 19 nt, Artificial Sequence
  RNA Oligomer
gguaccuaaacuuuaauca

SEQ ID NO: 11349 - RNA, 19 nt, Artificial Sequence
  RNA Oligomer
agaaaaucauaaugcucuc

SEQ ID NO: 11350 - RNA, 19 nt, Artificial Sequence
  RNA Oligomer
guccaacuuuuuguauccu

SEQ ID NO: 11351 - RNA, 19 nt, Artificial Sequence
  RNA Oligomer
gaaaaucauaaugcucucu

SEQ ID NO: 11352 - RNA, 19 nt, Artificial Sequence
  RNA Oligomer
uaccuuugcaaccaguuau

SEQ ID NO: 11353 - RNA, 19 nt, Artificial Sequence
  RNA Oligomer
ccacaaaagagaaaaacgu

SEQ ID NO: 11354 - RNA, 19 nt, Artificial Sequence
  RNA Oligomer
agaaaaacgucaagccaaa

SEQ ID NO: 11355 - RNA, 19 nt, Artificial Sequence
  RNA Oligomer
agaaacgagugggaaaaca

SEQ ID NO: 11356 - RNA, 19 nt, Artificial Sequence
  RNA Oligomer
accuugacgagaaugaaaa

SEQ ID NO: 11357 - RNA, 19 nt, Artificial Sequence
  RNA Oligomer
ccaucaccgaauuaauauu

SEQ ID NO: 11358 - RNA, 19 nt, Artificial Sequence
  RNA Oligomer
guaccuugacgagaaugaa

SEQ ID NO: 11359 - RNA, 19 nt, Artificial Sequence
  RNA Oligomer
cacuaaucaugccauuguu

SEQ ID NO: 11360 - RNA, 19 nt, Artificial Sequence
  RNA Oligomer
gcuaguaacuuuuggccau

SEQ ID NO: 11361 - RNA, 19 nt, Artificial Sequence
  RNA Oligomer
agaacuaccagaaacgagu

SEQ ID NO: 11362 - RNA, 19 nt, Artificial Sequence
  RNA Oligomer
gggcauccucuccacaaaa

SEQ ID NO: 11363 - RNA, 19 nt, Artificial Sequence
  RNA Oligomer
gggacuucuugaacuugca

SEQ ID NO: 11364 - RNA, 19 nt, Artificial Sequence
  RNA Oligomer
cgaugcuguaccuugacga

SEQ ID NO: 11365 - RNA, 19 nt, Artificial Sequence
  RNA Oligomer
gagaaaaacgucaagccaa

SEQ ID NO: 11366 - RNA, 19 nt, Artificial Sequence
  RNA Oligomer
aggaggcaaagaaaaggaa

SEQ ID NO: 11367 - RNA, 19 nt, Artificial Sequence
  RNA Oligomer
ggaggagaaacaagguguc

SEQ ID NO: 11368 - RNA, 19 nt, Artificial Sequence
  RNA Oligomer
gaaaucauaaaaccugcaa

SEQ ID NO: 11369 - RNA, 19 nt, Artificial Sequence
  RNA Oligomer
ccgagaacagaugcaagau

SEQ ID NO: 11370 - RNA, 19 nt, Artificial Sequence
  RNA Oligomer
ugaagaaucuuuggaagaa

SEQ ID NO: 11371 - RNA, 19 nt, Artificial Sequence
  RNA Oligomer
gugcuucuuagacggacug

SEQ ID NO: 11372 - RNA, 19 nt, Artificial Sequence
  RNA Oligomer
gaccagaguuuuuccaugu

SEQ ID NO: 11373 - RNA, 19 nt, Artificial Sequence
  RNA Oligomer
acagaacucagugcuaucu

SEQ ID NO: 11374 - RNA, 19 nt, Artificial Sequence
  RNA Oligomer
ggguaucacgccuuuuacu

SEQ ID NO: 11375 - RNA, 19 nt, Artificial Sequence
  RNA Oligomer
ggguggaaugacuggauug

SEQ ID NO: 11376 - RNA, 19 nt, Artificial Sequence
  RNA Oligomer
cuaguaacuuuuggccaug

SEQ ID NO: 11377 - RNA, 19 nt, Artificial Sequence
  RNA Oligomer
uaggaaacaauagcaguuu

SEQ ID NO: 11378 - RNA, 19 nt, Artificial Sequence
  RNA Oligomer
ccacggaggaguuuaucac

SEQ ID NO: 11379 - RNA, 19 nt, Artificial Sequence
  RNA Oligomer
cgagaaugaaaagguugua

SEQ ID NO: 11380 - RNA, 19 nt, Artificial Sequence
  RNA Oligomer
ggaaacgccuuaaguccag

SEQ ID NO: 11381 - RNA, 19 nt, Artificial Sequence
  RNA Oligomer
gggaaaguuuugaugucac

SEQ ID NO: 11382 - RNA, 19 nt, Artificial Sequence
  RNA Oligomer
ugaaucagaaugcaagcag

SEQ ID NO: 11383 - RNA, 19 nt, Artificial Sequence
  RNA Oligomer
ccaccaugaagaaucuuug

SEQ ID NO: 11384 - RNA, 19 nt, Artificial Sequence
  RNA Oligomer
ugaccagaguuuuuccaug

SEQ ID NO: 11385 - RNA, 19 nt, Artificial Sequence
  RNA Oligomer
agauuccuaaggcaugcug

SEQ ID NO: 11386 - RNA, 19 nt, Artificial Sequence
  RNA Oligomer
cucuaagauuccuaaggca

SEQ ID NO: 11387 - RNA, 19 nt, Artificial Sequence
  RNA Oligomer
guuaacucuaagauuccua

SEQ ID NO: 11388 - RNA, 19 nt, Artificial Sequence
  RNA Oligomer
cucuguuaacucuaagauu

SEQ ID NO: 11389 - RNA, 19 nt, Artificial Sequence
  RNA Oligomer
acucuguuaacucuaagau

SEQ ID NO: 11390 - RNA, 19 nt, Artificial Sequence
  RNA Oligomer
gucaagccaaacacaaaca

SEQ ID NO: 11391 - RNA, 19 nt, Artificial Sequence
  RNA Oligomer
caaaagagaaaaacgucaa

SEQ ID NO: 11392 - RNA, 19 nt, Artificial Sequence
  RNA Oligomer
gucacagauaaggccauug

SEQ ID NO: 11393 - RNA, 19 nt, Artificial Sequence
  RNA Oligomer
agacauguuaggauaagca

SEQ ID NO: 11394 - RNA, 19 nt, Artificial Sequence
  RNA Oligomer
ggacuucuugaacuugcag

SEQ ID NO: 11395 - RNA, 19 nt, Artificial Sequence
  RNA Oligomer
ccaugauggaaaagggcau

SEQ ID NO: 11396 - RNA, 19 nt, Artificial Sequence
  RNA Oligomer
uggugaaucagaaugcaag

SEQ ID NO: 11397 - RNA, 19 nt, Artificial Sequence
  RNA Oligomer
agguuggugaaucagaaug

SEQ ID NO: 11398 - RNA, 19 nt, Artificial Sequence
  RNA Oligomer
cagguuggugaaucagaau

SEQ ID NO: 11399 - RNA, 19 nt, Artificial Sequence
  RNA Oligomer
uccaccaugaagaaucuuu

SEQ ID NO: 11400 - RNA, 19 nt, Artificial Sequence
  RNA Oligomer
cuaucucgaugcuguaccu

SEQ ID NO: 11401 - RNA, 19 nt, Artificial Sequence
  RNA Oligomer
uccuuugaccagaguuuuu

SEQ ID NO: 11402 - RNA, 19 nt, Artificial Sequence
  RNA Oligomer
cugaacuccacuaaucaug

SEQ ID NO: 11403 - RNA, 19 nt, Artificial Sequence
  RNA Oligomer
cucuggcugaucaucugaa

SEQ ID NO: 11404 - RNA, 19 nt, Artificial Sequence
  RNA Oligomer
guuaggauaagcaggucuu

SEQ ID NO: 11405 - RNA, 19 nt, Artificial Sequence
  RNA Oligomer
ugggaaaguuuugauguca

SEQ ID NO: 11406 - RNA, 19 nt, Artificial Sequence
  RNA Oligomer
gcaggugggaaaguuuuga

SEQ ID NO: 11407 - RNA, 19 nt, Artificial Sequence
  RNA Oligomer
gugaaucagaaugcaagca

SEQ ID NO: 11408 - RNA, 19 nt, Artificial Sequence
  RNA Oligomer
ugaaaucauaaaaccugca

SEQ ID NO: 11409 - RNA, 19 nt, Artificial Sequence
  RNA Oligomer
uccaucaccgaauuaauau

SEQ ID NO: 11410 - RNA, 19 nt, Artificial Sequence
  RNA Oligomer
cuugcagggagaauaacuu

SEQ ID NO: 11411 - RNA, 19 nt, Artificial Sequence
  RNA Oligomer
uccuaaggcaugcuguguc

SEQ ID NO: 11412 - RNA, 19 nt, Artificial Sequence
  RNA Oligomer
ccuuugaccagaguuuuuc

SEQ ID NO: 11413 - RNA, 19 nt, Artificial Sequence
  RNA Oligomer
cugaucaucugaacuccac

SEQ ID NO: 11414 - RNA, 19 nt, Artificial Sequence
  RNA Oligomer
uggcugaucaucugaacuc

SEQ ID NO: 11415 - RNA, 19 nt, Artificial Sequence
  RNA Oligomer
cuuuuggccaugauggaaa

SEQ ID NO: 11416 - RNA, 19 nt, Artificial Sequence
  RNA Oligomer
gugggaaaguuuugauguc

SEQ ID NO: 11417 - RNA, 19 nt, Artificial Sequence
  RNA Oligomer
caggugggaaaguuuugau

SEQ ID NO: 11418 - RNA, 19 nt, Artificial Sequence
  RNA Oligomer
agcagagcuucagguuuuc

SEQ ID NO: 11419 - RNA, 19 nt, Artificial Sequence
  RNA Oligomer
cccuacaugcuagaccugu

SEQ ID NO: 11420 - RNA, 19 nt, Artificial Sequence
  RNA Oligomer
acaaaagagaaaaacguca

SEQ ID NO: 11421 - RNA, 19 nt, Artificial Sequence
  RNA Oligomer
aacccggagauucuucuuu

SEQ ID NO: 11422 - RNA, 19 nt, Artificial Sequence
  RNA Oligomer
gagaaugaaaagguuguau

SEQ ID NO: 11423 - RNA, 19 nt, Artificial Sequence
  RNA Oligomer
cccuuuguacguggacuuc

SEQ ID NO: 11424 - RNA, 19 nt, Artificial Sequence
  RNA Oligomer
cucuuucaauggacguguc

SEQ ID NO: 11425 - RNA, 19 nt, Artificial Sequence
  RNA Oligomer
gcucuuucaauggacgugu

SEQ ID NO: 11426 - RNA, 19 nt, Artificial Sequence
  RNA Oligomer
cgcuaguacagcaaaauua

SEQ ID NO: 11427 - RNA, 19 nt, Artificial Sequence
  RNA Oligomer
acaugguuguggaggguug

SEQ ID NO: 11428 - RNA, 19 nt, Artificial Sequence
  RNA Oligomer
ccaaacacaaacagcggaa

SEQ ID NO: 11429 - RNA, 19 nt, Artificial Sequence
  RNA Oligomer
aguaacuuuuggccaugau

SEQ ID NO: 11430 - RNA, 19 nt, Artificial Sequence
  RNA Oligomer
acgagaaugaaaagguugu

SEQ ID NO: 11431 - RNA, 19 nt, Artificial Sequence
  RNA Oligomer
uccucuggcugaucaucug

SEQ ID NO: 11432 - RNA, 19 nt, Artificial Sequence
  RNA Oligomer
accaagaugaacacagcug

SEQ ID NO: 11433 - RNA, 19 nt, Artificial Sequence
  RNA Oligomer
aggugggaaaguuuugaug

SEQ ID NO: 11434 - RNA, 19 nt, Artificial Sequence
  RNA Oligomer
agaugcuuuaggaaacaau

SEQ ID NO: 11435 - RNA, 19 nt, Artificial Sequence
  RNA Oligomer
ccagaaacgagugggaaaa

SEQ ID NO: 11436 - RNA, 19 nt, Artificial Sequence
  RNA Oligomer
gguggaaugacuggauugu

SEQ ID NO: 11437 - RNA, 19 nt, Artificial Sequence
  RNA Oligomer
gcuuuaggaaacaauagca

SEQ ID NO: 11438 - RNA, 19 nt, Artificial Sequence
  RNA Oligomer
ugucgcuaguacagcaaaa

SEQ ID NO: 11439 - RNA, 19 nt, Artificial Sequence
  RNA Oligomer
agaaugcccuuuuccucug

SEQ ID NO: 11440 - RNA, 19 nt, Artificial Sequence
  RNA Oligomer
gaacggacauucgguccuu

SEQ ID NO: 11441 - RNA, 19 nt, Artificial Sequence
  RNA Oligomer
caaacacaaacagcggaaa

SEQ ID NO: 11442 - RNA, 19 nt, Artificial Sequence
  RNA Oligomer
agaaucuuuggaagaacua

SEQ ID NO: 11443 - RNA, 19 nt, Artificial Sequence
  RNA Oligomer
cccuuuuccucuggcugau

SEQ ID NO: 11444 - RNA, 19 nt, Artificial Sequence
  RNA Oligomer
ucaagccaaacacaaacag

SEQ ID NO: 11445 - RNA, 19 nt, Artificial Sequence
  RNA Oligomer
ccucuccacaaaagagaaa

SEQ ID NO: 11446 - RNA, 19 nt, Artificial Sequence
  RNA Oligomer
gcuucagguuuuccgagaa

SEQ ID NO: 11447 - RNA, 19 nt, Artificial Sequence
  RNA Oligomer
cuaccagaaacgaguggga

SEQ ID NO: 11448 - RNA, 19 nt, Artificial Sequence
  RNA Oligomer
gaagaaucuuuggaagaac

SEQ ID NO: 11449 - RNA, 19 nt, Artificial Sequence
  RNA Oligomer
gucgcuaguacagcaaaau

SEQ ID NO: 11450 - RNA, 19 nt, Artificial Sequence
  RNA Oligomer
gccaaacacaaacagcgga

SEQ ID NO: 11451 - RNA, 19 nt, Artificial Sequence
  RNA Oligomer
gccauugcuaguaacuuuu

SEQ ID NO: 11452 - RNA, 19 nt, Artificial Sequence
  RNA Oligomer
gacuuuuggacaccagguu

SEQ ID NO: 11453 - RNA, 19 nt, Artificial Sequence
  RNA Oligomer
gggaaaacaacccggagau

SEQ ID NO: 11454 - RNA, 19 nt, Artificial Sequence
  RNA Oligomer
acguuggucaacucuguua

SEQ ID NO: 11455 - RNA, 19 nt, Artificial Sequence
  RNA Oligomer
ucaucugaacuccacuaau

SEQ ID NO: 11456 - RNA, 19 nt, Artificial Sequence
  RNA Oligomer
cuccacaaaagagaaaaac

SEQ ID NO: 11457 - RNA, 19 nt, Artificial Sequence
  RNA Oligomer
ucuccacaaaagagaaaaa

SEQ ID NO: 11458 - RNA, 19 nt, Artificial Sequence
  RNA Oligomer
cucuccacaaaagagaaaa

SEQ ID NO: 11459 - RNA, 19 nt, Artificial Sequence
  RNA Oligomer
ucgcuaguacagcaaaauu

SEQ ID NO: 11460 - RNA, 19 nt, Artificial Sequence
  RNA Oligomer
ggugucgcuaguacagcaa

SEQ ID NO: 11461 - RNA, 19 nt, Artificial Sequence
  RNA Oligomer
ccgacagaacucagugcua

SEQ ID NO: 11462 - RNA, 19 nt, Artificial Sequence
  RNA Oligomer
cuccacuaaucaugccauu

SEQ ID NO: 11463 - RNA, 19 nt, Artificial Sequence
  RNA Oligomer
ccagacuuuuggacaccag

SEQ ID NO: 11464 - RNA, 19 nt, Artificial Sequence
  RNA Oligomer
ccaugaagaaucuuuggaa

SEQ ID NO: 11465 - RNA, 19 nt, Artificial Sequence
  RNA Oligomer
ucacgccuuuuacugccac

SEQ ID NO: 11466 - RNA, 19 nt, Artificial Sequence
  RNA Oligomer
acagcggaaacgccuuaag

SEQ ID NO: 11467 - RNA, 19 nt, Artificial Sequence
  RNA Oligomer
ggcauccucuccacaaaag

SEQ ID NO: 11468 - RNA, 19 nt, Artificial Sequence
  RNA Oligomer
aggccauugcuaguaacuu

SEQ ID NO: 11469 - RNA, 19 nt, Artificial Sequence
  RNA Oligomer
cccacuuggaggagaaaca

SEQ ID NO: 11470 - RNA, 19 nt, Artificial Sequence
  RNA Oligomer
gggagaauaacuugcgcac

SEQ ID NO: 11471 - RNA, 19 nt, Artificial Sequence
  RNA Oligomer
agaacuaucaggacauggu

SEQ ID NO: 11472 - RNA, 19 nt, Artificial Sequence
  RNA Oligomer
cguuggucaacucuguuaa

SEQ ID NO: 11473 - RNA, 19 nt, Artificial Sequence
  RNA Oligomer
aucaucugaacuccacuaa

SEQ ID NO: 11474 - RNA, 19 nt, Artificial Sequence
  RNA Oligomer
acgucaagccaaacacaaa

SEQ ID NO: 11475 - RNA, 19 nt, Artificial Sequence
  RNA Oligomer
ccauugcuaguaacuuuug

SEQ ID NO: 11476 - RNA, 19 nt, Artificial Sequence
  RNA Oligomer
gcaggucuuugcaccaaga

SEQ ID NO: 11477 - RNA, 19 nt, Artificial Sequence
  RNA Oligomer
cugcaacagccaacucgaa

SEQ ID NO: 11478 - RNA, 19 nt, Artificial Sequence
  RNA Oligomer
guuuccaucaccgaauuaa

SEQ ID NO: 11479 - RNA, 19 nt, Artificial Sequence
  RNA Oligomer
gguuuuccgagaacagaug

SEQ ID NO: 11480 - RNA, 19 nt, Artificial Sequence
  RNA Oligomer
cuucagguuuuccgagaac

SEQ ID NO: 11481 - RNA, 19 nt, Artificial Sequence
  RNA Oligomer
agcuucagguuuuccgaga

SEQ ID NO: 11482 - RNA, 19 nt, Artificial Sequence
  RNA Oligomer
ggaggaguuuaucaccuca

SEQ ID NO: 11483 - RNA, 19 nt, Artificial Sequence
  RNA Oligomer
cuacaugcuagaccuguau

SEQ ID NO: 11484 - RNA, 19 nt, Artificial Sequence
  RNA Oligomer
cgugcuucuuagacggacu

SEQ ID NO: 11485 - RNA, 19 nt, Artificial Sequence
  RNA Oligomer
gugucgcuaguacagcaaa

SEQ ID NO: 11486 - RNA, 19 nt, Artificial Sequence
  RNA Oligomer
ccauuguucagacguuggu

SEQ ID NO: 11487 - RNA, 19 nt, Artificial Sequence
  RNA Oligomer
augccauuguucagacguu

SEQ ID NO: 11488 - RNA, 19 nt, Artificial Sequence
  RNA Oligomer
cuguaagagacacccuuug

SEQ ID NO: 11489 - RNA, 19 nt, Artificial Sequence
  RNA Oligomer
ggagaaacaaggugucucc

SEQ ID NO: 11490 - RNA, 19 nt, Artificial Sequence
  RNA Oligomer
gacacgccaaccauggauu

SEQ ID NO: 11491 - RNA, 19 nt, Artificial Sequence
  RNA Oligomer
gacaccagguuggugaauc

SEQ ID NO: 11492 - RNA, 19 nt, Artificial Sequence
  RNA Oligomer
ggaaacaauagcaguuucc

SEQ ID NO: 11493 - RNA, 19 nt, Artificial Sequence
  RNA Oligomer
aggaaacaauagcaguuuc

SEQ ID NO: 11494 - RNA, 19 nt, Artificial Sequence
  RNA Oligomer
ucagcagagcuucagguuu

SEQ ID NO: 11495 - RNA, 19 nt, Artificial Sequence
  RNA Oligomer
cggaggaguuuaucaccuc

SEQ ID NO: 11496 - RNA, 19 nt, Artificial Sequence
  RNA Oligomer
accagaaacgagugggaaa

SEQ ID NO: 11497 - RNA, 19 nt, Artificial Sequence
  RNA Oligomer
gugcuaucucgaugcugua

SEQ ID NO: 11498 - RNA, 19 nt, Artificial Sequence
  RNA Oligomer
gacguuggucaacucuguu

SEQ ID NO: 11499 - RNA, 19 nt, Artificial Sequence
  RNA Oligomer
acuccacuaaucaugccau

SEQ ID NO: 11500 - RNA, 19 nt, Artificial Sequence
  RNA Oligomer
gguccuuugaccagaguuu

SEQ ID NO: 11501 - RNA, 19 nt, Artificial Sequence
  RNA Oligomer
gcauccucuccacaaaaga

SEQ ID NO: 11502 - RNA, 19 nt, Artificial Sequence
  RNA Oligomer
agggcauccucuccacaaa

SEQ ID NO: 11503 - RNA, 19 nt, Artificial Sequence
  RNA Oligomer
uggucacagauaaggccau

SEQ ID NO: 11504 - RNA, 19 nt, Artificial Sequence
  RNA Oligomer
ggugucuccaagagacaug

SEQ ID NO: 11505 - RNA, 19 nt, Artificial Sequence
  RNA Oligomer
gaaacaaggugucuccaag

SEQ ID NO: 11506 - RNA, 19 nt, Artificial Sequence
  RNA Oligomer
gcuguucccagcgugaaaa

SEQ ID NO: 11507 - RNA, 19 nt, Artificial Sequence
  RNA Oligomer
ccuacaugcuagaccugua

SEQ ID NO: 11508 - RNA, 19 nt, Artificial Sequence
  RNA Oligomer
uccugagcgaguucgaguu

SEQ ID NO: 11509 - RNA, 19 nt, Artificial Sequence
  RNA Oligomer
cagguccuuugaccagagu

SEQ ID NO: 11510 - RNA, 19 nt, Artificial Sequence
  RNA Oligomer
gacacccuuuguacgugga

SEQ ID NO: 11511 - RNA, 19 nt, Artificial Sequence
  RNA Oligomer
gucuccaagagacauguua

SEQ ID NO: 11512 - RNA, 19 nt, Artificial Sequence
  RNA Oligomer
ccauggauucgugguggaa

SEQ ID NO: 11513 - RNA, 19 nt, Artificial Sequence
  RNA Oligomer
acaccagguuggugaauca

SEQ ID NO: 11514 - RNA, 19 nt, Artificial Sequence
  RNA Oligomer
ggaguuuaucaccucagca

SEQ ID NO: 11515 - RNA, 19 nt, Artificial Sequence
  RNA Oligomer
cagcuuccaccaugaagaa

SEQ ID NO: 11516 - RNA, 19 nt, Artificial Sequence
  RNA Oligomer
ucagcauguucggccugaa

SEQ ID NO: 11517 - RNA, 19 nt, Artificial Sequence
  RNA Oligomer
agcuguaagagacacccuu

SEQ ID NO: 11518 - RNA, 19 nt, Artificial Sequence
  RNA Oligomer
cgucaagccaaacacaaac

SEQ ID NO: 11519 - RNA, 19 nt, Artificial Sequence
  RNA Oligomer
accagacuuuuggacacca

SEQ ID NO: 11520 - RNA, 19 nt, Artificial Sequence
  RNA Oligomer
ugaccagacuuuuggacac

SEQ ID NO: 11521 - RNA, 19 nt, Artificial Sequence
  RNA Oligomer
uccgagaacagaugcaaga

SEQ ID NO: 11522 - RNA, 19 nt, Artificial Sequence
  RNA Oligomer
gaguuuaucaccucagcag

SEQ ID NO: 11523 - RNA, 19 nt, Artificial Sequence
  RNA Oligomer
gaggaguuuaucaccucag

SEQ ID NO: 11524 - RNA, 19 nt, Artificial Sequence
  RNA Oligomer
ugggaaaacaacccggaga

SEQ ID NO: 11525 - RNA, 19 nt, Artificial Sequence
  RNA Oligomer
gcagcuuccaccaugaaga

SEQ ID NO: 11526 - RNA, 19 nt, Artificial Sequence
  RNA Oligomer
gcauguucggccugaaaca

SEQ ID NO: 11527 - RNA, 19 nt, Artificial Sequence
  RNA Oligomer
ucagugcuaucucgaugcu

SEQ ID NO: 11528 - RNA, 19 nt, Artificial Sequence
  RNA Oligomer
gucaacucuguuaacucua

SEQ ID NO: 11529 - RNA, 19 nt, Artificial Sequence
  RNA Oligomer
acccuuuguacguggacuu

SEQ ID NO: 11530 - RNA, 19 nt, Artificial Sequence
  RNA Oligomer
ggucuuugcaccaagauga

SEQ ID NO: 11531 - RNA, 19 nt, Artificial Sequence
  RNA Oligomer
caggucuuugcaccaagau

SEQ ID NO: 11532 - RNA, 19 nt, Artificial Sequence
  RNA Oligomer
caaggugucuccaagagac

SEQ ID NO: 11533 - RNA, 19 nt, Artificial Sequence
  RNA Oligomer
accauggauucguggugga

SEQ ID NO: 11534 - RNA, 19 nt, Artificial Sequence
  RNA Oligomer
caaccauggauucguggug

SEQ ID NO: 11535 - RNA, 19 nt, Artificial Sequence
  RNA Oligomer
cgugaccagacuuuuggac

SEQ ID NO: 11536 - RNA, 19 nt, Artificial Sequence
  RNA Oligomer
ccgugaccagacuuuugga

SEQ ID NO: 11537 - RNA, 19 nt, Artificial Sequence
  RNA Oligomer
acggaggaguuuaucaccu

SEQ ID NO: 11538 - RNA, 19 nt, Artificial Sequence
  RNA Oligomer
agacguuggucaacucugu

SEQ ID NO: 11539 - RNA, 19 nt, Artificial Sequence
  RNA Oligomer
cacggagaaugcccuuuuc

SEQ ID NO: 11540 - RNA, 19 nt, Artificial Sequence
  RNA Oligomer
gccuuaaguccagcuguaa

SEQ ID NO: 11541 - RNA, 19 nt, Artificial Sequence
  RNA Oligomer
agcaggucuuugcaccaag

SEQ ID NO: 11542 - RNA, 19 nt, Artificial Sequence
  RNA Oligomer
ggauaagcaggucuuugca

SEQ ID NO: 11543 - RNA, 19 nt, Artificial Sequence
  RNA Oligomer
ccaaccauggauucguggu

SEQ ID NO: 11544 - RNA, 19 nt, Artificial Sequence
  RNA Oligomer
ggaaaguuuugaugucacc

SEQ ID NO: 11545 - RNA, 19 nt, Artificial Sequence
  RNA Oligomer
ggacaccagguuggugaau

SEQ ID NO: 11546 - RNA, 19 nt, Artificial Sequence
  RNA Oligomer
agguuuuccgagaacagau

SEQ ID NO: 11547 - RNA, 19 nt, Artificial Sequence
  RNA Oligomer
cccacggaggaguuuauca

SEQ ID NO: 11548 - RNA, 19 nt, Artificial Sequence
  RNA Oligomer
ugccauuguucagacguug

SEQ ID NO: 11549 - RNA, 19 nt, Artificial Sequence
  RNA Oligomer
guccuuugaccagaguuuu

SEQ ID NO: 11550 - RNA, 19 nt, Artificial Sequence
  RNA Oligomer
acgccaaccauggauucgu

SEQ ID NO: 11551 - RNA, 19 nt, Artificial Sequence
  RNA Oligomer
agggagaauaacuugcgca

SEQ ID NO: 11552 - RNA, 19 nt, Artificial Sequence
  RNA Oligomer
accaugaagaaucuuugga

SEQ ID NO: 11553 - RNA, 19 nt, Artificial Sequence
  RNA Oligomer
gcugucuucuagcguugcu

SEQ ID NO: 11554 - RNA, 19 nt, Artificial Sequence
  RNA Oligomer
cgcucuuucaauggacgug

SEQ ID NO: 11555 - RNA, 19 nt, Artificial Sequence
  RNA Oligomer
uccauguggacgcucuuuc

SEQ ID NO: 11556 - RNA, 19 nt, Artificial Sequence
  RNA Oligomer
ggcugaucaucugaacucc

SEQ ID NO: 11557 - RNA, 19 nt, Artificial Sequence
  RNA Oligomer
gcaccaagaugaacacagc

SEQ ID NO: 11558 - RNA, 19 nt, Artificial Sequence
  RNA Oligomer
caacccggagauucuucuu

SEQ ID NO: 11559 - RNA, 19 nt, Artificial Sequence
  RNA Oligomer
gcuuccaccaugaagaauc

SEQ ID NO: 11560 - RNA, 19 nt, Artificial Sequence
  RNA Oligomer
agguccuuugaccagaguu

SEQ ID NO: 11561 - RNA, 19 nt, Artificial Sequence
  RNA Oligomer
cacccuuuguacguggacu

SEQ ID NO: 11562 - RNA, 19 nt, Artificial Sequence
  RNA Oligomer
cggaaacgccuuaagucca

SEQ ID NO: 11563 - RNA, 19 nt, Artificial Sequence
  RNA Oligomer
ugauggaaaagggcauccu

SEQ ID NO: 11564 - RNA, 19 nt, Artificial Sequence
  RNA Oligomer
gucuccuaaaggucgacca

SEQ ID NO: 11565 - RNA, 19 nt, Artificial Sequence
  RNA Oligomer
ccaagaugaacacagcugg

SEQ ID NO: 11566 - RNA, 19 nt, Artificial Sequence
  RNA Oligomer
gaaaagggcauccucucca

SEQ ID NO: 11567 - RNA, 19 nt, Artificial Sequence
  RNA Oligomer
ugcaccaagaugaacacag

SEQ ID NO: 11568 - RNA, 19 nt, Artificial Sequence
  RNA Oligomer
gucuuugcaccaagaugaa

SEQ ID NO: 11569 - RNA, 19 nt, Artificial Sequence
  RNA Oligomer
ggagaaugcccuuuuccuc

SEQ ID NO: 11570 - RNA, 19 nt, Artificial Sequence
  RNA Oligomer
cggagaaugcccuuuuccu

SEQ ID NO: 11571 - RNA, 19 nt, Artificial Sequence
  RNA Oligomer
aagaugcuuuaggaaacaa

SEQ ID NO: 11572 - RNA, 19 nt, Artificial Sequence
  RNA Oligomer
acguuuuucucuuuugugg

SEQ ID NO: 11573 - RNA, 19 nt, Artificial Sequence
  RNA Oligomer
uuuggcuugacguuuuucu

SEQ ID NO: 11574 - RNA, 19 nt, Artificial Sequence
  RNA Oligomer
uguuuucccacucguuucu

SEQ ID NO: 11575 - RNA, 19 nt, Artificial Sequence
  RNA Oligomer
uuuucauucucgucaaggu

SEQ ID NO: 11576 - RNA, 19 nt, Artificial Sequence
  RNA Oligomer
aauauuaauucggugaugg

SEQ ID NO: 11577 - RNA, 19 nt, Artificial Sequence
  RNA Oligomer
uucauucucgucaagguac

SEQ ID NO: 11578 - RNA, 19 nt, Artificial Sequence
  RNA Oligomer
aacaauggcaugauuagug

SEQ ID NO: 11579 - RNA, 19 nt, Artificial Sequence
  RNA Oligomer
auggccaaaaguuacuagc

SEQ ID NO: 11580 - RNA, 19 nt, Artificial Sequence
  RNA Oligomer
acucguuucugguaguucu

SEQ ID NO: 11581 - RNA, 19 nt, Artificial Sequence
  RNA Oligomer
uuuuguggagaggaugccc

SEQ ID NO: 11582 - RNA, 19 nt, Artificial Sequence
  RNA Oligomer
ugcaaguucaagaaguccc

SEQ ID NO: 11583 - RNA, 19 nt, Artificial Sequence
  RNA Oligomer
ucgucaagguacagcaucg

SEQ ID NO: 11584 - RNA, 19 nt, Artificial Sequence
  RNA Oligomer
uuggcuugacguuuuucuc

SEQ ID NO: 11585 - RNA, 19 nt, Artificial Sequence
  RNA Oligomer
uuccuuuucuuugccuccu

SEQ ID NO: 11586 - RNA, 19 nt, Artificial Sequence
  RNA Oligomer
gacaccuuguuucuccucc

SEQ ID NO: 11587 - RNA, 19 nt, Artificial Sequence
  RNA Oligomer
uugcagguuuuaugauuuc

SEQ ID NO: 11588 - RNA, 19 nt, Artificial Sequence
  RNA Oligomer
aucuugcaucuguucucgg

SEQ ID NO: 11589 - RNA, 19 nt, Artificial Sequence
  RNA Oligomer
uucuuccaaagauucuuca

SEQ ID NO: 11590 - RNA, 19 nt, Artificial Sequence
  RNA Oligomer
caguccgucuaagaagcac

SEQ ID NO: 11591 - RNA, 19 nt, Artificial Sequence
  RNA Oligomer
acauggaaaaacucugguc

SEQ ID NO: 11592 - RNA, 19 nt, Artificial Sequence
  RNA Oligomer
agauagcacugaguucugu

SEQ ID NO: 11593 - RNA, 19 nt, Artificial Sequence
  RNA Oligomer
aguaaaaggcgugauaccc

SEQ ID NO: 11594 - RNA, 19 nt, Artificial Sequence
  RNA Oligomer
caauccagucauuccaccc

SEQ ID NO: 11595 - RNA, 19 nt, Artificial Sequence
  RNA Oligomer
cauggccaaaaguuacuag

SEQ ID NO: 11596 - RNA, 19 nt, Artificial Sequence
  RNA Oligomer
aaacugcuauuguuuccua

SEQ ID NO: 11597 - RNA, 19 nt, Artificial Sequence
  RNA Oligomer
gugauaaacuccuccgugg

SEQ ID NO: 11598 - RNA, 19 nt, Artificial Sequence
  RNA Oligomer
uacaaccuuuucauucucg

SEQ ID NO: 11599 - RNA, 19 nt, Artificial Sequence
  RNA Oligomer
cuggacuuaaggcguuucc

SEQ ID NO: 11600 - RNA, 19 nt, Artificial Sequence
  RNA Oligomer
gugacaucaaaacuuuccc

SEQ ID NO: 11601 - RNA, 19 nt, Artificial Sequence
  RNA Oligomer
cugcuugcauucugauuca

SEQ ID NO: 11602 - RNA, 19 nt, Artificial Sequence
  RNA Oligomer
caaagauucuucauggugg

SEQ ID NO: 11603 - RNA, 19 nt, Artificial Sequence
  RNA Oligomer
cauggaaaaacucugguca

SEQ ID NO: 11604 - RNA, 19 nt, Artificial Sequence
  RNA Oligomer
cagcaugccuuaggaaucu

SEQ ID NO: 11605 - RNA, 19 nt, Artificial Sequence
  RNA Oligomer
ugccuuaggaaucuuagag

SEQ ID NO: 11606 - RNA, 19 nt, Artificial Sequence
  RNA Oligomer
uaggaaucuuagaguuaac

SEQ ID NO: 11607 - RNA, 19 nt, Artificial Sequence
  RNA Oligomer
aaucuuagaguuaacagag

SEQ ID NO: 11608 - RNA, 19 nt, Artificial Sequence
  RNA Oligomer
aucuuagaguuaacagagu

SEQ ID NO: 11609 - RNA, 19 nt, Artificial Sequence
  RNA Oligomer
uguuuguguuuggcuugac

SEQ ID NO: 11610 - RNA, 19 nt, Artificial Sequence
  RNA Oligomer
uugacguuuuucucuuuug

SEQ ID NO: 11611 - RNA, 19 nt, Artificial Sequence
  RNA Oligomer
caauggccuuaucugugac

SEQ ID NO: 11612 - RNA, 19 nt, Artificial Sequence
  RNA Oligomer
ugcuuauccuaacaugucu

SEQ ID NO: 11613 - RNA, 19 nt, Artificial Sequence
  RNA Oligomer
cugcaaguucaagaagucc

SEQ ID NO: 11614 - RNA, 19 nt, Artificial Sequence
  RNA Oligomer
augcccuuuuccaucaugg

SEQ ID NO: 11615 - RNA, 19 nt, Artificial Sequence
  RNA Oligomer
cuugcauucugauucacca

SEQ ID NO: 11616 - RNA, 19 nt, Artificial Sequence
  RNA Oligomer
cauucugauucaccaaccu

SEQ ID NO: 11617 - RNA, 19 nt, Artificial Sequence
  RNA Oligomer
auucugauucaccaaccug

SEQ ID NO: 11618 - RNA, 19 nt, Artificial Sequence
  RNA Oligomer
aaagauucuucauggugga

SEQ ID NO: 11619 - RNA, 19 nt, Artificial Sequence
  RNA Oligomer
agguacagcaucgagauag

SEQ ID NO: 11620 - RNA, 19 nt, Artificial Sequence
  RNA Oligomer
aaaaacucuggucaaagga

SEQ ID NO: 11621 - RNA, 19 nt, Artificial Sequence
  RNA Oligomer
caugauuaguggaguucag

SEQ ID NO: 11622 - RNA, 19 nt, Artificial Sequence
  RNA Oligomer
uucagaugaucagccagag

SEQ ID NO: 11623 - RNA, 19 nt, Artificial Sequence
  RNA Oligomer
aagaccugcuuauccuaac

SEQ ID NO: 11624 - RNA, 19 nt, Artificial Sequence
  RNA Oligomer
ugacaucaaaacuuuccca

SEQ ID NO: 11625 - RNA, 19 nt, Artificial Sequence
  RNA Oligomer
ucaaaacuuucccaccugc

SEQ ID NO: 11626 - RNA, 19 nt, Artificial Sequence
  RNA Oligomer
ugcuugcauucugauucac

SEQ ID NO: 11627 - RNA, 19 nt, Artificial Sequence
  RNA Oligomer
ugcagguuuuaugauuuca

SEQ ID NO: 11628 - RNA, 19 nt, Artificial Sequence
  RNA Oligomer
auauuaauucggugaugga

SEQ ID NO: 11629 - RNA, 19 nt, Artificial Sequence
  RNA Oligomer
aaguuauucucccugcaag

SEQ ID NO: 11630 - RNA, 19 nt, Artificial Sequence
  RNA Oligomer
gacacagcaugccuuagga

SEQ ID NO: 11631 - RNA, 19 nt, Artificial Sequence
  RNA Oligomer
gaaaaacucuggucaaagg

SEQ ID NO: 11632 - RNA, 19 nt, Artificial Sequence
  RNA Oligomer
guggaguucagaugaucag

SEQ ID NO: 11633 - RNA, 19 nt, Artificial Sequence
  RNA Oligomer
gaguucagaugaucagcca

SEQ ID NO: 11634 - RNA, 19 nt, Artificial Sequence
  RNA Oligomer
uuuccaucauggccaaaag

SEQ ID NO: 11635 - RNA, 19 nt, Artificial Sequence
  RNA Oligomer
gacaucaaaacuuucccac

SEQ ID NO: 11636 - RNA, 19 nt, Artificial Sequence
  RNA Oligomer
aucaaaacuuucccaccug

SEQ ID NO: 11637 - RNA, 19 nt, Artificial Sequence
  RNA Oligomer
gaaaaccugaagcucugcu

SEQ ID NO: 11638 - RNA, 19 nt, Artificial Sequence
  RNA Oligomer
acaggucuagcauguaggg

SEQ ID NO: 11639 - RNA, 19 nt, Artificial Sequence
  RNA Oligomer
ugacguuuuucucuuuugu

SEQ ID NO: 11640 - RNA, 19 nt, Artificial Sequence
  RNA Oligomer
aaagaagaaucuccggguu

SEQ ID NO: 11641 - RNA, 19 nt, Artificial Sequence
  RNA Oligomer
auacaaccuuuucauucuc

SEQ ID NO: 11642 - RNA, 19 nt, Artificial Sequence
  RNA Oligomer
gaaguccacguacaaaggg

SEQ ID NO: 11643 - RNA, 19 nt, Artificial Sequence
  RNA Oligomer
gacacguccauugaaagag

SEQ ID NO: 11644 - RNA, 19 nt, Artificial Sequence
  RNA Oligomer
acacguccauugaaagagc

SEQ ID NO: 11645 - RNA, 19 nt, Artificial Sequence
  RNA Oligomer
uaauuuugcuguacuagcg

SEQ ID NO: 11646 - RNA, 19 nt, Artificial Sequence
  RNA Oligomer
caacccuccacaaccaugu

SEQ ID NO: 11647 - RNA, 19 nt, Artificial Sequence
  RNA Oligomer
uuccgcuguuuguguuugg

SEQ ID NO: 11648 - RNA, 19 nt, Artificial Sequence
  RNA Oligomer
aucauggccaaaaguuacu

SEQ ID NO: 11649 - RNA, 19 nt, Artificial Sequence
  RNA Oligomer
acaaccuuuucauucucgu

SEQ ID NO: 11650 - RNA, 19 nt, Artificial Sequence
  RNA Oligomer
cagaugaucagccagagga

SEQ ID NO: 11651 - RNA, 19 nt, Artificial Sequence
  RNA Oligomer
cagcuguguucaucuuggu

SEQ ID NO: 11652 - RNA, 19 nt, Artificial Sequence
  RNA Oligomer
caucaaaacuuucccaccu

SEQ ID NO: 11653 - RNA, 19 nt, Artificial Sequence
  RNA Oligomer
auuguuuccuaaagcaucu

SEQ ID NO: 11654 - RNA, 19 nt, Artificial Sequence
  RNA Oligomer
uuuucccacucguuucugg

SEQ ID NO: 11655 - RNA, 19 nt, Artificial Sequence
  RNA Oligomer
acaauccagucauuccacc

SEQ ID NO: 11656 - RNA, 19 nt, Artificial Sequence
  RNA Oligomer
ugcuauuguuuccuaaagc

SEQ ID NO: 11657 - RNA, 19 nt, Artificial Sequence
  RNA Oligomer
uuuugcuguacuagcgaca

SEQ ID NO: 11658 - RNA, 19 nt, Artificial Sequence
  RNA Oligomer
cagaggaaaagggcauucu

SEQ ID NO: 11659 - RNA, 19 nt, Artificial Sequence
  RNA Oligomer
aaggaccgaauguccguuc

SEQ ID NO: 11660 - RNA, 19 nt, Artificial Sequence
  RNA Oligomer
uuuccgcuguuuguguuug

SEQ ID NO: 11661 - RNA, 19 nt, Artificial Sequence
  RNA Oligomer
uaguucuuccaaagauucu

SEQ ID NO: 11662 - RNA, 19 nt, Artificial Sequence
  RNA Oligomer
aucagccagaggaaaaggg

SEQ ID NO: 11663 - RNA, 19 nt, Artificial Sequence
  RNA Oligomer
cuguuuguguuuggcuuga

SEQ ID NO: 11664 - RNA, 19 nt, Artificial Sequence
  RNA Oligomer
uuucucuuuuguggagagg

SEQ ID NO: 11665 - RNA, 19 nt, Artificial Sequence
  RNA Oligomer
uucucggaaaaccugaagc

SEQ ID NO: 11666 - RNA, 19 nt, Artificial Sequence
  RNA Oligomer
ucccacucguuucugguag

SEQ ID NO: 11667 - RNA, 19 nt, Artificial Sequence
  RNA Oligomer
guucuuccaaagauucuuc

SEQ ID NO: 11668 - RNA, 19 nt, Artificial Sequence
  RNA Oligomer
auuuugcuguacuagcgac

SEQ ID NO: 11669 - RNA, 19 nt, Artificial Sequence
  RNA Oligomer
uccgcuguuuguguuuggc

SEQ ID NO: 11670 - RNA, 19 nt, Artificial Sequence
  RNA Oligomer
aaaaguuacuagcaauggc

SEQ ID NO: 11671 - RNA, 19 nt, Artificial Sequence
  RNA Oligomer
aaccugguguccaaaaguc

SEQ ID NO: 11672 - RNA, 19 nt, Artificial Sequence
  RNA Oligomer
aucuccggguuguuuuccc

SEQ ID NO: 11673 - RNA, 19 nt, Artificial Sequence
  RNA Oligomer
uaacagaguugaccaacgu

SEQ ID NO: 11674 - RNA, 19 nt, Artificial Sequence
  RNA Oligomer
auuaguggaguucagauga

SEQ ID NO: 11675 - RNA, 19 nt, Artificial Sequence
  RNA Oligomer
guuuuucucuuuuguggag

SEQ ID NO: 11676 - RNA, 19 nt, Artificial Sequence
  RNA Oligomer
uuuuucucuuuuguggaga

SEQ ID NO: 11677 - RNA, 19 nt, Artificial Sequence
  RNA Oligomer
uuuucucuuuuguggagag

SEQ ID NO: 11678 - RNA, 19 nt, Artificial Sequence
  RNA Oligomer
aauuuugcuguacuagcga

SEQ ID NO: 11679 - RNA, 19 nt, Artificial Sequence
  RNA Oligomer
uugcuguacuagcgacacc

SEQ ID NO: 11680 - RNA, 19 nt, Artificial Sequence
  RNA Oligomer
uagcacugaguucugucgg

SEQ ID NO: 11681 - RNA, 19 nt, Artificial Sequence
  RNA Oligomer
aauggcaugauuaguggag

SEQ ID NO: 11682 - RNA, 19 nt, Artificial Sequence
  RNA Oligomer
cugguguccaaaagucugg

SEQ ID NO: 11683 - RNA, 19 nt, Artificial Sequence
  RNA Oligomer
uuccaaagauucuucaugg

SEQ ID NO: 11684 - RNA, 19 nt, Artificial Sequence
  RNA Oligomer
guggcaguaaaaggcguga

SEQ ID NO: 11685 - RNA, 19 nt, Artificial Sequence
  RNA Oligomer
cuuaaggcguuuccgcugu

SEQ ID NO: 11686 - RNA, 19 nt, Artificial Sequence
  RNA Oligomer
cuuuuguggagaggaugcc

SEQ ID NO: 11687 - RNA, 19 nt, Artificial Sequence
  RNA Oligomer
aaguuacuagcaauggccu

SEQ ID NO: 11688 - RNA, 19 nt, Artificial Sequence
  RNA Oligomer
uguuucuccuccaaguggg

SEQ ID NO: 11689 - RNA, 19 nt, Artificial Sequence
  RNA Oligomer
gugcgcaaguuauucuccc

SEQ ID NO: 11690 - RNA, 19 nt, Artificial Sequence
  RNA Oligomer
accauguccugauaguucu

SEQ ID NO: 11691 - RNA, 19 nt, Artificial Sequence
  RNA Oligomer
uuaacagaguugaccaacg

SEQ ID NO: 11692 - RNA, 19 nt, Artificial Sequence
  RNA Oligomer
uuaguggaguucagaugau

SEQ ID NO: 11693 - RNA, 19 nt, Artificial Sequence
  RNA Oligomer
uuuguguuuggcuugacgu

SEQ ID NO: 11694 - RNA, 19 nt, Artificial Sequence
  RNA Oligomer
caaaaguuacuagcaaugg

SEQ ID NO: 11695 - RNA, 19 nt, Artificial Sequence
  RNA Oligomer
ucuuggugcaaagaccugc

SEQ ID NO: 11696 - RNA, 19 nt, Artificial Sequence
  RNA Oligomer
uucgaguuggcuguugcag

SEQ ID NO: 11697 - RNA, 19 nt, Artificial Sequence
  RNA Oligomer
uuaauucggugauggaaac

SEQ ID NO: 11698 - RNA, 19 nt, Artificial Sequence
  RNA Oligomer
caucuguucucggaaaacc

SEQ ID NO: 11699 - RNA, 19 nt, Artificial Sequence
  RNA Oligomer
guucucggaaaaccugaag

SEQ ID NO: 11700 - RNA, 19 nt, Artificial Sequence
  RNA Oligomer
ucucggaaaaccugaagcu

SEQ ID NO: 11701 - RNA, 19 nt, Artificial Sequence
  RNA Oligomer
ugaggugauaaacuccucc

SEQ ID NO: 11702 - RNA, 19 nt, Artificial Sequence
  RNA Oligomer
auacaggucuagcauguag

SEQ ID NO: 11703 - RNA, 19 nt, Artificial Sequence
  RNA Oligomer
aguccgucuaagaagcacg

SEQ ID NO: 11704 - RNA, 19 nt, Artificial Sequence
  RNA Oligomer
uuugcuguacuagcgacac

SEQ ID NO: 11705 - RNA, 19 nt, Artificial Sequence
  RNA Oligomer
accaacgucugaacaaugg

SEQ ID NO: 11706 - RNA, 19 nt, Artificial Sequence
  RNA Oligomer
aacgucugaacaauggcau

SEQ ID NO: 11707 - RNA, 19 nt, Artificial Sequence
  RNA Oligomer
caaagggugucucuuacag

SEQ ID NO: 11708 - RNA, 19 nt, Artificial Sequence
  RNA Oligomer
ggagacaccuuguuucucc

SEQ ID NO: 11709 - RNA, 19 nt, Artificial Sequence
  RNA Oligomer
aauccaugguuggcguguc

SEQ ID NO: 11710 - RNA, 19 nt, Artificial Sequence
  RNA Oligomer
gauucaccaaccugguguc

SEQ ID NO: 11711 - RNA, 19 nt, Artificial Sequence
  RNA Oligomer
ggaaacugcuauuguuucc

SEQ ID NO: 11712 - RNA, 19 nt, Artificial Sequence
  RNA Oligomer
gaaacugcuauuguuuccu

SEQ ID NO: 11713 - RNA, 19 nt, Artificial Sequence
  RNA Oligomer
aaaccugaagcucugcuga

SEQ ID NO: 11714 - RNA, 19 nt, Artificial Sequence
  RNA Oligomer
gaggugauaaacuccuccg

SEQ ID NO: 11715 - RNA, 19 nt, Artificial Sequence
  RNA Oligomer
uuucccacucguuucuggu

SEQ ID NO: 11716 - RNA, 19 nt, Artificial Sequence
  RNA Oligomer
uacagcaucgagauagcac

SEQ ID NO: 11717 - RNA, 19 nt, Artificial Sequence
  RNA Oligomer
aacagaguugaccaacguc

SEQ ID NO: 11718 - RNA, 19 nt, Artificial Sequence
  RNA Oligomer
auggcaugauuaguggagu

SEQ ID NO: 11719 - RNA, 19 nt, Artificial Sequence
  RNA Oligomer
aaacucuggucaaaggacc

SEQ ID NO: 11720 - RNA, 19 nt, Artificial Sequence
  RNA Oligomer
ucuuuuguggagaggaugc

SEQ ID NO: 11721 - RNA, 19 nt, Artificial Sequence
  RNA Oligomer
uuuguggagaggaugcccu

SEQ ID NO: 11722 - RNA, 19 nt, Artificial Sequence
  RNA Oligomer
auggccuuaucugugacca

SEQ ID NO: 11723 - RNA, 19 nt, Artificial Sequence
  RNA Oligomer
caugucucuuggagacacc

SEQ ID NO: 11724 - RNA, 19 nt, Artificial Sequence
  RNA Oligomer
cuuggagacaccuuguuuc

SEQ ID NO: 11725 - RNA, 19 nt, Artificial Sequence
  RNA Oligomer
uuuucacgcugggaacagc

SEQ ID NO: 11726 - RNA, 19 nt, Artificial Sequence
  RNA Oligomer
uacaggucuagcauguagg

SEQ ID NO: 11727 - RNA, 19 nt, Artificial Sequence
  RNA Oligomer
aacucgaacucgcucagga

SEQ ID NO: 11728 - RNA, 19 nt, Artificial Sequence
  RNA Oligomer
acucuggucaaaggaccug

SEQ ID NO: 11729 - RNA, 19 nt, Artificial Sequence
  RNA Oligomer
uccacguacaaaggguguc

SEQ ID NO: 11730 - RNA, 19 nt, Artificial Sequence
  RNA Oligomer
uaacaugucucuuggagac

SEQ ID NO: 11731 - RNA, 19 nt, Artificial Sequence
  RNA Oligomer
uuccaccacgaauccaugg

SEQ ID NO: 11732 - RNA, 19 nt, Artificial Sequence
  RNA Oligomer
ugauucaccaaccuggugu

SEQ ID NO: 11733 - RNA, 19 nt, Artificial Sequence
  RNA Oligomer
ugcugaggugauaaacucc

SEQ ID NO: 11734 - RNA, 19 nt, Artificial Sequence
  RNA Oligomer
uucuucaugguggaagcug

SEQ ID NO: 11735 - RNA, 19 nt, Artificial Sequence
  RNA Oligomer
uucaggccgaacaugcuga

SEQ ID NO: 11736 - RNA, 19 nt, Artificial Sequence
  RNA Oligomer
aagggugucucuuacagcu

SEQ ID NO: 11737 - RNA, 19 nt, Artificial Sequence
  RNA Oligomer
guuuguguuuggcuugacg

SEQ ID NO: 11738 - RNA, 19 nt, Artificial Sequence
  RNA Oligomer
ugguguccaaaagucuggu

SEQ ID NO: 11739 - RNA, 19 nt, Artificial Sequence
  RNA Oligomer
guguccaaaagucugguca

SEQ ID NO: 11740 - RNA, 19 nt, Artificial Sequence
  RNA Oligomer
ucuugcaucuguucucgga

SEQ ID NO: 11741 - RNA, 19 nt, Artificial Sequence
  RNA Oligomer
cugcugaggugauaaacuc

SEQ ID NO: 11742 - RNA, 19 nt, Artificial Sequence
  RNA Oligomer
cugaggugauaaacuccuc

SEQ ID NO: 11743 - RNA, 19 nt, Artificial Sequence
  RNA Oligomer
ucuccggguuguuuuccca

SEQ ID NO: 11744 - RNA, 19 nt, Artificial Sequence
  RNA Oligomer
ucuucaugguggaagcugc

SEQ ID NO: 11745 - RNA, 19 nt, Artificial Sequence
  RNA Oligomer
uguuucaggccgaacaugc

SEQ ID NO: 11746 - RNA, 19 nt, Artificial Sequence
  RNA Oligomer
agcaucgagauagcacuga

SEQ ID NO: 11747 - RNA, 19 nt, Artificial Sequence
  RNA Oligomer
uagaguuaacagaguugac

SEQ ID NO: 11748 - RNA, 19 nt, Artificial Sequence
  RNA Oligomer
aaguccacguacaaagggu

SEQ ID NO: 11749 - RNA, 19 nt, Artificial Sequence
  RNA Oligomer
ucaucuuggugcaaagacc

SEQ ID NO: 11750 - RNA, 19 nt, Artificial Sequence
  RNA Oligomer
aucuuggugcaaagaccug

SEQ ID NO: 11751 - RNA, 19 nt, Artificial Sequence
  RNA Oligomer
gucucuuggagacaccuug

SEQ ID NO: 11752 - RNA, 19 nt, Artificial Sequence
  RNA Oligomer
uccaccacgaauccauggu

SEQ ID NO: 11753 - RNA, 19 nt, Artificial Sequence
  RNA Oligomer
caccacgaauccaugguug

SEQ ID NO: 11754 - RNA, 19 nt, Artificial Sequence
  RNA Oligomer
guccaaaagucuggucacg

SEQ ID NO: 11755 - RNA, 19 nt, Artificial Sequence
  RNA Oligomer
uccaaaagucuggucacgg

SEQ ID NO: 11756 - RNA, 19 nt, Artificial Sequence
  RNA Oligomer
aggugauaaacuccuccgu

SEQ ID NO: 11757 - RNA, 19 nt, Artificial Sequence
  RNA Oligomer
acagaguugaccaacgucu

SEQ ID NO: 11758 - RNA, 19 nt, Artificial Sequence
  RNA Oligomer
gaaaagggcauucuccgug

SEQ ID NO: 11759 - RNA, 19 nt, Artificial Sequence
  RNA Oligomer
uuacagcuggacuuaaggc

SEQ ID NO: 11760 - RNA, 19 nt, Artificial Sequence
  RNA Oligomer
cuuggugcaaagaccugcu

SEQ ID NO: 11761 - RNA, 19 nt, Artificial Sequence
  RNA Oligomer
ugcaaagaccugcuuaucc

SEQ ID NO: 11762 - RNA, 19 nt, Artificial Sequence
  RNA Oligomer
accacgaauccaugguugg

SEQ ID NO: 11763 - RNA, 19 nt, Artificial Sequence
  RNA Oligomer
ggugacaucaaaacuuucc

SEQ ID NO: 11764 - RNA, 19 nt, Artificial Sequence
  RNA Oligomer
auucaccaaccuggugucc

SEQ ID NO: 11765 - RNA, 19 nt, Artificial Sequence
  RNA Oligomer
aucuguucucggaaaaccu

SEQ ID NO: 11766 - RNA, 19 nt, Artificial Sequence
  RNA Oligomer
ugauaaacuccuccguggg

SEQ ID NO: 11767 - RNA, 19 nt, Artificial Sequence
  RNA Oligomer
caacgucugaacaauggca

SEQ ID NO: 11768 - RNA, 19 nt, Artificial Sequence
  RNA Oligomer
aaaacucuggucaaaggac

SEQ ID NO: 11769 - RNA, 19 nt, Artificial Sequence
  RNA Oligomer
acgaauccaugguuggcgu

SEQ ID NO: 11770 - RNA, 19 nt, Artificial Sequence
  RNA Oligomer
ugcgcaaguuauucucccu

SEQ ID NO: 11771 - RNA, 19 nt, Artificial Sequence
  RNA Oligomer
uccaaagauucuucauggu

SEQ ID NO: 11772 - RNA, 19 nt, Artificial Sequence
  RNA Oligomer
agcaacgcuagaagacagc

SEQ ID NO: 11773 - RNA, 19 nt, Artificial Sequence
  RNA Oligomer
cacguccauugaaagagcg

SEQ ID NO: 11774 - RNA, 19 nt, Artificial Sequence
  RNA Oligomer
gaaagagcguccacaugga

SEQ ID NO: 11775 - RNA, 19 nt, Artificial Sequence
  RNA Oligomer
ggaguucagaugaucagcc

SEQ ID NO: 11776 - RNA, 19 nt, Artificial Sequence
  RNA Oligomer
gcuguguucaucuuggugc

SEQ ID NO: 11777 - RNA, 19 nt, Artificial Sequence
  RNA Oligomer
aagaagaaucuccggguug

SEQ ID NO: 11778 - RNA, 19 nt, Artificial Sequence
  RNA Oligomer
gauucuucaugguggaagc

SEQ ID NO: 11779 - RNA, 19 nt, Artificial Sequence
  RNA Oligomer
aacucuggucaaaggaccu

SEQ ID NO: 11780 - RNA, 19 nt, Artificial Sequence
  RNA Oligomer
aguccacguacaaagggug

SEQ ID NO: 11781 - RNA, 19 nt, Artificial Sequence
  RNA Oligomer
uggacuuaaggcguuuccg

SEQ ID NO: 11782 - RNA, 19 nt, Artificial Sequence
  RNA Oligomer
aggaugcccuuuuccauca

SEQ ID NO: 11783 - RNA, 19 nt, Artificial Sequence
  RNA Oligomer
uggucgaccuuuaggagac

SEQ ID NO: 11784 - RNA, 19 nt, Artificial Sequence
  RNA Oligomer
ccagcuguguucaucuugg

SEQ ID NO: 11785 - RNA, 19 nt, Artificial Sequence
  RNA Oligomer
uggagaggaugcccuuuuc

SEQ ID NO: 11786 - RNA, 19 nt, Artificial Sequence
  RNA Oligomer
cuguguucaucuuggugca

SEQ ID NO: 11787 - RNA, 19 nt, Artificial Sequence
  RNA Oligomer
uucaucuuggugcaaagac

SEQ ID NO: 11788 - RNA, 19 nt, Artificial Sequence
  RNA Oligomer
gaggaaaagggcauucucc

SEQ ID NO: 11789 - RNA, 19 nt, Artificial Sequence
  RNA Oligomer
aggaaaagggcauucuccg

SEQ ID NO: 11790 - RNA, 19 nt, Artificial Sequence
  RNA Oligomer
uuguuuccuaaagcaucuu

SEQ ID NO: 11791 - RNA, 19 nt, Artificial Sequence
  RNA Oligomer
gcggaguuuuaaacuuuaa

SEQ ID NO: 11792 - RNA, 19 nt, Artificial Sequence
  RNA Oligomer
ucagcuacauaaacaguuu

SEQ ID NO: 11793 - RNA, 19 nt, Artificial Sequence
  RNA Oligomer
gaaaaaaggugcuguagaa

SEQ ID NO: 11794 - RNA, 19 nt, Artificial Sequence
  RNA Oligomer
gccuuuucauuuuacuuca

SEQ ID NO: 11795 - RNA, 19 nt, Artificial Sequence
  RNA Oligomer
cagcuacauaaacaguuuu

SEQ ID NO: 11796 - RNA, 19 nt, Artificial Sequence
  RNA Oligomer
gucagcuacauaaacaguu

SEQ ID NO: 11797 - RNA, 19 nt, Artificial Sequence
  RNA Oligomer
ggauucaaagaacuuagau

SEQ ID NO: 11798 - RNA, 19 nt, Artificial Sequence
  RNA Oligomer
caauuguggagaagaaaaa

SEQ ID NO: 11799 - RNA, 19 nt, Artificial Sequence
  RNA Oligomer
gagaucuagauacaggcuu

SEQ ID NO: 11800 - RNA, 19 nt, Artificial Sequence
  RNA Oligomer
gcagcggaguuuuaaacuu

SEQ ID NO: 11801 - RNA, 19 nt, Artificial Sequence
  RNA Oligomer
cgaaccuacaucaucagua

SEQ ID NO: 11802 - RNA, 19 nt, Artificial Sequence
  RNA Oligomer
ccaucacuuuuucaucauu

SEQ ID NO: 11803 - RNA, 19 nt, Artificial Sequence
  RNA Oligomer
ccauccacuugcacaauau

SEQ ID NO: 11804 - RNA, 19 nt, Artificial Sequence
  RNA Oligomer
ucccuguguauccuauuau

SEQ ID NO: 11805 - RNA, 19 nt, Artificial Sequence
  RNA Oligomer
agcuacuacucacauucau

SEQ ID NO: 11806 - RNA, 19 nt, Artificial Sequence
  RNA Oligomer
ggcuuagaaaacacaaaga

SEQ ID NO: 11807 - RNA, 19 nt, Artificial Sequence
  RNA Oligomer
agaucuagauacaggcuug

SEQ ID NO: 11808 - RNA, 19 nt, Artificial Sequence
  RNA Oligomer
ggcuaauuacagugcagaa

SEQ ID NO: 11809 - RNA, 19 nt, Artificial Sequence
  RNA Oligomer
agcggaguuuuaaacuuua

SEQ ID NO: 11810 - RNA, 19 nt, Artificial Sequence
  RNA Oligomer
accagcaacuuugauguuu

SEQ ID NO: 11811 - RNA, 19 nt, Artificial Sequence
  RNA Oligomer
ggauacugguuuuguuaau

SEQ ID NO: 11812 - RNA, 19 nt, Artificial Sequence
  RNA Oligomer
cccuguguauccuauuaug

SEQ ID NO: 11813 - RNA, 19 nt, Artificial Sequence
  RNA Oligomer
cuaaaauguuuuucccugu

SEQ ID NO: 11814 - RNA, 19 nt, Artificial Sequence
  RNA Oligomer
gcccacagaauaagauuuu

SEQ ID NO: 11815 - RNA, 19 nt, Artificial Sequence
  RNA Oligomer
ucuagauacaggcuugaaa

SEQ ID NO: 11816 - RNA, 19 nt, Artificial Sequence
  RNA Oligomer
ggagaucuagauacaggcu

SEQ ID NO: 11817 - RNA, 19 nt, Artificial Sequence
  RNA Oligomer
ucauuuuacuucauccucc

SEQ ID NO: 11818 - RNA, 19 nt, Artificial Sequence
  RNA Oligomer
gggcuaauuacagugcaga

SEQ ID NO: 11819 - RNA, 19 nt, Artificial Sequence
  RNA Oligomer
caauucuucuugccgcaau

SEQ ID NO: 11820 - RNA, 19 nt, Artificial Sequence
  RNA Oligomer
cccuggccuugaauaucau

SEQ ID NO: 11821 - RNA, 19 nt, Artificial Sequence
  RNA Oligomer
cagcggaguuuuaaacuuu

SEQ ID NO: 11822 - RNA, 19 nt, Artificial Sequence
  RNA Oligomer
agcuacauaaacaguuuug

SEQ ID NO: 11823 - RNA, 19 nt, Artificial Sequence
  RNA Oligomer
cuauuauggauacugguuu

SEQ ID NO: 11824 - RNA, 19 nt, Artificial Sequence
  RNA Oligomer
ccuaaaauguuuuucccug

SEQ ID NO: 11825 - RNA, 19 nt, Artificial Sequence
  RNA Oligomer
ucauuccucagcuacuacu

SEQ ID NO: 11826 - RNA, 19 nt, Artificial Sequence
  RNA Oligomer
ucaauuguggagaagaaaa

SEQ ID NO: 11827 - RNA, 19 nt, Artificial Sequence
  RNA Oligomer
gcaaaacugggcuaauuac

SEQ ID NO: 11828 - RNA, 19 nt, Artificial Sequence
  RNA Oligomer
ggguccugcagaucauauu

SEQ ID NO: 11829 - RNA, 19 nt, Artificial Sequence
  RNA Oligomer
gcuacauaaacaguuuugu

SEQ ID NO: 11830 - RNA, 19 nt, Artificial Sequence
  RNA Oligomer
acagaagauuggugaaaau

SEQ ID NO: 11831 - RNA, 19 nt, Artificial Sequence
  RNA Oligomer
gccuuuuuuaaaacucauc

SEQ ID NO: 11832 - RNA, 19 nt, Artificial Sequence
  RNA Oligomer
ugaaccuuucucauggauu

SEQ ID NO: 11833 - RNA, 19 nt, Artificial Sequence
  RNA Oligomer
ccauuguuaaaauuugcac

SEQ ID NO: 11834 - RNA, 19 nt, Artificial Sequence
  RNA Oligomer
uggauucaaagaacuuaga

SEQ ID NO: 11835 - RNA, 19 nt, Artificial Sequence
  RNA Oligomer
gcuuagaaaacacaaagac

SEQ ID NO: 11836 - RNA, 19 nt, Artificial Sequence
  RNA Oligomer
gaggcuuagaaaacacaaa

SEQ ID NO: 11837 - RNA, 19 nt, Artificial Sequence
  RNA Oligomer
ccagguguuaauuuugauc

SEQ ID NO: 11838 - RNA, 19 nt, Artificial Sequence
  RNA Oligomer
agaaaaaaggugcuguaga

SEQ ID NO: 11839 - RNA, 19 nt, Artificial Sequence
  RNA Oligomer
gcacagccuuuugauuucc

SEQ ID NO: 11840 - RNA, 19 nt, Artificial Sequence
  RNA Oligomer
gggucucaaaaauaugcuu

SEQ ID NO: 11841 - RNA, 19 nt, Artificial Sequence
  RNA Oligomer
cugugggucucaaaaauau

SEQ ID NO: 11842 - RNA, 19 nt, Artificial Sequence
  RNA Oligomer
caaucucucaugugcgcuu

SEQ ID NO: 11843 - RNA, 19 nt, Artificial Sequence
  RNA Oligomer
cggucauguucagcuucau

SEQ ID NO: 11844 - RNA, 19 nt, Artificial Sequence
  RNA Oligomer
uggugaaaaugcugaguau

SEQ ID NO: 11845 - RNA, 19 nt, Artificial Sequence
  RNA Oligomer
ugaccagcaacuuugaugu

SEQ ID NO: 11846 - RNA, 19 nt, Artificial Sequence
  RNA Oligomer
ucauuaaugugagagacuu

SEQ ID NO: 11847 - RNA, 19 nt, Artificial Sequence
  RNA Oligomer
gcacacuuuuuuuuucucc

SEQ ID NO: 11848 - RNA, 19 nt, Artificial Sequence
  RNA Oligomer
agcagauacaguauaaacu

SEQ ID NO: 11849 - RNA, 19 nt, Artificial Sequence
  RNA Oligomer
ggugguaauuguggcuaaa

SEQ ID NO: 11850 - RNA, 19 nt, Artificial Sequence
  RNA Oligomer
cacaaagacauuagaauac

SEQ ID NO: 11851 - RNA, 19 nt, Artificial Sequence
  RNA Oligomer
accagguguuaauuuugau

SEQ ID NO: 11852 - RNA, 19 nt, Artificial Sequence
  RNA Oligomer
ugcaccagguguuaauuuu

SEQ ID NO: 11853 - RNA, 19 nt, Artificial Sequence
  RNA Oligomer
cucaauuguggagaagaaa

SEQ ID NO: 11854 - RNA, 19 nt, Artificial Sequence
  RNA Oligomer
caagauuccacucaauugu

SEQ ID NO: 11855 - RNA, 19 nt, Artificial Sequence
  RNA Oligomer
ugggcuaauuacagugcag

SEQ ID NO: 11856 - RNA, 19 nt, Artificial Sequence
  RNA Oligomer
cugggcuaauuacagugca

SEQ ID NO: 11857 - RNA, 19 nt, Artificial Sequence
  RNA Oligomer
guacgguauugaagagcau

SEQ ID NO: 11858 - RNA, 19 nt, Artificial Sequence
  RNA Oligomer
ccaaacagcagcggaguuu

SEQ ID NO: 11859 - RNA, 19 nt, Artificial Sequence
  RNA Oligomer
agaaguucaaguacgguau

SEQ ID NO: 11860 - RNA, 19 nt, Artificial Sequence
  RNA Oligomer
agcagauugagauaaagaa

SEQ ID NO: 11861 - RNA, 19 nt, Artificial Sequence
  RNA Oligomer
guugugaaaaugucugcua

SEQ ID NO: 11862 - RNA, 19 nt, Artificial Sequence
  RNA Oligomer
ugcauguaauguagaccua

SEQ ID NO: 11863 - RNA, 19 nt, Artificial Sequence
  RNA Oligomer
ggcugucaguacuuuucau

SEQ ID NO: 11864 - RNA, 19 nt, Artificial Sequence
  RNA Oligomer
caacuuugauguuugcacu

SEQ ID NO: 11865 - RNA, 19 nt, Artificial Sequence
  RNA Oligomer
gccuaaaugaauuuugcag

SEQ ID NO: 11866 - RNA, 19 nt, Artificial Sequence
  RNA Oligomer
gacuauuaaaugugccuaa

SEQ ID NO: 11867 - RNA, 19 nt, Artificial Sequence
  RNA Oligomer
acaggcuuuagucauuaau

SEQ ID NO: 11868 - RNA, 19 nt, Artificial Sequence
  RNA Oligomer
ugaugcuugaaugauagaa

SEQ ID NO: 11869 - RNA, 19 nt, Artificial Sequence
  RNA Oligomer
uucccuguguauccuauua

SEQ ID NO: 11870 - RNA, 19 nt, Artificial Sequence
  RNA Oligomer
aaauguuuuucccugugua

SEQ ID NO: 11871 - RNA, 19 nt, Artificial Sequence
  RNA Oligomer
gcuacuacucacauucauu

SEQ ID NO: 11872 - RNA, 19 nt, Artificial Sequence
  RNA Oligomer
accaucacuuuuucaucau

SEQ ID NO: 11873 - RNA, 19 nt, Artificial Sequence
  RNA Oligomer
acaauaucauuaccaucac

SEQ ID NO: 11874 - RNA, 19 nt, Artificial Sequence
  RNA Oligomer
cccacagaauaagauuuuc

SEQ ID NO: 11875 - RNA, 19 nt, Artificial Sequence
  RNA Oligomer
ggcccacagaauaagauuu

SEQ ID NO: 11876 - RNA, 19 nt, Artificial Sequence
  RNA Oligomer
ucuuaggucuuuucaacaa

SEQ ID NO: 11877 - RNA, 19 nt, Artificial Sequence
  RNA Oligomer
guggauucaaagaacuuag

SEQ ID NO: 11878 - RNA, 19 nt, Artificial Sequence
  RNA Oligomer
gguauuuaaaguaguggau

SEQ ID NO: 11879 - RNA, 19 nt, Artificial Sequence
  RNA Oligomer
acauuagaauaccuagguu

SEQ ID NO: 11880 - RNA, 19 nt, Artificial Sequence
  RNA Oligomer
caaagacauuagaauaccu

SEQ ID NO: 11881 - RNA, 19 nt, Artificial Sequence
  RNA Oligomer
aggcuuagaaaacacaaag

SEQ ID NO: 11882 - RNA, 19 nt, Artificial Sequence
  RNA Oligomer
gcagaacaaaaucgaaugg

SEQ ID NO: 11883 - RNA, 19 nt, Artificial Sequence
  RNA Oligomer
gcuaauuacagugcagaac

SEQ ID NO: 11884 - RNA, 19 nt, Artificial Sequence
  RNA Oligomer
ccuugaauaucauugaacu

SEQ ID NO: 11885 - RNA, 19 nt, Artificial Sequence
  RNA Oligomer
cacagaagauuggugaaaa

SEQ ID NO: 11886 - RNA, 19 nt, Artificial Sequence
  RNA Oligomer
gaacuauauguugaagaca

SEQ ID NO: 11887 - RNA, 19 nt, Artificial Sequence
  RNA Oligomer
acuuugauguuugcacuaa

SEQ ID NO: 11888 - RNA, 19 nt, Artificial Sequence
  RNA Oligomer
gaugcuugaaugauagaau

SEQ ID NO: 11889 - RNA, 19 nt, Artificial Sequence
  RNA Oligomer
aaaauguuuuucccugugu

SEQ ID NO: 11890 - RNA, 19 nt, Artificial Sequence
  RNA Oligomer
uaaaauguuuuucccugug

SEQ ID NO: 11891 - RNA, 19 nt, Artificial Sequence
  RNA Oligomer
uacaagcagauacaguaua

SEQ ID NO: 11892 - RNA, 19 nt, Artificial Sequence
  RNA Oligomer
gccaugcuuaauauuuaac

SEQ ID NO: 11893 - RNA, 19 nt, Artificial Sequence
  RNA Oligomer
uggacuugugcuacuauau

SEQ ID NO: 11894 - RNA, 19 nt, Artificial Sequence
  RNA Oligomer
gugguaauuguggcuaaau

SEQ ID NO: 11895 - RNA, 19 nt, Artificial Sequence
  RNA Oligomer
cgggugguaauuguggcua

SEQ ID NO: 11896 - RNA, 19 nt, Artificial Sequence
  RNA Oligomer
acauagauaagggcuuuuu

SEQ ID NO: 11897 - RNA, 19 nt, Artificial Sequence
  RNA Oligomer
guaguggauucaaagaacu

SEQ ID NO: 11898 - RNA, 19 nt, Artificial Sequence
  RNA Oligomer
guguuaauuuugauccggu

SEQ ID NO: 11899 - RNA, 19 nt, Artificial Sequence
  RNA Oligomer
caccagguguuaauuuuga

SEQ ID NO: 11900 - RNA, 19 nt, Artificial Sequence
  RNA Oligomer
gcaccagguguuaauuuug

SEQ ID NO: 11901 - RNA, 19 nt, Artificial Sequence
  RNA Oligomer
gugcagaacaaaaucgaau

SEQ ID NO: 11902 - RNA, 19 nt, Artificial Sequence
  RNA Oligomer
ggucucaaaaauaugcuua

SEQ ID NO: 11903 - RNA, 19 nt, Artificial Sequence
  RNA Oligomer
cagugguacaucuauggau

SEQ ID NO: 11904 - RNA, 19 nt, Artificial Sequence
  RNA Oligomer
ucaucaguauccucuucaa

SEQ ID NO: 11905 - RNA, 19 nt, Artificial Sequence
  RNA Oligomer
gcgaaccuacaucaucagu

SEQ ID NO: 11906 - RNA, 19 nt, Artificial Sequence
  RNA Oligomer
ugcgaaccuacaucaucag

SEQ ID NO: 11907 - RNA, 19 nt, Artificial Sequence
  RNA Oligomer
gaaguucaaguacgguauu

SEQ ID NO: 11908 - RNA, 19 nt, Artificial Sequence
  RNA Oligomer
gagauaaagaaguucaagu

SEQ ID NO: 11909 - RNA, 19 nt, Artificial Sequence
  RNA Oligomer
agaaacugaacaagaaaga

SEQ ID NO: 11910 - RNA, 19 nt, Artificial Sequence
  RNA Oligomer
agagaaacugaacaagaaa

SEQ ID NO: 11911 - RNA, 19 nt, Artificial Sequence
  RNA Oligomer
aaaaagcuuuuacgaggua

SEQ ID NO: 11912 - RNA, 19 nt, Artificial Sequence
  RNA Oligomer
uugugaaaaugucugcuau

SEQ ID NO: 11913 - RNA, 19 nt, Artificial Sequence
  RNA Oligomer
cugguugugaaaaugucug

SEQ ID NO: 11914 - RNA, 19 nt, Artificial Sequence
  RNA Oligomer
gacauuccauguuaaacua

SEQ ID NO: 11915 - RNA, 19 nt, Artificial Sequence
  RNA Oligomer
guguggcugucaguacuuu

SEQ ID NO: 11916 - RNA, 19 nt, Artificial Sequence
  RNA Oligomer
uaaugugagagacuuagaa

SEQ ID NO: 11917 - RNA, 19 nt, Artificial Sequence
  RNA Oligomer
guaaucauugaugcuugaa

SEQ ID NO: 11918 - RNA, 19 nt, Artificial Sequence
  RNA Oligomer
ccuauuauggauacugguu

SEQ ID NO: 11919 - RNA, 19 nt, Artificial Sequence
  RNA Oligomer
agcacacuuuuuuuuucuc

SEQ ID NO: 11920 - RNA, 19 nt, Artificial Sequence
  RNA Oligomer
caauaucauuaccaucacu

SEQ ID NO: 11921 - RNA, 19 nt, Artificial Sequence
  RNA Oligomer
uccacuugcacaauaucau

SEQ ID NO: 11922 - RNA, 19 nt, Artificial Sequence
  RNA Oligomer
ccacagaauaagauuuucc

SEQ ID NO: 11923 - RNA, 19 nt, Artificial Sequence
  RNA Oligomer
auggacuugugcuacuaua

SEQ ID NO: 11924 - RNA, 19 nt, Artificial Sequence
  RNA Oligomer
ccuuaagucccugcuaaaa

SEQ ID NO: 11925 - RNA, 19 nt, Artificial Sequence
  RNA Oligomer
uccuuaagucccugcuaaa

SEQ ID NO: 11926 - RNA, 19 nt, Artificial Sequence
  RNA Oligomer
ucaacaagaaaaagacaga

SEQ ID NO: 11927 - RNA, 19 nt, Artificial Sequence
  RNA Oligomer
aguggauucaaagaacuua

SEQ ID NO: 11928 - RNA, 19 nt, Artificial Sequence
  RNA Oligomer
aggugcauguugguauuua

SEQ ID NO: 11929 - RNA, 19 nt, Artificial Sequence
  RNA Oligomer
acaaagacauuagaauacc

SEQ ID NO: 11930 - RNA, 19 nt, Artificial Sequence
  RNA Oligomer
ucaugaggcuuagaaaaca

SEQ ID NO: 11931 - RNA, 19 nt, Artificial Sequence
  RNA Oligomer
gugcaccagguguuaauuu

SEQ ID NO: 11932 - RNA, 19 nt, Artificial Sequence
  RNA Oligomer
cuaauuacagugcagaaca

SEQ ID NO: 11933 - RNA, 19 nt, Artificial Sequence
  RNA Oligomer
ucccuggccuugaauauca

SEQ ID NO: 11934 - RNA, 19 nt, Artificial Sequence
  RNA Oligomer
ucaucuucaugcugguggu

SEQ ID NO: 11935 - RNA, 19 nt, Artificial Sequence
  RNA Oligomer
ugcugauccagugguacau

SEQ ID NO: 11936 - RNA, 19 nt, Artificial Sequence
  RNA Oligomer
guauccucuucaagucuau

SEQ ID NO: 11937 - RNA, 19 nt, Artificial Sequence
  RNA Oligomer
caaguacgguauugaagag

SEQ ID NO: 11938 - RNA, 19 nt, Artificial Sequence
  RNA Oligomer
gcagauugagauaaagaag

SEQ ID NO: 11939 - RNA, 19 nt, Artificial Sequence
  RNA Oligomer
uccugcagaucauauuugu

SEQ ID NO: 11940 - RNA, 19 nt, Artificial Sequence
  RNA Oligomer
guccugcagaucauauuug

SEQ ID NO: 11941 - RNA, 19 nt, Artificial Sequence
  RNA Oligomer
gguccugcagaucauauuu

SEQ ID NO: 11942 - RNA, 19 nt, Artificial Sequence
  RNA Oligomer
gucuuucccaaucucucau

SEQ ID NO: 11943 - RNA, 19 nt, Artificial Sequence
  RNA Oligomer
gugaaaaugucugcuauga

SEQ ID NO: 11944 - RNA, 19 nt, Artificial Sequence
  RNA Oligomer
gguugugaaaaugucugcu

SEQ ID NO: 11945 - RNA, 19 nt, Artificial Sequence
  RNA Oligomer
accugguugugaaaauguc

SEQ ID NO: 11946 - RNA, 19 nt, Artificial Sequence
  RNA Oligomer
ucuggagaguguucuuuau

SEQ ID NO: 11947 - RNA, 19 nt, Artificial Sequence
  RNA Oligomer
ccuaguccaucagaucaug

SEQ ID NO: 11948 - RNA, 19 nt, Artificial Sequence
  RNA Oligomer
cuacggucauguucagcuu

SEQ ID NO: 11949 - RNA, 19 nt, Artificial Sequence
  RNA Oligomer
gcugucaguacuuuucauu

SEQ ID NO: 11950 - RNA, 19 nt, Artificial Sequence
  RNA Oligomer
ugaaaaugcugaguaugac

SEQ ID NO: 11951 - RNA, 19 nt, Artificial Sequence
  RNA Oligomer
uuggugaaaaugcugagua

SEQ ID NO: 11952 - RNA, 19 nt, Artificial Sequence
  RNA Oligomer
cugguauucuuggguuuuc

SEQ ID NO: 11953 - RNA, 19 nt, Artificial Sequence
  RNA Oligomer
ugcaguaacugguauucuu

SEQ ID NO: 11954 - RNA, 19 nt, Artificial Sequence
  RNA Oligomer
aggcuuuagucauuaaugu

SEQ ID NO: 11955 - RNA, 19 nt, Artificial Sequence
  RNA Oligomer
uaaacaggcuuuagucauu

SEQ ID NO: 11956 - RNA, 19 nt, Artificial Sequence
  RNA Oligomer
cauugaugcuugaaugaua

SEQ ID NO: 11957 - RNA, 19 nt, Artificial Sequence
  RNA Oligomer
ucgaagaguuuguuuuguu

SEQ ID NO: 11958 - RNA, 19 nt, Artificial Sequence
  RNA Oligomer
auaugugugucgaagaguu

SEQ ID NO: 11959 - RNA, 19 nt, Artificial Sequence
  RNA Oligomer
cacuugcacaauaucauua

SEQ ID NO: 11960 - RNA, 19 nt, Artificial Sequence
  RNA Oligomer
gaaaaagacagaggauugu

SEQ ID NO: 11961 - RNA, 19 nt, Artificial Sequence
  RNA Oligomer
uaagaaugguucuguguau

SEQ ID NO: 11962 - RNA, 19 nt, Artificial Sequence
  RNA Oligomer
gugcauguugguauuuaaa

SEQ ID NO: 11963 - RNA, 19 nt, Artificial Sequence
  RNA Oligomer
ugaggcuuagaaaacacaa

SEQ ID NO: 11964 - RNA, 19 nt, Artificial Sequence
  RNA Oligomer
uuauucaugaggcuuagaa

SEQ ID NO: 11965 - RNA, 19 nt, Artificial Sequence
  RNA Oligomer
agguguuaauuuugauccg

SEQ ID NO: 11966 - RNA, 19 nt, Artificial Sequence
  RNA Oligomer
aaaacuagcugcuggacau

SEQ ID NO: 11967 - RNA, 19 nt, Artificial Sequence
  RNA Oligomer
ugcagaacaaaaucgaaug

SEQ ID NO: 11968 - RNA, 19 nt, Artificial Sequence
  RNA Oligomer
ccuggccuugaauaucauu

SEQ ID NO: 11969 - RNA, 19 nt, Artificial Sequence
  RNA Oligomer
ccaucuucaucaucuucau

SEQ ID NO: 11970 - RNA, 19 nt, Artificial Sequence
  RNA Oligomer
agugguacaucuauggauu

SEQ ID NO: 11971 - RNA, 19 nt, Artificial Sequence
  RNA Oligomer
uccucuucaagucuaucuu

SEQ ID NO: 11972 - RNA, 19 nt, Artificial Sequence
  RNA Oligomer
cagauugagauaaagaagu

SEQ ID NO: 11973 - RNA, 19 nt, Artificial Sequence
  RNA Oligomer
aaaagcuuuuacgagguau

SEQ ID NO: 11974 - RNA, 19 nt, Artificial Sequence
  RNA Oligomer
gagaaacugaacaagaaag

SEQ ID NO: 11975 - RNA, 19 nt, Artificial Sequence
  RNA Oligomer
cugcagaucauauuugugu

SEQ ID NO: 11976 - RNA, 19 nt, Artificial Sequence
  RNA Oligomer
gagaguguucuuuauucaa

SEQ ID NO: 11977 - RNA, 19 nt, Artificial Sequence
  RNA Oligomer
cuggagaguguucuuuauu

SEQ ID NO: 11978 - RNA, 19 nt, Artificial Sequence
  RNA Oligomer
gcauguaauguagaccuag

SEQ ID NO: 11979 - RNA, 19 nt, Artificial Sequence
  RNA Oligomer
acggucauguucagcuuca

SEQ ID NO: 11980 - RNA, 19 nt, Artificial Sequence
  RNA Oligomer
gucaguacuuuucauuuuc

SEQ ID NO: 11981 - RNA, 19 nt, Artificial Sequence
  RNA Oligomer
cuuuucuucuugcaugcau

SEQ ID NO: 11982 - RNA, 19 nt, Artificial Sequence
  RNA Oligomer
gaagauuggugaaaaugcu

SEQ ID NO: 11983 - RNA, 19 nt, Artificial Sequence
  RNA Oligomer
gguguggcugucaguacuu

SEQ ID NO: 11984 - RNA, 19 nt, Artificial Sequence
  RNA Oligomer
cuuugauguuugcacuaag

SEQ ID NO: 11985 - RNA, 19 nt, Artificial Sequence
  RNA Oligomer
ugugagagacuuagaaaaa

SEQ ID NO: 11986 - RNA, 19 nt, Artificial Sequence
  RNA Oligomer
augugagagacuuagaaaa

SEQ ID NO: 11987 - RNA, 19 nt, Artificial Sequence
  RNA Oligomer
guaaacaggcuuuagucau

SEQ ID NO: 11988 - RNA, 19 nt, Artificial Sequence
  RNA Oligomer
caagcagauacaguauaaa

SEQ ID NO: 11989 - RNA, 19 nt, Artificial Sequence
  RNA Oligomer
acaagcagauacaguauaa

SEQ ID NO: 11990 - RNA, 19 nt, Artificial Sequence
  RNA Oligomer
gugucgaagaguuuguuuu

SEQ ID NO: 11991 - RNA, 19 nt, Artificial Sequence
  RNA Oligomer
caacaagaaaaagacagag

SEQ ID NO: 11992 - RNA, 19 nt, Artificial Sequence
  RNA Oligomer
agaggugcauguugguauu

SEQ ID NO: 11993 - RNA, 19 nt, Artificial Sequence
  RNA Oligomer
gguguuaauuuugauccgg

SEQ ID NO: 11994 - RNA, 19 nt, Artificial Sequence
  RNA Oligomer
aagugcaccagguguuaau

SEQ ID NO: 11995 - RNA, 19 nt, Artificial Sequence
  RNA Oligomer
gcaccaucucuaacuccca

SEQ ID NO: 11996 - RNA, 19 nt, Artificial Sequence
  RNA Oligomer
cagugcagaacaaaaucga

SEQ ID NO: 11997 - RNA, 19 nt, Artificial Sequence
  RNA Oligomer
ugggucucaaaaauaugcu

SEQ ID NO: 11998 - RNA, 19 nt, Artificial Sequence
  RNA Oligomer
ggucugagugccugaacuu

SEQ ID NO: 11999 - RNA, 19 nt, Artificial Sequence
  RNA Oligomer
ggguuaagggaaagagcga

SEQ ID NO: 12000 - RNA, 19 nt, Artificial Sequence
  RNA Oligomer
cuggccuugaauaucauug

SEQ ID NO: 12001 - RNA, 19 nt, Artificial Sequence
  RNA Oligomer
acaucuauggauucagcuu

SEQ ID NO: 12002 - RNA, 19 nt, Artificial Sequence
  RNA Oligomer
gguacaucuauggauucag

SEQ ID NO: 12003 - RNA, 19 nt, Artificial Sequence
  RNA Oligomer
ugguacaucuauggauuca

SEQ ID NO: 12004 - RNA, 19 nt, Artificial Sequence
  RNA Oligomer
ccagugguacaucuaugga

SEQ ID NO: 12005 - RNA, 19 nt, Artificial Sequence
  RNA Oligomer
cuaucuuugagguggccuu

SEQ ID NO: 12006 - RNA, 19 nt, Artificial Sequence
  RNA Oligomer
ccucuucaagucuaucuuu

SEQ ID NO: 12007 - RNA, 19 nt, Artificial Sequence
  RNA Oligomer
acagcagcggaguuuuaaa

SEQ ID NO: 12008 - RNA, 19 nt, Artificial Sequence
  RNA Oligomer
uugaagcagauugagauaa

SEQ ID NO: 12009 - RNA, 19 nt, Artificial Sequence
  RNA Oligomer
gcacuugaagcagauugag

SEQ ID NO: 12010 - RNA, 19 nt, Artificial Sequence
  RNA Oligomer
ggaaggcgugaggaaagua

SEQ ID NO: 12011 - RNA, 19 nt, Artificial Sequence
  RNA Oligomer
gucugccuuucguuguaac

SEQ ID NO: 12012 - RNA, 19 nt, Artificial Sequence
  RNA Oligomer
agucugccuuucguuguaa

SEQ ID NO: 12013 - RNA, 19 nt, Artificial Sequence
  RNA Oligomer
ggucauguucagcuucauu

SEQ ID NO: 12014 - RNA, 19 nt, Artificial Sequence
  RNA Oligomer
ugacauuccauguuaaacu

SEQ ID NO: 12015 - RNA, 19 nt, Artificial Sequence
  RNA Oligomer
uguuugacauuccauguua

SEQ ID NO: 12016 - RNA, 19 nt, Artificial Sequence
  RNA Oligomer
gugaaaaugcugaguauga

SEQ ID NO: 12017 - RNA, 19 nt, Artificial Sequence
  RNA Oligomer
agauuggugaaaaugcuga

SEQ ID NO: 12018 - RNA, 19 nt, Artificial Sequence
  RNA Oligomer
uucuccaaaugccuuuuuu

SEQ ID NO: 12019 - RNA, 19 nt, Artificial Sequence
  RNA Oligomer
cuaccaguuucuccaaaug

SEQ ID NO: 12020 - RNA, 19 nt, Artificial Sequence
  RNA Oligomer
gagacuuagaaaaaaugcu

SEQ ID NO: 12021 - RNA, 19 nt, Artificial Sequence
  RNA Oligomer
gcuuuagucauuaauguga

SEQ ID NO: 12022 - RNA, 19 nt, Artificial Sequence
  RNA Oligomer
aacaggcuuuagucauuaa

SEQ ID NO: 12023 - RNA, 19 nt, Artificial Sequence
  RNA Oligomer
gugugucgaagaguuuguu

SEQ ID NO: 12024 - RNA, 19 nt, Artificial Sequence
  RNA Oligomer
gcuaaagucagggaaucaa

SEQ ID NO: 12025 - RNA, 19 nt, Artificial Sequence
  RNA Oligomer
cacuuuuucaucauuccuc

SEQ ID NO: 12026 - RNA, 19 nt, Artificial Sequence
  RNA Oligomer
caucacuuuuucaucauuc

SEQ ID NO: 12027 - RNA, 19 nt, Artificial Sequence
  RNA Oligomer
ucauuaccaucacuuuuuc

SEQ ID NO: 12028 - RNA, 19 nt, Artificial Sequence
  RNA Oligomer
auauucuuuuuccauccac

SEQ ID NO: 12029 - RNA, 19 nt, Artificial Sequence
  RNA Oligomer
gcuaaaacauuccauuguu

SEQ ID NO: 12030 - RNA, 19 nt, Artificial Sequence
  RNA Oligomer
guuuuaccaagaaacugaa

SEQ ID NO: 12031 - RNA, 19 nt, Artificial Sequence
  RNA Oligomer
cuaagaaugguucugugua

SEQ ID NO: 12032 - RNA, 19 nt, Artificial Sequence
  RNA Oligomer
ggugauacauagauaaggg

SEQ ID NO: 12033 - RNA, 19 nt, Artificial Sequence
  RNA Oligomer
ugguauuuaaaguagugga

SEQ ID NO: 12034 - RNA, 19 nt, Artificial Sequence
  RNA Oligomer
acuagcugcuggacaugaa

SEQ ID NO: 12035 - RNA, 19 nt, Artificial Sequence
  RNA Oligomer
ucaagucuaucuuugaggu

SEQ ID NO: 12036 - RNA, 19 nt, Artificial Sequence
  RNA Oligomer
cucuucaagucuaucuuug

SEQ ID NO: 12037 - RNA, 19 nt, Artificial Sequence
  RNA Oligomer
cagcagcggaguuuuaaac

SEQ ID NO: 12038 - RNA, 19 nt, Artificial Sequence
  RNA Oligomer
acaucaucaguauccucuu

SEQ ID NO: 12039 - RNA, 19 nt, Artificial Sequence
  RNA Oligomer
cugauggugucaaugugga

SEQ ID NO: 12040 - RNA, 19 nt, Artificial Sequence
  RNA Oligomer
ugcagaucauauuuguguc

SEQ ID NO: 12041 - RNA, 19 nt, Artificial Sequence
  RNA Oligomer
guucuggagaguguucuuu

SEQ ID NO: 12042 - RNA, 19 nt, Artificial Sequence
  RNA Oligomer
cauguaauguagaccuagu

SEQ ID NO: 12043 - RNA, 19 nt, Artificial Sequence
  RNA Oligomer
uuguuugacauuccauguu

SEQ ID NO: 12044 - RNA, 19 nt, Artificial Sequence
  RNA Oligomer
ucaguacuuuucauuuucc

SEQ ID NO: 12045 - RNA, 19 nt, Artificial Sequence
  RNA Oligomer
guggcugucaguacuuuuc

SEQ ID NO: 12046 - RNA, 19 nt, Artificial Sequence
  RNA Oligomer
ucuaccaguuucuccaaau

SEQ ID NO: 12047 - RNA, 19 nt, Artificial Sequence
  RNA Oligomer
agguguggcugucaguacu

SEQ ID NO: 12048 - RNA, 19 nt, Artificial Sequence
  RNA Oligomer
aacugguauucuuggguuu

SEQ ID NO: 12049 - RNA, 19 nt, Artificial Sequence
  RNA Oligomer
uaacugguauucuuggguu

SEQ ID NO: 12050 - RNA, 19 nt, Artificial Sequence
  RNA Oligomer
gcaguaacugguauucuug

SEQ ID NO: 12051 - RNA, 19 nt, Artificial Sequence
  RNA Oligomer
ggcuuuagucauuaaugug

SEQ ID NO: 12052 - RNA, 19 nt, Artificial Sequence
  RNA Oligomer
gaaauguaaucauugaugc

SEQ ID NO: 12053 - RNA, 19 nt, Artificial Sequence
  RNA Oligomer
uuaggauauagcaguaaug

SEQ ID NO: 12054 - RNA, 19 nt, Artificial Sequence
  RNA Oligomer
gucgaagaguuuguuuugu

SEQ ID NO: 12055 - RNA, 19 nt, Artificial Sequence
  RNA Oligomer
gaaugagcgggugguaauu

SEQ ID NO: 12056 - RNA, 19 nt, Artificial Sequence
  RNA Oligomer
caaaagagaucccugccca

SEQ ID NO: 12057 - RNA, 19 nt, Artificial Sequence
  RNA Oligomer
guacaucuauggauucagc

SEQ ID NO: 12058 - RNA, 19 nt, Artificial Sequence
  RNA Oligomer
ucuugcugauccaguggua

SEQ ID NO: 12059 - RNA, 19 nt, Artificial Sequence
  RNA Oligomer
aguauccucuucaagucua

SEQ ID NO: 12060 - RNA, 19 nt, Artificial Sequence
  RNA Oligomer
ucaguauccucuucaaguc

SEQ ID NO: 12061 - RNA, 19 nt, Artificial Sequence
  RNA Oligomer
acuugaagcagauugagau

SEQ ID NO: 12062 - RNA, 19 nt, Artificial Sequence
  RNA Oligomer
uggguccugcagaucauau

SEQ ID NO: 12063 - RNA, 19 nt, Artificial Sequence
  RNA Oligomer
gucauguucagcuucauug

SEQ ID NO: 12064 - RNA, 19 nt, Artificial Sequence
  RNA Oligomer
guuugacauuccauguuaa

SEQ ID NO: 12065 - RNA, 19 nt, Artificial Sequence
  RNA Oligomer
cugucaguacuuuucauuu

SEQ ID NO: 12066 - RNA, 19 nt, Artificial Sequence
  RNA Oligomer
agaggauucaguaguacac

SEQ ID NO: 12067 - RNA, 19 nt, Artificial Sequence
  RNA Oligomer
caggcuuuagucauuaaug

SEQ ID NO: 12068 - RNA, 19 nt, Artificial Sequence
  RNA Oligomer
gugggccaauaugguguuu

SEQ ID NO: 12069 - RNA, 19 nt, Artificial Sequence
  RNA Oligomer
aaacucacaaacacagauu

SEQ ID NO: 12070 - RNA, 19 nt, Artificial Sequence
  RNA Oligomer
cagggaaucaagccaugcu

SEQ ID NO: 12071 - RNA, 19 nt, Artificial Sequence
  RNA Oligomer
ucacuuuuucaucauuccu

SEQ ID NO: 12072 - RNA, 19 nt, Artificial Sequence
  RNA Oligomer
aagaaaaagacagaggauu

SEQ ID NO: 12073 - RNA, 19 nt, Artificial Sequence
  RNA Oligomer
ugguucuguguaugugaau

SEQ ID NO: 12074 - RNA, 19 nt, Artificial Sequence
  RNA Oligomer
uacauagauaagggcuuuu

SEQ ID NO: 12075 - RNA, 19 nt, Artificial Sequence
  RNA Oligomer
gauacauagauaagggcuu

SEQ ID NO: 12076 - RNA, 19 nt, Artificial Sequence
  RNA Oligomer
guugguauuuaaaguagug

SEQ ID NO: 12077 - RNA, 19 nt, Artificial Sequence
  RNA Oligomer
gaggugcauguugguauuu

SEQ ID NO: 12078 - RNA, 19 nt, Artificial Sequence
  RNA Oligomer
gggaagcaccaucucuaac

SEQ ID NO: 12079 - RNA, 19 nt, Artificial Sequence
  RNA Oligomer
guuuucuucaagggcguua

SEQ ID NO: 12080 - RNA, 19 nt, Artificial Sequence
  RNA Oligomer
ccuucuugcugauccagug

SEQ ID NO: 12081 - RNA, 19 nt, Artificial Sequence
  RNA Oligomer
gccuucuugcugauccagu

SEQ ID NO: 12082 - RNA, 19 nt, Artificial Sequence
  RNA Oligomer
gaaggcgugaggaaaguac

SEQ ID NO: 12083 - RNA, 19 nt, Artificial Sequence
  RNA Oligomer
cauguuaaacuacggucau

SEQ ID NO: 12084 - RNA, 19 nt, Artificial Sequence
  RNA Oligomer
uuucuccaaaugccuuuuu

SEQ ID NO: 12085 - RNA, 19 nt, Artificial Sequence
  RNA Oligomer
guaacugguauucuugggu

SEQ ID NO: 12086 - RNA, 19 nt, Artificial Sequence
  RNA Oligomer
gaauuuugcaguaacuggu

SEQ ID NO: 12087 - RNA, 19 nt, Artificial Sequence
  RNA Oligomer
gaguggacuauuaaaugug

SEQ ID NO: 12088 - RNA, 19 nt, Artificial Sequence
  RNA Oligomer
uuauauaauuccugcugug

SEQ ID NO: 12089 - RNA, 19 nt, Artificial Sequence
  RNA Oligomer
cauuauauaauuccugcug

SEQ ID NO: 12090 - RNA, 19 nt, Artificial Sequence
  RNA Oligomer
uaaacucacaaacacagau

SEQ ID NO: 12091 - RNA, 19 nt, Artificial Sequence
  RNA Oligomer
cguauauucuuuuuccauc

SEQ ID NO: 12092 - RNA, 19 nt, Artificial Sequence
  RNA Oligomer
gcauuugcaaauacguaua

SEQ ID NO: 12093 - RNA, 19 nt, Artificial Sequence
  RNA Oligomer
aggcccacagaauaagauu

SEQ ID NO: 12094 - RNA, 19 nt, Artificial Sequence
  RNA Oligomer
guucuguguaugugaauga

SEQ ID NO: 12095 - RNA, 19 nt, Artificial Sequence
  RNA Oligomer
gguucuguguaugugaaug

SEQ ID NO: 12096 - RNA, 19 nt, Artificial Sequence
  RNA Oligomer
augguucuguguaugugaa

SEQ ID NO: 12097 - RNA, 19 nt, Artificial Sequence
  RNA Oligomer
agaaugguucuguguaugu

SEQ ID NO: 12098 - RNA, 19 nt, Artificial Sequence
  RNA Oligomer
agaauaccuagguucacug

SEQ ID NO: 12099 - RNA, 19 nt, Artificial Sequence
  RNA Oligomer
gcuuauuucaauggcugcu

SEQ ID NO: 12100 - RNA, 19 nt, Artificial Sequence
  RNA Oligomer
gccuugaauaucauugaac

SEQ ID NO: 12101 - RNA, 19 nt, Artificial Sequence
  RNA Oligomer
ggguuuuccuacuuaauac

SEQ ID NO: 12102 - RNA, 19 nt, Artificial Sequence
  RNA Oligomer
gugagagacuuagaaaaaa

SEQ ID NO: 12103 - RNA, 19 nt, Artificial Sequence
  RNA Oligomer
cucuccuuuuuuuaggaua

SEQ ID NO: 12104 - RNA, 19 nt, Artificial Sequence
  RNA Oligomer
aacucacaaacacagauuu

SEQ ID NO: 12105 - RNA, 19 nt, Artificial Sequence
  RNA Oligomer
gucagggaaucaagccaug

SEQ ID NO: 12106 - RNA, 19 nt, Artificial Sequence
  RNA Oligomer
agucagggaaucaagccau

SEQ ID NO: 12107 - RNA, 19 nt, Artificial Sequence
  RNA Oligomer
acucaagguugcccaaacu

SEQ ID NO: 12108 - RNA, 19 nt, Artificial Sequence
  RNA Oligomer
gccuuucguuguaacacuc

SEQ ID NO: 12109 - RNA, 19 nt, Artificial Sequence
  RNA Oligomer
augcaugucagcuacauaa

SEQ ID NO: 12110 - RNA, 19 nt, Artificial Sequence
  RNA Oligomer
agagagguugaaagaggau

SEQ ID NO: 12111 - RNA, 19 nt, Artificial Sequence
  RNA Oligomer
gcaagagagguugaaagag

SEQ ID NO: 12112 - RNA, 19 nt, Artificial Sequence
  RNA Oligomer
guacuguaaacaggcuuua

SEQ ID NO: 12113 - RNA, 19 nt, Artificial Sequence
  RNA Oligomer
cacacuuuuuuuuucuccu

SEQ ID NO: 12114 - RNA, 19 nt, Artificial Sequence
  RNA Oligomer
uccaugcauuugcaaauac

SEQ ID NO: 12115 - RNA, 19 nt, Artificial Sequence
  RNA Oligomer
guaugugaaugagcgggug

SEQ ID NO: 12116 - RNA, 19 nt, Artificial Sequence
  RNA Oligomer
uuacagugcagaacaaaau

SEQ ID NO: 12117 - RNA, 19 nt, Artificial Sequence
  RNA Oligomer
ggaagagaaacugaacaag

SEQ ID NO: 12118 - RNA, 19 nt, Artificial Sequence
  RNA Oligomer
aggaagagaaacugaacaa

SEQ ID NO: 12119 - RNA, 19 nt, Artificial Sequence
  RNA Oligomer
gcaugucagcuacauaaac

SEQ ID NO: 12120 - RNA, 19 nt, Artificial Sequence
  RNA Oligomer
uuccaugcauuugcaaaua

SEQ ID NO: 12121 - RNA, 19 nt, Artificial Sequence
  RNA Oligomer
ugcuaaaacauuccauugu

SEQ ID NO: 12122 - RNA, 19 nt, Artificial Sequence
  RNA Oligomer
uggccuugaauaucauuga

SEQ ID NO: 12123 - RNA, 19 nt, Artificial Sequence
  RNA Oligomer
ugauguuugcacuaagauu

SEQ ID NO: 12124 - RNA, 19 nt, Artificial Sequence
  RNA Oligomer
uuaugaguuuagcagucuu

SEQ ID NO: 12125 - RNA, 19 nt, Artificial Sequence
  RNA Oligomer
gguuuuccuacuuaauaca

SEQ ID NO: 12126 - RNA, 19 nt, Artificial Sequence
  RNA Oligomer
acaguauaaacucacaaac

SEQ ID NO: 12127 - RNA, 19 nt, Artificial Sequence
  RNA Oligomer
guauauucuuuuuccaucc

SEQ ID NO: 12128 - RNA, 19 nt, Artificial Sequence
  RNA Oligomer
gcacuuugaagguaagcuu

SEQ ID NO: 12129 - RNA, 19 nt, Artificial Sequence
  RNA Oligomer
cccugcuaaaacauuccau

SEQ ID NO: 12130 - RNA, 19 nt, Artificial Sequence
  RNA Oligomer
gacagaggauuguccuuaa

SEQ ID NO: 12131 - RNA, 19 nt, Artificial Sequence
  RNA Oligomer
gaguuccauuaggugauac

SEQ ID NO: 12132 - RNA, 19 nt, Artificial Sequence
  RNA Oligomer
caaagacugugggucucaa

SEQ ID NO: 12133 - RNA, 19 nt, Artificial Sequence
  RNA Oligomer
ucaugcuggugguguccuu

SEQ ID NO: 12134 - RNA, 19 nt, Artificial Sequence
  RNA Oligomer
aaaccaucuucaucaucuu

SEQ ID NO: 12135 - RNA, 19 nt, Artificial Sequence
  RNA Oligomer
acaagucuuucccaaucuc

SEQ ID NO: 12136 - RNA, 19 nt, Artificial Sequence
  RNA Oligomer
ugccuuucguuguaacacu

SEQ ID NO: 12137 - RNA, 19 nt, Artificial Sequence
  RNA Oligomer
ugcaugucagcuacauaaa

SEQ ID NO: 12138 - RNA, 19 nt, Artificial Sequence
  RNA Oligomer
cuccaaaugccuuuuuuaa

SEQ ID NO: 12139 - RNA, 19 nt, Artificial Sequence
  RNA Oligomer
ccuaaaugaauuuugcagu

SEQ ID NO: 12140 - RNA, 19 nt, Artificial Sequence
  RNA Oligomer
agauacaguauaaacucac

SEQ ID NO: 12141 - RNA, 19 nt, Artificial Sequence
  RNA Oligomer
cagauacaguauaaacuca

SEQ ID NO: 12142 - RNA, 19 nt, Artificial Sequence
  RNA Oligomer
caaucacuuauaugugugu

SEQ ID NO: 12143 - RNA, 19 nt, Artificial Sequence
  RNA Oligomer
ucagcuacuacucacauuc

SEQ ID NO: 12144 - RNA, 19 nt, Artificial Sequence
  RNA Oligomer
ccucagcuacuacucacau

SEQ ID NO: 12145 - RNA, 19 nt, Artificial Sequence
  RNA Oligomer
ggucuuuucaacaagaaaa

SEQ ID NO: 12146 - RNA, 19 nt, Artificial Sequence
  RNA Oligomer
aaguaguggauucaaagaa

SEQ ID NO: 12147 - RNA, 19 nt, Artificial Sequence
  RNA Oligomer
cuugccuuuucauuuuacu

SEQ ID NO: 12148 - RNA, 19 nt, Artificial Sequence
  RNA Oligomer
acuugccuuuucauuuuac

SEQ ID NO: 12149 - RNA, 19 nt, Artificial Sequence
  RNA Oligomer
accaucuucaucaucuuca

SEQ ID NO: 12150 - RNA, 19 nt, Artificial Sequence
  RNA Oligomer
ggcgugaggaaaguaccaa

SEQ ID NO: 12151 - RNA, 19 nt, Artificial Sequence
  RNA Oligomer
acacucagcaaccugguug

SEQ ID NO: 12152 - RNA, 19 nt, Artificial Sequence
  RNA Oligomer
guccaucagaucauguguu

SEQ ID NO: 12153 - RNA, 19 nt, Artificial Sequence
  RNA Oligomer
cagcuucauugcauguaau

SEQ ID NO: 12154 - RNA, 19 nt, Artificial Sequence
  RNA Oligomer
cuugcaugcaugucagcua

SEQ ID NO: 12155 - RNA, 19 nt, Artificial Sequence
  RNA Oligomer
uguaaucauugaugcuuga

SEQ ID NO: 12156 - RNA, 19 nt, Artificial Sequence
  RNA Oligomer
ccugcuaaaacauuccauu

SEQ ID NO: 12157 - RNA, 19 nt, Artificial Sequence
  RNA Oligomer
ggauuguccuuaagucccu

SEQ ID NO: 12158 - RNA, 19 nt, Artificial Sequence
  RNA Oligomer
acagaggauuguccuuaag

SEQ ID NO: 12159 - RNA, 19 nt, Artificial Sequence
  RNA Oligomer
aggucuuuucaacaagaaa

SEQ ID NO: 12160 - RNA, 19 nt, Artificial Sequence
  RNA Oligomer
ugagcaaaacugggcuaau

SEQ ID NO: 12161 - RNA, 19 nt, Artificial Sequence
  RNA Oligomer
gacagaaacaauucuucuu

SEQ ID NO: 12162 - RNA, 19 nt, Artificial Sequence
  RNA Oligomer
cagcaaccugguugugaaa

SEQ ID NO: 12163 - RNA, 19 nt, Artificial Sequence
  RNA Oligomer
gagagacuuagaaaaaaug

SEQ ID NO: 12164 - RNA, 19 nt, Artificial Sequence
  RNA Oligomer
aguacuguaaacaggcuuu

SEQ ID NO: 12165 - RNA, 19 nt, Artificial Sequence
  RNA Oligomer
ugggccaauaugguguuua

SEQ ID NO: 12166 - RNA, 19 nt, Artificial Sequence
  RNA Oligomer
acaaucacuuauaugugug

SEQ ID NO: 12167 - RNA, 19 nt, Artificial Sequence
  RNA Oligomer
cucagcuacuacucacauu

SEQ ID NO: 12168 - RNA, 19 nt, Artificial Sequence
  RNA Oligomer
ugcauuugcaaauacguau

SEQ ID NO: 12169 - RNA, 19 nt, Artificial Sequence
  RNA Oligomer
ccaugcauuugcaaauacg

SEQ ID NO: 12170 - RNA, 19 nt, Artificial Sequence
  RNA Oligomer
ccaaggaguucaaucacuu

SEQ ID NO: 12171 - RNA, 19 nt, Artificial Sequence
  RNA Oligomer
gccuuauucaugaggcuua

SEQ ID NO: 12172 - RNA, 19 nt, Artificial Sequence
  RNA Oligomer
gguacucaacagccuuauu

SEQ ID NO: 12173 - RNA, 19 nt, Artificial Sequence
  RNA Oligomer
ugguacucaacagccuuau

SEQ ID NO: 12174 - RNA, 19 nt, Artificial Sequence
  RNA Oligomer
ccacucaauuguggagaag

SEQ ID NO: 12175 - RNA, 19 nt, Artificial Sequence
  RNA Oligomer
gauacaggcuugaaagcau

SEQ ID NO: 12176 - RNA, 19 nt, Artificial Sequence
  RNA Oligomer
gugagcaaaacugggcuaa

SEQ ID NO: 12177 - RNA, 19 nt, Artificial Sequence
  RNA Oligomer
acagaaacaauucuucuug

SEQ ID NO: 12178 - RNA, 19 nt, Artificial Sequence
  RNA Oligomer
acaugcacuugaagcagau

SEQ ID NO: 12179 - RNA, 19 nt, Artificial Sequence
  RNA Oligomer
auguggacaugcacuugaa

SEQ ID NO: 12180 - RNA, 19 nt, Artificial Sequence
  RNA Oligomer
ucaauguggacaugcacuu

SEQ ID NO: 12181 - RNA, 19 nt, Artificial Sequence
  RNA Oligomer
cccaaacugauggugucaa

SEQ ID NO: 12182 - RNA, 19 nt, Artificial Sequence
  RNA Oligomer
ucagcaaccugguugugaa

SEQ ID NO: 12183 - RNA, 19 nt, Artificial Sequence
  RNA Oligomer
ucguuguaacacucagcaa

SEQ ID NO: 12184 - RNA, 19 nt, Artificial Sequence
  RNA Oligomer
gcaacuuugauguuugcac

SEQ ID NO: 12185 - RNA, 19 nt, Artificial Sequence
  RNA Oligomer
ggauauagcaguaaugcua

SEQ ID NO: 12186 - RNA, 19 nt, Artificial Sequence
  RNA Oligomer
ucucuccuuuuuuuaggau

SEQ ID NO: 12187 - RNA, 19 nt, Artificial Sequence
  RNA Oligomer
caaacuccuugacaagguu

SEQ ID NO: 12188 - RNA, 19 nt, Artificial Sequence
  RNA Oligomer
auaaugcacauaugguguu

SEQ ID NO: 12189 - RNA, 19 nt, Artificial Sequence
  RNA Oligomer
gcagauacaguauaaacuc

SEQ ID NO: 12190 - RNA, 19 nt, Artificial Sequence
  RNA Oligomer
agaggauuguccuuaaguc

SEQ ID NO: 12191 - RNA, 19 nt, Artificial Sequence
  RNA Oligomer
gugguacucaacagccuua

SEQ ID NO: 12192 - RNA, 19 nt, Artificial Sequence
  RNA Oligomer
acucaauuguggagaagaa

SEQ ID NO: 12193 - RNA, 19 nt, Artificial Sequence
  RNA Oligomer
accuggagaucuagauaca

SEQ ID NO: 12194 - RNA, 19 nt, Artificial Sequence
  RNA Oligomer
gaccuggagaucuagauac

SEQ ID NO: 12195 - RNA, 19 nt, Artificial Sequence
  RNA Oligomer
ugaccuggagaucuagaua

SEQ ID NO: 12196 - RNA, 19 nt, Artificial Sequence
  RNA Oligomer
ggcgacagaaacaauucuu

SEQ ID NO: 12197 - RNA, 19 nt, Artificial Sequence
  RNA Oligomer
gacugugggucucaaaaau

SEQ ID NO: 12198 - RNA, 19 nt, Artificial Sequence
  RNA Oligomer
ccuacaucaucaguauccu

SEQ ID NO: 12199 - RNA, 19 nt, Artificial Sequence
  RNA Oligomer
uccaucagaucauguguuc

SEQ ID NO: 12200 - RNA, 19 nt, Artificial Sequence
  RNA Oligomer
accuaguccaucagaucau

SEQ ID NO: 12201 - RNA, 19 nt, Artificial Sequence
  RNA Oligomer
ucuccaaaugccuuuuuua

SEQ ID NO: 12202 - RNA, 19 nt, Artificial Sequence
  RNA Oligomer
ggacuauuaaaugugccua

SEQ ID NO: 12203 - RNA, 19 nt, Artificial Sequence
  RNA Oligomer
ggccaauaugguguuuaca

SEQ ID NO: 12204 - RNA, 19 nt, Artificial Sequence
  RNA Oligomer
augcacauaugguguucaa

SEQ ID NO: 12205 - RNA, 19 nt, Artificial Sequence
  RNA Oligomer
ggaguucaaucacuuggcg

SEQ ID NO: 12206 - RNA, 19 nt, Artificial Sequence
  RNA Oligomer
uccacucaauuguggagaa

SEQ ID NO: 12207 - RNA, 19 nt, Artificial Sequence
  RNA Oligomer
cccgaugauaaccagaauu

SEQ ID NO: 12208 - RNA, 19 nt, Artificial Sequence
  RNA Oligomer
agcaaaacugggcuaauua

SEQ ID NO: 12209 - RNA, 19 nt, Artificial Sequence
  RNA Oligomer
gcccaaacugaugguguca

SEQ ID NO: 12210 - RNA, 19 nt, Artificial Sequence
  RNA Oligomer
ugcccaaacugaugguguc

SEQ ID NO: 12211 - RNA, 19 nt, Artificial Sequence
  RNA Oligomer
ucugcuaugacaagucuuu

SEQ ID NO: 12212 - RNA, 19 nt, Artificial Sequence
  RNA Oligomer
gcagucuuuuggagugacc

SEQ ID NO: 12213 - RNA, 19 nt, Artificial Sequence
  RNA Oligomer
gccaauaugguguuuacau

SEQ ID NO: 12214 - RNA, 19 nt, Artificial Sequence
  RNA Oligomer
ucacuuauaugugugucga

SEQ ID NO: 12215 - RNA, 19 nt, Artificial Sequence
  RNA Oligomer
cugaaauaauucuggccag

SEQ ID NO: 12216 - RNA, 19 nt, Artificial Sequence
  RNA Oligomer
cacuagccauuguggacca

SEQ ID NO: 12217 - RNA, 19 nt, Artificial Sequence
  RNA Oligomer
acagccacuagccauugug

SEQ ID NO: 12218 - RNA, 19 nt, Artificial Sequence
  RNA Oligomer
agacugugggucucaaaaa

SEQ ID NO: 12219 - RNA, 19 nt, Artificial Sequence
  RNA Oligomer
caagguugcccaaacugau

SEQ ID NO: 12220 - RNA, 19 nt, Artificial Sequence
  RNA Oligomer
gcagucugccuuucguugu

SEQ ID NO: 12221 - RNA, 19 nt, Artificial Sequence
  RNA Oligomer
ugagcagucugccuuucgu

SEQ ID NO: 12222 - RNA, 19 nt, Artificial Sequence
  RNA Oligomer
cuucauugcauguaaugua

SEQ ID NO: 12223 - RNA, 19 nt, Artificial Sequence
  RNA Oligomer
guaguacacauacaacuaa

SEQ ID NO: 12224 - RNA, 19 nt, Artificial Sequence
  RNA Oligomer
ccuacuuaauacacaguaa

SEQ ID NO: 12225 - RNA, 19 nt, Artificial Sequence
  RNA Oligomer
guguauccuauuauggaua

SEQ ID NO: 12226 - RNA, 19 nt, Artificial Sequence
  RNA Oligomer
gcaaguaaagcacacuuuu

SEQ ID NO: 12227 - RNA, 19 nt, Artificial Sequence
  RNA Oligomer
gcaaacuccuugacaaggu

SEQ ID NO: 12228 - RNA, 19 nt, Artificial Sequence
  RNA Oligomer
uugaaccuuucucauggau

SEQ ID NO: 12229 - RNA, 19 nt, Artificial Sequence
  RNA Oligomer
cacuuauaugugugucgaa

SEQ ID NO: 12230 - RNA, 19 nt, Artificial Sequence
  RNA Oligomer
uccucagcuacuacucaca

SEQ ID NO: 12231 - RNA, 19 nt, Artificial Sequence
  RNA Oligomer
agacagaggauuguccuua

SEQ ID NO: 12232 - RNA, 19 nt, Artificial Sequence
  RNA Oligomer
uaggucuuuucaacaagaa

SEQ ID NO: 12233 - RNA, 19 nt, Artificial Sequence
  RNA Oligomer
ucaaucacuuggcgugacu

SEQ ID NO: 12234 - RNA, 19 nt, Artificial Sequence
  RNA Oligomer
uggaggugguacucaacag

SEQ ID NO: 12235 - RNA, 19 nt, Artificial Sequence
  RNA Oligomer
gcgacagaaacaauucuuc

SEQ ID NO: 12236 - RNA, 19 nt, Artificial Sequence
  RNA Oligomer
ccaaagacugugggucuca

SEQ ID NO: 12237 - RNA, 19 nt, Artificial Sequence
  RNA Oligomer
ggauucagcuugagugcug

SEQ ID NO: 12238 - RNA, 19 nt, Artificial Sequence
  RNA Oligomer
gacaugcacuugaagcaga

SEQ ID NO: 12239 - RNA, 19 nt, Artificial Sequence
  RNA Oligomer
uggugucaauguggacaug

SEQ ID NO: 12240 - RNA, 19 nt, Artificial Sequence
  RNA Oligomer
cacucagcaaccugguugu

SEQ ID NO: 12241 - RNA, 19 nt, Artificial Sequence
  RNA Oligomer
ccauguuaaacuacgguca

SEQ ID NO: 12242 - RNA, 19 nt, Artificial Sequence
  RNA Oligomer
acuauauguugaagacauc

SEQ ID NO: 12243 - RNA, 19 nt, Artificial Sequence
  RNA Oligomer
uuggaaugcaagagagguu

SEQ ID NO: 12244 - RNA, 19 nt, Artificial Sequence
  RNA Oligomer
uccuacuuaauacacagua

SEQ ID NO: 12245 - RNA, 19 nt, Artificial Sequence
  RNA Oligomer
ugcacauaugguguucaaa

SEQ ID NO: 12246 - RNA, 19 nt, Artificial Sequence
  RNA Oligomer
cccuaagaaugguucugug

SEQ ID NO: 12247 - RNA, 19 nt, Artificial Sequence
  RNA Oligomer
ggugguacucaacagccuu

SEQ ID NO: 12248 - RNA, 19 nt, Artificial Sequence
  RNA Oligomer
ccgaugauaaccagaauuc

SEQ ID NO: 12249 - RNA, 19 nt, Artificial Sequence
  RNA Oligomer
cgggaagcaccaucucuaa

SEQ ID NO: 12250 - RNA, 19 nt, Artificial Sequence
  RNA Oligomer
acaauucuucuugccgcaa

SEQ ID NO: 12251 - RNA, 19 nt, Artificial Sequence
  RNA Oligomer
gaaagagcgacccuuacca

SEQ ID NO: 12252 - RNA, 19 nt, Artificial Sequence
  RNA Oligomer
agguggccuucuugcugau

SEQ ID NO: 12253 - RNA, 19 nt, Artificial Sequence
  RNA Oligomer
ucuuugagguggccuucuu

SEQ ID NO: 12254 - RNA, 19 nt, Artificial Sequence
  RNA Oligomer
cugcgaaccuacaucauca

SEQ ID NO: 12255 - RNA, 19 nt, Artificial Sequence
  RNA Oligomer
ugcugcgaaccuacaucau

SEQ ID NO: 12256 - RNA, 19 nt, Artificial Sequence
  RNA Oligomer
agaugagcagucugccuuu

SEQ ID NO: 12257 - RNA, 19 nt, Artificial Sequence
  RNA Oligomer
gagaugagcagucugccuu

SEQ ID NO: 12258 - RNA, 19 nt, Artificial Sequence
  RNA Oligomer
auguucagcuucauugcau

SEQ ID NO: 12259 - RNA, 19 nt, Artificial Sequence
  RNA Oligomer
gguugaaagaggauucagu

SEQ ID NO: 12260 - RNA, 19 nt, Artificial Sequence
  RNA Oligomer
uggagugaccagcaacuuu

SEQ ID NO: 12261 - RNA, 19 nt, Artificial Sequence
  RNA Oligomer
agcagucuuuuggagugac

SEQ ID NO: 12262 - RNA, 19 nt, Artificial Sequence
  RNA Oligomer
uggguuuuccuacuuaaua

SEQ ID NO: 12263 - RNA, 19 nt, Artificial Sequence
  RNA Oligomer
caguaaugcuauuacugaa

SEQ ID NO: 12264 - RNA, 19 nt, Artificial Sequence
  RNA Oligomer
uguguauccuauuauggau

SEQ ID NO: 12265 - RNA, 19 nt, Artificial Sequence
  RNA Oligomer
ggcaaguaaagcacacuuu

SEQ ID NO: 12266 - RNA, 19 nt, Artificial Sequence
  RNA Oligomer
caguauaaacucacaaaca

SEQ ID NO: 12267 - RNA, 19 nt, Artificial Sequence
  RNA Oligomer
agauuuuccaugcauuugc

SEQ ID NO: 12268 - RNA, 19 nt, Artificial Sequence
  RNA Oligomer
ucagacaaggcccacagaa

SEQ ID NO: 12269 - RNA, 19 nt, Artificial Sequence
  RNA Oligomer
gguaagcuuucuaggccug

SEQ ID NO: 12270 - RNA, 19 nt, Artificial Sequence
  RNA Oligomer
agguaagcuuucuaggccu

SEQ ID NO: 12271 - RNA, 19 nt, Artificial Sequence
  RNA Oligomer
caaucacuuggcgugacuu

SEQ ID NO: 12272 - RNA, 19 nt, Artificial Sequence
  RNA Oligomer
aagaguuccauuaggugau

SEQ ID NO: 12273 - RNA, 19 nt, Artificial Sequence
  RNA Oligomer
cgacagaaacaauucuucu

SEQ ID NO: 12274 - RNA, 19 nt, Artificial Sequence
  RNA Oligomer
acaggucugagugccugaa

SEQ ID NO: 12275 - RNA, 19 nt, Artificial Sequence
  RNA Oligomer
gacaagucuuucccaaucu

SEQ ID NO: 12276 - RNA, 19 nt, Artificial Sequence
  RNA Oligomer
gaaaaugucugcuaugaca

SEQ ID NO: 12277 - RNA, 19 nt, Artificial Sequence
  RNA Oligomer
cguuguaacacucagcaac

SEQ ID NO: 12278 - RNA, 19 nt, Artificial Sequence
  RNA Oligomer
uucagcuucauugcaugua

SEQ ID NO: 12279 - RNA, 19 nt, Artificial Sequence
  RNA Oligomer
cagcaacuuugauguuugc

SEQ ID NO: 12280 - RNA, 19 nt, Artificial Sequence
  RNA Oligomer
acuguaaacaggcuuuagu

SEQ ID NO: 12281 - RNA, 19 nt, Artificial Sequence
  RNA Oligomer
gcaguaaugcuauuacuga

SEQ ID NO: 12282 - RNA, 19 nt, Artificial Sequence
  RNA Oligomer
guauccuauuauggauacu

SEQ ID NO: 12283 - RNA, 19 nt, Artificial Sequence
  RNA Oligomer
ugugggccaauaugguguu

SEQ ID NO: 12284 - RNA, 19 nt, Artificial Sequence
  RNA Oligomer
caagccaugcuuaauauuu

SEQ ID NO: 12285 - RNA, 19 nt, Artificial Sequence
  RNA Oligomer
ggaaucaagccaugcuuaa

SEQ ID NO: 12286 - RNA, 19 nt, Artificial Sequence
  RNA Oligomer
agggaaucaagccaugcuu

SEQ ID NO: 12287 - RNA, 19 nt, Artificial Sequence
  RNA Oligomer
ccaggugucaauggacuug

SEQ ID NO: 12288 - RNA, 19 nt, Artificial Sequence
  RNA Oligomer
ccuuauucaugaggcuuag

SEQ ID NO: 12289 - RNA, 19 nt, Artificial Sequence
  RNA Oligomer
ccuggguacaagcugguua

SEQ ID NO: 12290 - RNA, 19 nt, Artificial Sequence
  RNA Oligomer
gguugcugcgaaccuacau

SEQ ID NO: 12291 - RNA, 19 nt, Artificial Sequence
  RNA Oligomer
uuaaaguuuaaaacuccgc

SEQ ID NO: 12292 - RNA, 19 nt, Artificial Sequence
  RNA Oligomer
aaacuguuuauguagcuga

SEQ ID NO: 12293 - RNA, 19 nt, Artificial Sequence
  RNA Oligomer
uucuacagcaccuuuuuuc

SEQ ID NO: 12294 - RNA, 19 nt, Artificial Sequence
  RNA Oligomer
ugaaguaaaaugaaaaggc

SEQ ID NO: 12295 - RNA, 19 nt, Artificial Sequence
  RNA Oligomer
aaaacuguuuauguagcug

SEQ ID NO: 12296 - RNA, 19 nt, Artificial Sequence
  RNA Oligomer
aacuguuuauguagcugac

SEQ ID NO: 12297 - RNA, 19 nt, Artificial Sequence
  RNA Oligomer
aucuaaguucuuugaaucc

SEQ ID NO: 12298 - RNA, 19 nt, Artificial Sequence
  RNA Oligomer
uuuuucuucuccacaauug

SEQ ID NO: 12299 - RNA, 19 nt, Artificial Sequence
  RNA Oligomer
aagccuguaucuagaucuc

SEQ ID NO: 12300 - RNA, 19 nt, Artificial Sequence
  RNA Oligomer
aaguuuaaaacuccgcugc

SEQ ID NO: 12301 - RNA, 19 nt, Artificial Sequence
  RNA Oligomer
uacugaugauguagguucg

SEQ ID NO: 12302 - RNA, 19 nt, Artificial Sequence
  RNA Oligomer
aaugaugaaaaagugaugg

SEQ ID NO: 12303 - RNA, 19 nt, Artificial Sequence
  RNA Oligomer
auauugugcaaguggaugg

SEQ ID NO: 12304 - RNA, 19 nt, Artificial Sequence
  RNA Oligomer
auaauaggauacacaggga

SEQ ID NO: 12305 - RNA, 19 nt, Artificial Sequence
  RNA Oligomer
augaaugugaguaguagcu

SEQ ID NO: 12306 - RNA, 19 nt, Artificial Sequence
  RNA Oligomer
ucuuuguguuuucuaagcc

SEQ ID NO: 12307 - RNA, 19 nt, Artificial Sequence
  RNA Oligomer
caagccuguaucuagaucu

SEQ ID NO: 12308 - RNA, 19 nt, Artificial Sequence
  RNA Oligomer
uucugcacuguaauuagcc

SEQ ID NO: 12309 - RNA, 19 nt, Artificial Sequence
  RNA Oligomer
uaaaguuuaaaacuccgcu

SEQ ID NO: 12310 - RNA, 19 nt, Artificial Sequence
  RNA Oligomer
aaacaucaaaguugcuggu

SEQ ID NO: 12311 - RNA, 19 nt, Artificial Sequence
  RNA Oligomer
auuaacaaaaccaguaucc

SEQ ID NO: 12312 - RNA, 19 nt, Artificial Sequence
  RNA Oligomer
cauaauaggauacacaggg

SEQ ID NO: 12313 - RNA, 19 nt, Artificial Sequence
  RNA Oligomer
acagggaaaaacauuuuag

SEQ ID NO: 12314 - RNA, 19 nt, Artificial Sequence
  RNA Oligomer
aaaaucuuauucugugggc

SEQ ID NO: 12315 - RNA, 19 nt, Artificial Sequence
  RNA Oligomer
uuucaagccuguaucuaga

SEQ ID NO: 12316 - RNA, 19 nt, Artificial Sequence
  RNA Oligomer
agccuguaucuagaucucc

SEQ ID NO: 12317 - RNA, 19 nt, Artificial Sequence
  RNA Oligomer
ggaggaugaaguaaaauga

SEQ ID NO: 12318 - RNA, 19 nt, Artificial Sequence
  RNA Oligomer
ucugcacuguaauuagccc

SEQ ID NO: 12319 - RNA, 19 nt, Artificial Sequence
  RNA Oligomer
auugcggcaagaagaauug

SEQ ID NO: 12320 - RNA, 19 nt, Artificial Sequence
  RNA Oligomer
augauauucaaggccaggg

SEQ ID NO: 12321 - RNA, 19 nt, Artificial Sequence
  RNA Oligomer
aaaguuuaaaacuccgcug

SEQ ID NO: 12322 - RNA, 19 nt, Artificial Sequence
  RNA Oligomer
caaaacuguuuauguagcu

SEQ ID NO: 12323 - RNA, 19 nt, Artificial Sequence
  RNA Oligomer
aaaccaguauccauaauag

SEQ ID NO: 12324 - RNA, 19 nt, Artificial Sequence
  RNA Oligomer
cagggaaaaacauuuuagg

SEQ ID NO: 12325 - RNA, 19 nt, Artificial Sequence
  RNA Oligomer
aguaguagcugaggaauga

SEQ ID NO: 12326 - RNA, 19 nt, Artificial Sequence
  RNA Oligomer
uuuucuucuccacaauuga

SEQ ID NO: 12327 - RNA, 19 nt, Artificial Sequence
  RNA Oligomer
guaauuagcccaguuuugc

SEQ ID NO: 12328 - RNA, 19 nt, Artificial Sequence
  RNA Oligomer
aauaugaucugcaggaccc

SEQ ID NO: 12329 - RNA, 19 nt, Artificial Sequence
  RNA Oligomer
acaaaacuguuuauguagc

SEQ ID NO: 12330 - RNA, 19 nt, Artificial Sequence
  RNA Oligomer
auuuucaccaaucuucugu

SEQ ID NO: 12331 - RNA, 19 nt, Artificial Sequence
  RNA Oligomer
gaugaguuuuaaaaaaggc

SEQ ID NO: 12332 - RNA, 19 nt, Artificial Sequence
  RNA Oligomer
aauccaugagaaagguuca

SEQ ID NO: 12333 - RNA, 19 nt, Artificial Sequence
  RNA Oligomer
gugcaaauuuuaacaaugg

SEQ ID NO: 12334 - RNA, 19 nt, Artificial Sequence
  RNA Oligomer
ucuaaguucuuugaaucca

SEQ ID NO: 12335 - RNA, 19 nt, Artificial Sequence
  RNA Oligomer
gucuuuguguuuucuaagc

SEQ ID NO: 12336 - RNA, 19 nt, Artificial Sequence
  RNA Oligomer
uuuguguuuucuaagccuc

SEQ ID NO: 12337 - RNA, 19 nt, Artificial Sequence
  RNA Oligomer
gaucaaaauuaacaccugg

SEQ ID NO: 12338 - RNA, 19 nt, Artificial Sequence
  RNA Oligomer
ucuacagcaccuuuuuucu

SEQ ID NO: 12339 - RNA, 19 nt, Artificial Sequence
  RNA Oligomer
ggaaaucaaaaggcugugc

SEQ ID NO: 12340 - RNA, 19 nt, Artificial Sequence
  RNA Oligomer
aagcauauuuuugagaccc

SEQ ID NO: 12341 - RNA, 19 nt, Artificial Sequence
  RNA Oligomer
auauuuuugagacccacag

SEQ ID NO: 12342 - RNA, 19 nt, Artificial Sequence
  RNA Oligomer
aagcgcacaugagagauug

SEQ ID NO: 12343 - RNA, 19 nt, Artificial Sequence
  RNA Oligomer
augaagcugaacaugaccg

SEQ ID NO: 12344 - RNA, 19 nt, Artificial Sequence
  RNA Oligomer
auacucagcauuuucacca

SEQ ID NO: 12345 - RNA, 19 nt, Artificial Sequence
  RNA Oligomer
acaucaaaguugcugguca

SEQ ID NO: 12346 - RNA, 19 nt, Artificial Sequence
  RNA Oligomer
aagucucucacauuaauga

SEQ ID NO: 12347 - RNA, 19 nt, Artificial Sequence
  RNA Oligomer
ggagaaaaaaaaagugugc

SEQ ID NO: 12348 - RNA, 19 nt, Artificial Sequence
  RNA Oligomer
aguuuauacuguaucugcu

SEQ ID NO: 12349 - RNA, 19 nt, Artificial Sequence
  RNA Oligomer
uuuagccacaauuaccacc

SEQ ID NO: 12350 - RNA, 19 nt, Artificial Sequence
  RNA Oligomer
guauucuaaugucuuugug

SEQ ID NO: 12351 - RNA, 19 nt, Artificial Sequence
  RNA Oligomer
aucaaaauuaacaccuggu

SEQ ID NO: 12352 - RNA, 19 nt, Artificial Sequence
  RNA Oligomer
aaaauuaacaccuggugca

SEQ ID NO: 12353 - RNA, 19 nt, Artificial Sequence
  RNA Oligomer
uuucuucuccacaauugag

SEQ ID NO: 12354 - RNA, 19 nt, Artificial Sequence
  RNA Oligomer
acaauugaguggaaucuug

SEQ ID NO: 12355 - RNA, 19 nt, Artificial Sequence
  RNA Oligomer
cugcacuguaauuagccca

SEQ ID NO: 12356 - RNA, 19 nt, Artificial Sequence
  RNA Oligomer
ugcacuguaauuagcccag

SEQ ID NO: 12357 - RNA, 19 nt, Artificial Sequence
  RNA Oligomer
augcucuucaauaccguac

SEQ ID NO: 12358 - RNA, 19 nt, Artificial Sequence
  RNA Oligomer
aaacuccgcugcuguuugg

SEQ ID NO: 12359 - RNA, 19 nt, Artificial Sequence
  RNA Oligomer
auaccguacuugaacuucu

SEQ ID NO: 12360 - RNA, 19 nt, Artificial Sequence
  RNA Oligomer
uucuuuaucucaaucugcu

SEQ ID NO: 12361 - RNA, 19 nt, Artificial Sequence
  RNA Oligomer
uagcagacauuuucacaac

SEQ ID NO: 12362 - RNA, 19 nt, Artificial Sequence
  RNA Oligomer
uaggucuacauuacaugca

SEQ ID NO: 12363 - RNA, 19 nt, Artificial Sequence
  RNA Oligomer
augaaaaguacugacagcc

SEQ ID NO: 12364 - RNA, 19 nt, Artificial Sequence
  RNA Oligomer
agugcaaacaucaaaguug

SEQ ID NO: 12365 - RNA, 19 nt, Artificial Sequence
  RNA Oligomer
cugcaaaauucauuuaggc

SEQ ID NO: 12366 - RNA, 19 nt, Artificial Sequence
  RNA Oligomer
uuaggcacauuuaauaguc

SEQ ID NO: 12367 - RNA, 19 nt, Artificial Sequence
  RNA Oligomer
auuaaugacuaaagccugu

SEQ ID NO: 12368 - RNA, 19 nt, Artificial Sequence
  RNA Oligomer
uucuaucauucaagcauca

SEQ ID NO: 12369 - RNA, 19 nt, Artificial Sequence
  RNA Oligomer
uaauaggauacacagggaa

SEQ ID NO: 12370 - RNA, 19 nt, Artificial Sequence
  RNA Oligomer
uacacagggaaaaacauuu

SEQ ID NO: 12371 - RNA, 19 nt, Artificial Sequence
  RNA Oligomer
aaugaaugugaguaguagc

SEQ ID NO: 12372 - RNA, 19 nt, Artificial Sequence
  RNA Oligomer
augaugaaaaagugauggu

SEQ ID NO: 12373 - RNA, 19 nt, Artificial Sequence
  RNA Oligomer
gugaugguaaugauauugu

SEQ ID NO: 12374 - RNA, 19 nt, Artificial Sequence
  RNA Oligomer
gaaaaucuuauucuguggg

SEQ ID NO: 12375 - RNA, 19 nt, Artificial Sequence
  RNA Oligomer
aaaucuuauucugugggcc

SEQ ID NO: 12376 - RNA, 19 nt, Artificial Sequence
  RNA Oligomer
uuguugaaaagaccuaaga

SEQ ID NO: 12377 - RNA, 19 nt, Artificial Sequence
  RNA Oligomer
cuaaguucuuugaauccac

SEQ ID NO: 12378 - RNA, 19 nt, Artificial Sequence
  RNA Oligomer
auccacuacuuuaaauacc

SEQ ID NO: 12379 - RNA, 19 nt, Artificial Sequence
  RNA Oligomer
aaccuagguauucuaaugu

SEQ ID NO: 12380 - RNA, 19 nt, Artificial Sequence
  RNA Oligomer
agguauucuaaugucuuug

SEQ ID NO: 12381 - RNA, 19 nt, Artificial Sequence
  RNA Oligomer
cuuuguguuuucuaagccu

SEQ ID NO: 12382 - RNA, 19 nt, Artificial Sequence
  RNA Oligomer
ccauucgauuuuguucugc

SEQ ID NO: 12383 - RNA, 19 nt, Artificial Sequence
  RNA Oligomer
guucugcacuguaauuagc

SEQ ID NO: 12384 - RNA, 19 nt, Artificial Sequence
  RNA Oligomer
aguucaaugauauucaagg

SEQ ID NO: 12385 - RNA, 19 nt, Artificial Sequence
  RNA Oligomer
uuuucaccaaucuucugug

SEQ ID NO: 12386 - RNA, 19 nt, Artificial Sequence
  RNA Oligomer
ugucuucaacauauaguuc

SEQ ID NO: 12387 - RNA, 19 nt, Artificial Sequence
  RNA Oligomer
uuagugcaaacaucaaagu

SEQ ID NO: 12388 - RNA, 19 nt, Artificial Sequence
  RNA Oligomer
auucuaucauucaagcauc

SEQ ID NO: 12389 - RNA, 19 nt, Artificial Sequence
  RNA Oligomer
acacagggaaaaacauuuu

SEQ ID NO: 12390 - RNA, 19 nt, Artificial Sequence
  RNA Oligomer
cacagggaaaaacauuuua

SEQ ID NO: 12391 - RNA, 19 nt, Artificial Sequence
  RNA Oligomer
uauacuguaucugcuugua

SEQ ID NO: 12392 - RNA, 19 nt, Artificial Sequence
  RNA Oligomer
guuaaauauuaagcauggc

SEQ ID NO: 12393 - RNA, 19 nt, Artificial Sequence
  RNA Oligomer
auauaguagcacaagucca

SEQ ID NO: 12394 - RNA, 19 nt, Artificial Sequence
  RNA Oligomer
auuuagccacaauuaccac

SEQ ID NO: 12395 - RNA, 19 nt, Artificial Sequence
  RNA Oligomer
uagccacaauuaccacccg

SEQ ID NO: 12396 - RNA, 19 nt, Artificial Sequence
  RNA Oligomer
aaaaagcccuuaucuaugu

SEQ ID NO: 12397 - RNA, 19 nt, Artificial Sequence
  RNA Oligomer
aguucuuugaauccacuac

SEQ ID NO: 12398 - RNA, 19 nt, Artificial Sequence
  RNA Oligomer
accggaucaaaauuaacac

SEQ ID NO: 12399 - RNA, 19 nt, Artificial Sequence
  RNA Oligomer
ucaaaauuaacaccuggug

SEQ ID NO: 12400 - RNA, 19 nt, Artificial Sequence
  RNA Oligomer
caaaauuaacaccuggugc

SEQ ID NO: 12401 - RNA, 19 nt, Artificial Sequence
  RNA Oligomer
auucgauuuuguucugcac

SEQ ID NO: 12402 - RNA, 19 nt, Artificial Sequence
  RNA Oligomer
uaagcauauuuuugagacc

SEQ ID NO: 12403 - RNA, 19 nt, Artificial Sequence
  RNA Oligomer
auccauagauguaccacug

SEQ ID NO: 12404 - RNA, 19 nt, Artificial Sequence
  RNA Oligomer
uugaagaggauacugauga

SEQ ID NO: 12405 - RNA, 19 nt, Artificial Sequence
  RNA Oligomer
acugaugauguagguucgc

SEQ ID NO: 12406 - RNA, 19 nt, Artificial Sequence
  RNA Oligomer
cugaugauguagguucgca

SEQ ID NO: 12407 - RNA, 19 nt, Artificial Sequence
  RNA Oligomer
aauaccguacuugaacuuc

SEQ ID NO: 12408 - RNA, 19 nt, Artificial Sequence
  RNA Oligomer
acuugaacuucuuuaucuc

SEQ ID NO: 12409 - RNA, 19 nt, Artificial Sequence
  RNA Oligomer
ucuuucuuguucaguuucu

SEQ ID NO: 12410 - RNA, 19 nt, Artificial Sequence
  RNA Oligomer
uuucuuguucaguuucucu

SEQ ID NO: 12411 - RNA, 19 nt, Artificial Sequence
  RNA Oligomer
uaccucguaaaagcuuuuu

SEQ ID NO: 12412 - RNA, 19 nt, Artificial Sequence
  RNA Oligomer
auagcagacauuuucacaa

SEQ ID NO: 12413 - RNA, 19 nt, Artificial Sequence
  RNA Oligomer
cagacauuuucacaaccag

SEQ ID NO: 12414 - RNA, 19 nt, Artificial Sequence
  RNA Oligomer
uaguuuaacauggaauguc

SEQ ID NO: 12415 - RNA, 19 nt, Artificial Sequence
  RNA Oligomer
aaaguacugacagccacac

SEQ ID NO: 12416 - RNA, 19 nt, Artificial Sequence
  RNA Oligomer
uucuaagucucucacauua

SEQ ID NO: 12417 - RNA, 19 nt, Artificial Sequence
  RNA Oligomer
uucaagcaucaaugauuac

SEQ ID NO: 12418 - RNA, 19 nt, Artificial Sequence
  RNA Oligomer
aaccaguauccauaauagg

SEQ ID NO: 12419 - RNA, 19 nt, Artificial Sequence
  RNA Oligomer
gagaaaaaaaaagugugcu

SEQ ID NO: 12420 - RNA, 19 nt, Artificial Sequence
  RNA Oligomer
agugaugguaaugauauug

SEQ ID NO: 12421 - RNA, 19 nt, Artificial Sequence
  RNA Oligomer
augauauugugcaagugga

SEQ ID NO: 12422 - RNA, 19 nt, Artificial Sequence
  RNA Oligomer
ggaaaaucuuauucugugg

SEQ ID NO: 12423 - RNA, 19 nt, Artificial Sequence
  RNA Oligomer
uauaguagcacaaguccau

SEQ ID NO: 12424 - RNA, 19 nt, Artificial Sequence
  RNA Oligomer
uuuuagcagggacuuaagg

SEQ ID NO: 12425 - RNA, 19 nt, Artificial Sequence
  RNA Oligomer
uuuagcagggacuuaagga

SEQ ID NO: 12426 - RNA, 19 nt, Artificial Sequence
  RNA Oligomer
ucugucuuuuucuuguuga

SEQ ID NO: 12427 - RNA, 19 nt, Artificial Sequence
  RNA Oligomer
uaaguucuuugaauccacu

SEQ ID NO: 12428 - RNA, 19 nt, Artificial Sequence
  RNA Oligomer
uaaauaccaacaugcaccu

SEQ ID NO: 12429 - RNA, 19 nt, Artificial Sequence
  RNA Oligomer
gguauucuaaugucuuugu

SEQ ID NO: 12430 - RNA, 19 nt, Artificial Sequence
  RNA Oligomer
uguuuucuaagccucauga

SEQ ID NO: 12431 - RNA, 19 nt, Artificial Sequence
  RNA Oligomer
aaauuaacaccuggugcac

SEQ ID NO: 12432 - RNA, 19 nt, Artificial Sequence
  RNA Oligomer
uguucugcacuguaauuag

SEQ ID NO: 12433 - RNA, 19 nt, Artificial Sequence
  RNA Oligomer
ugauauucaaggccaggga

SEQ ID NO: 12434 - RNA, 19 nt, Artificial Sequence
  RNA Oligomer
accaccagcaugaagauga

SEQ ID NO: 12435 - RNA, 19 nt, Artificial Sequence
  RNA Oligomer
auguaccacuggaucagca

SEQ ID NO: 12436 - RNA, 19 nt, Artificial Sequence
  RNA Oligomer
auagacuugaagaggauac

SEQ ID NO: 12437 - RNA, 19 nt, Artificial Sequence
  RNA Oligomer
cucuucaauaccguacuug

SEQ ID NO: 12438 - RNA, 19 nt, Artificial Sequence
  RNA Oligomer
cuucuuuaucucaaucugc

SEQ ID NO: 12439 - RNA, 19 nt, Artificial Sequence
  RNA Oligomer
acaaauaugaucugcagga

SEQ ID NO: 12440 - RNA, 19 nt, Artificial Sequence
  RNA Oligomer
caaauaugaucugcaggac

SEQ ID NO: 12441 - RNA, 19 nt, Artificial Sequence
  RNA Oligomer
aaauaugaucugcaggacc

SEQ ID NO: 12442 - RNA, 19 nt, Artificial Sequence
  RNA Oligomer
augagagauugggaaagac

SEQ ID NO: 12443 - RNA, 19 nt, Artificial Sequence
  RNA Oligomer
ucauagcagacauuuucac

SEQ ID NO: 12444 - RNA, 19 nt, Artificial Sequence
  RNA Oligomer
agcagacauuuucacaacc

SEQ ID NO: 12445 - RNA, 19 nt, Artificial Sequence
  RNA Oligomer
gacauuuucacaaccaggu

SEQ ID NO: 12446 - RNA, 19 nt, Artificial Sequence
  RNA Oligomer
auaaagaacacucuccaga

SEQ ID NO: 12447 - RNA, 19 nt, Artificial Sequence
  RNA Oligomer
caugaucugauggacuagg

SEQ ID NO: 12448 - RNA, 19 nt, Artificial Sequence
  RNA Oligomer
aagcugaacaugaccguag

SEQ ID NO: 12449 - RNA, 19 nt, Artificial Sequence
  RNA Oligomer
aaugaaaaguacugacagc

SEQ ID NO: 12450 - RNA, 19 nt, Artificial Sequence
  RNA Oligomer
gucauacucagcauuuuca

SEQ ID NO: 12451 - RNA, 19 nt, Artificial Sequence
  RNA Oligomer
uacucagcauuuucaccaa

SEQ ID NO: 12452 - RNA, 19 nt, Artificial Sequence
  RNA Oligomer
gaaaacccaagaauaccag

SEQ ID NO: 12453 - RNA, 19 nt, Artificial Sequence
  RNA Oligomer
aagaauaccaguuacugca

SEQ ID NO: 12454 - RNA, 19 nt, Artificial Sequence
  RNA Oligomer
acauuaaugacuaaagccu

SEQ ID NO: 12455 - RNA, 19 nt, Artificial Sequence
  RNA Oligomer
aaugacuaaagccuguuua

SEQ ID NO: 12456 - RNA, 19 nt, Artificial Sequence
  RNA Oligomer
uaucauucaagcaucaaug

SEQ ID NO: 12457 - RNA, 19 nt, Artificial Sequence
  RNA Oligomer
aacaaaacaaacucuucga

SEQ ID NO: 12458 - RNA, 19 nt, Artificial Sequence
  RNA Oligomer
aacucuucgacacacauau

SEQ ID NO: 12459 - RNA, 19 nt, Artificial Sequence
  RNA Oligomer
uaaugauauugugcaagug

SEQ ID NO: 12460 - RNA, 19 nt, Artificial Sequence
  RNA Oligomer
acaauccucugucuuuuuc

SEQ ID NO: 12461 - RNA, 19 nt, Artificial Sequence
  RNA Oligomer
auacacagaaccauucuua

SEQ ID NO: 12462 - RNA, 19 nt, Artificial Sequence
  RNA Oligomer
uuuaaauaccaacaugcac

SEQ ID NO: 12463 - RNA, 19 nt, Artificial Sequence
  RNA Oligomer
uuguguuuucuaagccuca

SEQ ID NO: 12464 - RNA, 19 nt, Artificial Sequence
  RNA Oligomer
uucuaagccucaugaauaa

SEQ ID NO: 12465 - RNA, 19 nt, Artificial Sequence
  RNA Oligomer
cggaucaaaauuaacaccu

SEQ ID NO: 12466 - RNA, 19 nt, Artificial Sequence
  RNA Oligomer
auguccagcagcuaguuuu

SEQ ID NO: 12467 - RNA, 19 nt, Artificial Sequence
  RNA Oligomer
cauucgauuuuguucugca

SEQ ID NO: 12468 - RNA, 19 nt, Artificial Sequence
  RNA Oligomer
aaugauauucaaggccagg

SEQ ID NO: 12469 - RNA, 19 nt, Artificial Sequence
  RNA Oligomer
augaagaugaugaagaugg

SEQ ID NO: 12470 - RNA, 19 nt, Artificial Sequence
  RNA Oligomer
aauccauagauguaccacu

SEQ ID NO: 12471 - RNA, 19 nt, Artificial Sequence
  RNA Oligomer
aagauagacuugaagagga

SEQ ID NO: 12472 - RNA, 19 nt, Artificial Sequence
  RNA Oligomer
acuucuuuaucucaaucug

SEQ ID NO: 12473 - RNA, 19 nt, Artificial Sequence
  RNA Oligomer
auaccucguaaaagcuuuu

SEQ ID NO: 12474 - RNA, 19 nt, Artificial Sequence
  RNA Oligomer
cuuucuuguucaguuucuc

SEQ ID NO: 12475 - RNA, 19 nt, Artificial Sequence
  RNA Oligomer
acacaaauaugaucugcag

SEQ ID NO: 12476 - RNA, 19 nt, Artificial Sequence
  RNA Oligomer
uugaauaaagaacacucuc

SEQ ID NO: 12477 - RNA, 19 nt, Artificial Sequence
  RNA Oligomer
aauaaagaacacucuccag

SEQ ID NO: 12478 - RNA, 19 nt, Artificial Sequence
  RNA Oligomer
cuaggucuacauuacaugc

SEQ ID NO: 12479 - RNA, 19 nt, Artificial Sequence
  RNA Oligomer
ugaagcugaacaugaccgu

SEQ ID NO: 12480 - RNA, 19 nt, Artificial Sequence
  RNA Oligomer
gaaaaugaaaaguacugac

SEQ ID NO: 12481 - RNA, 19 nt, Artificial Sequence
  RNA Oligomer
augcaugcaagaagaaaag

SEQ ID NO: 12482 - RNA, 19 nt, Artificial Sequence
  RNA Oligomer
agcauuuucaccaaucuuc

SEQ ID NO: 12483 - RNA, 19 nt, Artificial Sequence
  RNA Oligomer
aaguacugacagccacacc

SEQ ID NO: 12484 - RNA, 19 nt, Artificial Sequence
  RNA Oligomer
cuuagugcaaacaucaaag

SEQ ID NO: 12485 - RNA, 19 nt, Artificial Sequence
  RNA Oligomer
uuuuucuaagucucucaca

SEQ ID NO: 12486 - RNA, 19 nt, Artificial Sequence
  RNA Oligomer
uuuucuaagucucucacau

SEQ ID NO: 12487 - RNA, 19 nt, Artificial Sequence
  RNA Oligomer
augacuaaagccuguuuac

SEQ ID NO: 12488 - RNA, 19 nt, Artificial Sequence
  RNA Oligomer
uuuauacuguaucugcuug

SEQ ID NO: 12489 - RNA, 19 nt, Artificial Sequence
  RNA Oligomer
uuauacuguaucugcuugu

SEQ ID NO: 12490 - RNA, 19 nt, Artificial Sequence
  RNA Oligomer
aaaacaaacucuucgacac

SEQ ID NO: 12491 - RNA, 19 nt, Artificial Sequence
  RNA Oligomer
cucugucuuuuucuuguug

SEQ ID NO: 12492 - RNA, 19 nt, Artificial Sequence
  RNA Oligomer
aauaccaacaugcaccucu

SEQ ID NO: 12493 - RNA, 19 nt, Artificial Sequence
  RNA Oligomer
ccggaucaaaauuaacacc

SEQ ID NO: 12494 - RNA, 19 nt, Artificial Sequence
  RNA Oligomer
auuaacaccuggugcacuu

SEQ ID NO: 12495 - RNA, 19 nt, Artificial Sequence
  RNA Oligomer
ugggaguuagagauggugc

SEQ ID NO: 12496 - RNA, 19 nt, Artificial Sequence
  RNA Oligomer
ucgauuuuguucugcacug

SEQ ID NO: 12497 - RNA, 19 nt, Artificial Sequence
  RNA Oligomer
agcauauuuuugagaccca

SEQ ID NO: 12498 - RNA, 19 nt, Artificial Sequence
  RNA Oligomer
aaguucaggcacucagacc

SEQ ID NO: 12499 - RNA, 19 nt, Artificial Sequence
  RNA Oligomer
ucgcucuuucccuuaaccc

SEQ ID NO: 12500 - RNA, 19 nt, Artificial Sequence
  RNA Oligomer
caaugauauucaaggccag

SEQ ID NO: 12501 - RNA, 19 nt, Artificial Sequence
  RNA Oligomer
aagcugaauccauagaugu

SEQ ID NO: 12502 - RNA, 19 nt, Artificial Sequence
  RNA Oligomer
cugaauccauagauguacc

SEQ ID NO: 12503 - RNA, 19 nt, Artificial Sequence
  RNA Oligomer
ugaauccauagauguacca

SEQ ID NO: 12504 - RNA, 19 nt, Artificial Sequence
  RNA Oligomer
uccauagauguaccacugg

SEQ ID NO: 12505 - RNA, 19 nt, Artificial Sequence
  RNA Oligomer
aaggccaccucaaagauag

SEQ ID NO: 12506 - RNA, 19 nt, Artificial Sequence
  RNA Oligomer
aaagauagacuugaagagg

SEQ ID NO: 12507 - RNA, 19 nt, Artificial Sequence
  RNA Oligomer
uuuaaaacuccgcugcugu

SEQ ID NO: 12508 - RNA, 19 nt, Artificial Sequence
  RNA Oligomer
uuaucucaaucugcuucaa

SEQ ID NO: 12509 - RNA, 19 nt, Artificial Sequence
  RNA Oligomer
cucaaucugcuucaagugc

SEQ ID NO: 12510 - RNA, 19 nt, Artificial Sequence
  RNA Oligomer
uacuuuccucacgccuucc

SEQ ID NO: 12511 - RNA, 19 nt, Artificial Sequence
  RNA Oligomer
guuacaacgaaaggcagac

SEQ ID NO: 12512 - RNA, 19 nt, Artificial Sequence
  RNA Oligomer
uuacaacgaaaggcagacu

SEQ ID NO: 12513 - RNA, 19 nt, Artificial Sequence
  RNA Oligomer
aaugaagcugaacaugacc

SEQ ID NO: 12514 - RNA, 19 nt, Artificial Sequence
  RNA Oligomer
aguuuaacauggaauguca

SEQ ID NO: 12515 - RNA, 19 nt, Artificial Sequence
  RNA Oligomer
uaacauggaaugucaaaca

SEQ ID NO: 12516 - RNA, 19 nt, Artificial Sequence
  RNA Oligomer
ucauacucagcauuuucac

SEQ ID NO: 12517 - RNA, 19 nt, Artificial Sequence
  RNA Oligomer
ucagcauuuucaccaaucu

SEQ ID NO: 12518 - RNA, 19 nt, Artificial Sequence
  RNA Oligomer
aaaaaaggcauuuggagaa

SEQ ID NO: 12519 - RNA, 19 nt, Artificial Sequence
  RNA Oligomer
cauuuggagaaacugguag

SEQ ID NO: 12520 - RNA, 19 nt, Artificial Sequence
  RNA Oligomer
agcauuuuuucuaagucuc

SEQ ID NO: 12521 - RNA, 19 nt, Artificial Sequence
  RNA Oligomer
ucacauuaaugacuaaagc

SEQ ID NO: 12522 - RNA, 19 nt, Artificial Sequence
  RNA Oligomer
uuaaugacuaaagccuguu

SEQ ID NO: 12523 - RNA, 19 nt, Artificial Sequence
  RNA Oligomer
aacaaacucuucgacacac

SEQ ID NO: 12524 - RNA, 19 nt, Artificial Sequence
  RNA Oligomer
uugauucccugacuuuagc

SEQ ID NO: 12525 - RNA, 19 nt, Artificial Sequence
  RNA Oligomer
gaggaaugaugaaaaagug

SEQ ID NO: 12526 - RNA, 19 nt, Artificial Sequence
  RNA Oligomer
gaaugaugaaaaagugaug

SEQ ID NO: 12527 - RNA, 19 nt, Artificial Sequence
  RNA Oligomer
gaaaaagugaugguaauga

SEQ ID NO: 12528 - RNA, 19 nt, Artificial Sequence
  RNA Oligomer
guggauggaaaaagaauau

SEQ ID NO: 12529 - RNA, 19 nt, Artificial Sequence
  RNA Oligomer
aacaauggaauguuuuagc

SEQ ID NO: 12530 - RNA, 19 nt, Artificial Sequence
  RNA Oligomer
uucaguuucuugguaaaac

SEQ ID NO: 12531 - RNA, 19 nt, Artificial Sequence
  RNA Oligomer
uacacagaaccauucuuag

SEQ ID NO: 12532 - RNA, 19 nt, Artificial Sequence
  RNA Oligomer
cccuuaucuauguaucacc

SEQ ID NO: 12533 - RNA, 19 nt, Artificial Sequence
  RNA Oligomer
uccacuacuuuaaauacca

SEQ ID NO: 12534 - RNA, 19 nt, Artificial Sequence
  RNA Oligomer
uucauguccagcagcuagu

SEQ ID NO: 12535 - RNA, 19 nt, Artificial Sequence
  RNA Oligomer
accucaaagauagacuuga

SEQ ID NO: 12536 - RNA, 19 nt, Artificial Sequence
  RNA Oligomer
caaagauagacuugaagag

SEQ ID NO: 12537 - RNA, 19 nt, Artificial Sequence
  RNA Oligomer
guuuaaaacuccgcugcug

SEQ ID NO: 12538 - RNA, 19 nt, Artificial Sequence
  RNA Oligomer
aagaggauacugaugaugu

SEQ ID NO: 12539 - RNA, 19 nt, Artificial Sequence
  RNA Oligomer
uccacauugacaccaucag

SEQ ID NO: 12540 - RNA, 19 nt, Artificial Sequence
  RNA Oligomer
gacacaaauaugaucugca

SEQ ID NO: 12541 - RNA, 19 nt, Artificial Sequence
  RNA Oligomer
aaagaacacucuccagaac

SEQ ID NO: 12542 - RNA, 19 nt, Artificial Sequence
  RNA Oligomer
acuaggucuacauuacaug

SEQ ID NO: 12543 - RNA, 19 nt, Artificial Sequence
  RNA Oligomer
aacauggaaugucaaacaa

SEQ ID NO: 12544 - RNA, 19 nt, Artificial Sequence
  RNA Oligomer
ggaaaaugaaaaguacuga

SEQ ID NO: 12545 - RNA, 19 nt, Artificial Sequence
  RNA Oligomer
gaaaaguacugacagccac

SEQ ID NO: 12546 - RNA, 19 nt, Artificial Sequence
  RNA Oligomer
auuuggagaaacugguaga

SEQ ID NO: 12547 - RNA, 19 nt, Artificial Sequence
  RNA Oligomer
aguacugacagccacaccu

SEQ ID NO: 12548 - RNA, 19 nt, Artificial Sequence
  RNA Oligomer
aaacccaagaauaccaguu

SEQ ID NO: 12549 - RNA, 19 nt, Artificial Sequence
  RNA Oligomer
aacccaagaauaccaguua

SEQ ID NO: 12550 - RNA, 19 nt, Artificial Sequence
  RNA Oligomer
caagaauaccaguuacugc

SEQ ID NO: 12551 - RNA, 19 nt, Artificial Sequence
  RNA Oligomer
cacauuaaugacuaaagcc

SEQ ID NO: 12552 - RNA, 19 nt, Artificial Sequence
  RNA Oligomer
gcaucaaugauuacauuuc

SEQ ID NO: 12553 - RNA, 19 nt, Artificial Sequence
  RNA Oligomer
cauuacugcuauauccuaa

SEQ ID NO: 12554 - RNA, 19 nt, Artificial Sequence
  RNA Oligomer
acaaaacaaacucuucgac

SEQ ID NO: 12555 - RNA, 19 nt, Artificial Sequence
  RNA Oligomer
aauuaccacccgcucauuc

SEQ ID NO: 12556 - RNA, 19 nt, Artificial Sequence
  RNA Oligomer
ugggcagggaucucuuuug

SEQ ID NO: 12557 - RNA, 19 nt, Artificial Sequence
  RNA Oligomer
gcugaauccauagauguac

SEQ ID NO: 12558 - RNA, 19 nt, Artificial Sequence
  RNA Oligomer
uaccacuggaucagcaaga

SEQ ID NO: 12559 - RNA, 19 nt, Artificial Sequence
  RNA Oligomer
uagacuugaagaggauacu

SEQ ID NO: 12560 - RNA, 19 nt, Artificial Sequence
  RNA Oligomer
gacuugaagaggauacuga

SEQ ID NO: 12561 - RNA, 19 nt, Artificial Sequence
  RNA Oligomer
aucucaaucugcuucaagu

SEQ ID NO: 12562 - RNA, 19 nt, Artificial Sequence
  RNA Oligomer
auaugaucugcaggaccca

SEQ ID NO: 12563 - RNA, 19 nt, Artificial Sequence
  RNA Oligomer
caaugaagcugaacaugac

SEQ ID NO: 12564 - RNA, 19 nt, Artificial Sequence
  RNA Oligomer
uuaacauggaaugucaaac

SEQ ID NO: 12565 - RNA, 19 nt, Artificial Sequence
  RNA Oligomer
aaaugaaaaguacugacag

SEQ ID NO: 12566 - RNA, 19 nt, Artificial Sequence
  RNA Oligomer
guguacuacugaauccucu

SEQ ID NO: 12567 - RNA, 19 nt, Artificial Sequence
  RNA Oligomer
cauuaaugacuaaagccug

SEQ ID NO: 12568 - RNA, 19 nt, Artificial Sequence
  RNA Oligomer
aaacaccauauuggcccac

SEQ ID NO: 12569 - RNA, 19 nt, Artificial Sequence
  RNA Oligomer
aaucuguguuugugaguuu

SEQ ID NO: 12570 - RNA, 19 nt, Artificial Sequence
  RNA Oligomer
agcauggcuugauucccug

SEQ ID NO: 12571 - RNA, 19 nt, Artificial Sequence
  RNA Oligomer
aggaaugaugaaaaaguga

SEQ ID NO: 12572 - RNA, 19 nt, Artificial Sequence
  RNA Oligomer
aauccucugucuuuuucuu

SEQ ID NO: 12573 - RNA, 19 nt, Artificial Sequence
  RNA Oligomer
auucacauacacagaacca

SEQ ID NO: 12574 - RNA, 19 nt, Artificial Sequence
  RNA Oligomer
aaaagcccuuaucuaugua

SEQ ID NO: 12575 - RNA, 19 nt, Artificial Sequence
  RNA Oligomer
aagcccuuaucuauguauc

SEQ ID NO: 12576 - RNA, 19 nt, Artificial Sequence
  RNA Oligomer
cacuacuuuaaauaccaac

SEQ ID NO: 12577 - RNA, 19 nt, Artificial Sequence
  RNA Oligomer
aaauaccaacaugcaccuc

SEQ ID NO: 12578 - RNA, 19 nt, Artificial Sequence
  RNA Oligomer
guuagagauggugcuuccc

SEQ ID NO: 12579 - RNA, 19 nt, Artificial Sequence
  RNA Oligomer
uaacgcccuugaagaaaac

SEQ ID NO: 12580 - RNA, 19 nt, Artificial Sequence
  RNA Oligomer
cacuggaucagcaagaagg

SEQ ID NO: 12581 - RNA, 19 nt, Artificial Sequence
  RNA Oligomer
acuggaucagcaagaaggc

SEQ ID NO: 12582 - RNA, 19 nt, Artificial Sequence
  RNA Oligomer
guacuuuccucacgccuuc

SEQ ID NO: 12583 - RNA, 19 nt, Artificial Sequence
  RNA Oligomer
augaccguaguuuaacaug

SEQ ID NO: 12584 - RNA, 19 nt, Artificial Sequence
  RNA Oligomer
aaaaaggcauuuggagaaa

SEQ ID NO: 12585 - RNA, 19 nt, Artificial Sequence
  RNA Oligomer
acccaagaauaccaguuac

SEQ ID NO: 12586 - RNA, 19 nt, Artificial Sequence
  RNA Oligomer
accaguuacugcaaaauuc

SEQ ID NO: 12587 - RNA, 19 nt, Artificial Sequence
  RNA Oligomer
cacauuuaauaguccacuc

SEQ ID NO: 12588 - RNA, 19 nt, Artificial Sequence
  RNA Oligomer
cacagcaggaauuauauaa

SEQ ID NO: 12589 - RNA, 19 nt, Artificial Sequence
  RNA Oligomer
cagcaggaauuauauaaug

SEQ ID NO: 12590 - RNA, 19 nt, Artificial Sequence
  RNA Oligomer
aucuguguuugugaguuua

SEQ ID NO: 12591 - RNA, 19 nt, Artificial Sequence
  RNA Oligomer
gauggaaaaagaauauacg

SEQ ID NO: 12592 - RNA, 19 nt, Artificial Sequence
  RNA Oligomer
uauacguauuugcaaaugc

SEQ ID NO: 12593 - RNA, 19 nt, Artificial Sequence
  RNA Oligomer
aaucuuauucugugggccu

SEQ ID NO: 12594 - RNA, 19 nt, Artificial Sequence
  RNA Oligomer
ucauucacauacacagaac

SEQ ID NO: 12595 - RNA, 19 nt, Artificial Sequence
  RNA Oligomer
cauucacauacacagaacc

SEQ ID NO: 12596 - RNA, 19 nt, Artificial Sequence
  RNA Oligomer
uucacauacacagaaccau

SEQ ID NO: 12597 - RNA, 19 nt, Artificial Sequence
  RNA Oligomer
acauacacagaaccauucu

SEQ ID NO: 12598 - RNA, 19 nt, Artificial Sequence
  RNA Oligomer
cagugaaccuagguauucu

SEQ ID NO: 12599 - RNA, 19 nt, Artificial Sequence
  RNA Oligomer
agcagccauugaaauaagc

SEQ ID NO: 12600 - RNA, 19 nt, Artificial Sequence
  RNA Oligomer
guucaaugauauucaaggc

SEQ ID NO: 12601 - RNA, 19 nt, Artificial Sequence
  RNA Oligomer
guauuaaguaggaaaaccc

SEQ ID NO: 12602 - RNA, 19 nt, Artificial Sequence
  RNA Oligomer
uuuuuucuaagucucucac

SEQ ID NO: 12603 - RNA, 19 nt, Artificial Sequence
  RNA Oligomer
uauccuaaaaaaaggagag

SEQ ID NO: 12604 - RNA, 19 nt, Artificial Sequence
  RNA Oligomer
aaaucuguguuugugaguu

SEQ ID NO: 12605 - RNA, 19 nt, Artificial Sequence
  RNA Oligomer
cauggcuugauucccugac

SEQ ID NO: 12606 - RNA, 19 nt, Artificial Sequence
  RNA Oligomer
auggcuugauucccugacu

SEQ ID NO: 12607 - RNA, 19 nt, Artificial Sequence
  RNA Oligomer
aguuugggcaaccuugagu

SEQ ID NO: 12608 - RNA, 19 nt, Artificial Sequence
  RNA Oligomer
gaguguuacaacgaaaggc

SEQ ID NO: 12609 - RNA, 19 nt, Artificial Sequence
  RNA Oligomer
uuauguagcugacaugcau

SEQ ID NO: 12610 - RNA, 19 nt, Artificial Sequence
  RNA Oligomer
auccucuuucaaccucucu

SEQ ID NO: 12611 - RNA, 19 nt, Artificial Sequence
  RNA Oligomer
cucuuucaaccucucuugc

SEQ ID NO: 12612 - RNA, 19 nt, Artificial Sequence
  RNA Oligomer
uaaagccuguuuacaguac

SEQ ID NO: 12613 - RNA, 19 nt, Artificial Sequence
  RNA Oligomer
aggagaaaaaaaaagugug

SEQ ID NO: 12614 - RNA, 19 nt, Artificial Sequence
  RNA Oligomer
guauuugcaaaugcaugga

SEQ ID NO: 12615 - RNA, 19 nt, Artificial Sequence
  RNA Oligomer
cacccgcucauucacauac

SEQ ID NO: 12616 - RNA, 19 nt, Artificial Sequence
  RNA Oligomer
auuuuguucugcacuguaa

SEQ ID NO: 12617 - RNA, 19 nt, Artificial Sequence
  RNA Oligomer
cuuguucaguuucucuucc

SEQ ID NO: 12618 - RNA, 19 nt, Artificial Sequence
  RNA Oligomer
uuguucaguuucucuuccu

SEQ ID NO: 12619 - RNA, 19 nt, Artificial Sequence
  RNA Oligomer
guuuauguagcugacaugc

SEQ ID NO: 12620 - RNA, 19 nt, Artificial Sequence
  RNA Oligomer
uauuugcaaaugcauggaa

SEQ ID NO: 12621 - RNA, 19 nt, Artificial Sequence
  RNA Oligomer
acaauggaauguuuuagca

SEQ ID NO: 12622 - RNA, 19 nt, Artificial Sequence
  RNA Oligomer
ucaaugauauucaaggcca

SEQ ID NO: 12623 - RNA, 19 nt, Artificial Sequence
  RNA Oligomer
aaucuuagugcaaacauca

SEQ ID NO: 12624 - RNA, 19 nt, Artificial Sequence
  RNA Oligomer
aagacugcuaaacucauaa

SEQ ID NO: 12625 - RNA, 19 nt, Artificial Sequence
  RNA Oligomer
uguauuaaguaggaaaacc

SEQ ID NO: 12626 - RNA, 19 nt, Artificial Sequence
  RNA Oligomer
guuugugaguuuauacugu

SEQ ID NO: 12627 - RNA, 19 nt, Artificial Sequence
  RNA Oligomer
ggauggaaaaagaauauac

SEQ ID NO: 12628 - RNA, 19 nt, Artificial Sequence
  RNA Oligomer
aagcuuaccuucaaagugc

SEQ ID NO: 12629 - RNA, 19 nt, Artificial Sequence
  RNA Oligomer
auggaauguuuuagcaggg

SEQ ID NO: 12630 - RNA, 19 nt, Artificial Sequence
  RNA Oligomer
uuaaggacaauccucuguc

SEQ ID NO: 12631 - RNA, 19 nt, Artificial Sequence
  RNA Oligomer
guaucaccuaauggaacuc

SEQ ID NO: 12632 - RNA, 19 nt, Artificial Sequence
  RNA Oligomer
uugagacccacagucuuug

SEQ ID NO: 12633 - RNA, 19 nt, Artificial Sequence
  RNA Oligomer
aaggacaccaccagcauga

SEQ ID NO: 12634 - RNA, 19 nt, Artificial Sequence
  RNA Oligomer
aagaugaugaagaugguuu

SEQ ID NO: 12635 - RNA, 19 nt, Artificial Sequence
  RNA Oligomer
gagauugggaaagacuugu

SEQ ID NO: 12636 - RNA, 19 nt, Artificial Sequence
  RNA Oligomer
aguguuacaacgaaaggca

SEQ ID NO: 12637 - RNA, 19 nt, Artificial Sequence
  RNA Oligomer
uuuauguagcugacaugca

SEQ ID NO: 12638 - RNA, 19 nt, Artificial Sequence
  RNA Oligomer
uuaaaaaaggcauuuggag

SEQ ID NO: 12639 - RNA, 19 nt, Artificial Sequence
  RNA Oligomer
acugcaaaauucauuuagg

SEQ ID NO: 12640 - RNA, 19 nt, Artificial Sequence
  RNA Oligomer
gugaguuuauacuguaucu

SEQ ID NO: 12641 - RNA, 19 nt, Artificial Sequence
  RNA Oligomer
ugaguuuauacuguaucug

SEQ ID NO: 12642 - RNA, 19 nt, Artificial Sequence
  RNA Oligomer
acacacauauaagugauug

SEQ ID NO: 12643 - RNA, 19 nt, Artificial Sequence
  RNA Oligomer
gaaugugaguaguagcuga

SEQ ID NO: 12644 - RNA, 19 nt, Artificial Sequence
  RNA Oligomer
augugaguaguagcugagg

SEQ ID NO: 12645 - RNA, 19 nt, Artificial Sequence
  RNA Oligomer
uuuucuuguugaaaagacc

SEQ ID NO: 12646 - RNA, 19 nt, Artificial Sequence
  RNA Oligomer
uucuuugaauccacuacuu

SEQ ID NO: 12647 - RNA, 19 nt, Artificial Sequence
  RNA Oligomer
aguaaaaugaaaaggcaag

SEQ ID NO: 12648 - RNA, 19 nt, Artificial Sequence
  RNA Oligomer
guaaaaugaaaaggcaagu

SEQ ID NO: 12649 - RNA, 19 nt, Artificial Sequence
  RNA Oligomer
ugaagaugaugaagauggu

SEQ ID NO: 12650 - RNA, 19 nt, Artificial Sequence
  RNA Oligomer
uugguacuuuccucacgcc

SEQ ID NO: 12651 - RNA, 19 nt, Artificial Sequence
  RNA Oligomer
caaccagguugcugagugu

SEQ ID NO: 12652 - RNA, 19 nt, Artificial Sequence
  RNA Oligomer
aacacaugaucugauggac

SEQ ID NO: 12653 - RNA, 19 nt, Artificial Sequence
  RNA Oligomer
auuacaugcaaugaagcug

SEQ ID NO: 12654 - RNA, 19 nt, Artificial Sequence
  RNA Oligomer
uagcugacaugcaugcaag

SEQ ID NO: 12655 - RNA, 19 nt, Artificial Sequence
  RNA Oligomer
ucaagcaucaaugauuaca

SEQ ID NO: 12656 - RNA, 19 nt, Artificial Sequence
  RNA Oligomer
aauggaauguuuuagcagg

SEQ ID NO: 12657 - RNA, 19 nt, Artificial Sequence
  RNA Oligomer
agggacuuaaggacaaucc

SEQ ID NO: 12658 - RNA, 19 nt, Artificial Sequence
  RNA Oligomer
cuuaaggacaauccucugu

SEQ ID NO: 12659 - RNA, 19 nt, Artificial Sequence
  RNA Oligomer
uuucuuguugaaaagaccu

SEQ ID NO: 12660 - RNA, 19 nt, Artificial Sequence
  RNA Oligomer
auuagcccaguuuugcuca

SEQ ID NO: 12661 - RNA, 19 nt, Artificial Sequence
  RNA Oligomer
aagaagaauuguuucuguc

SEQ ID NO: 12662 - RNA, 19 nt, Artificial Sequence
  RNA Oligomer
uuucacaaccagguugcug

SEQ ID NO: 12663 - RNA, 19 nt, Artificial Sequence
  RNA Oligomer
cauuuuuucuaagucucuc

SEQ ID NO: 12664 - RNA, 19 nt, Artificial Sequence
  RNA Oligomer
aaagccuguuuacaguacu

SEQ ID NO: 12665 - RNA, 19 nt, Artificial Sequence
  RNA Oligomer
uaaacaccauauuggccca

SEQ ID NO: 12666 - RNA, 19 nt, Artificial Sequence
  RNA Oligomer
cacacauauaagugauugu

SEQ ID NO: 12667 - RNA, 19 nt, Artificial Sequence
  RNA Oligomer
aaugugaguaguagcugag

SEQ ID NO: 12668 - RNA, 19 nt, Artificial Sequence
  RNA Oligomer
auacguauuugcaaaugca

SEQ ID NO: 12669 - RNA, 19 nt, Artificial Sequence
  RNA Oligomer
cguauuugcaaaugcaugg

SEQ ID NO: 12670 - RNA, 19 nt, Artificial Sequence
  RNA Oligomer
aagugauugaacuccuugg

SEQ ID NO: 12671 - RNA, 19 nt, Artificial Sequence
  RNA Oligomer
uaagccucaugaauaaggc

SEQ ID NO: 12672 - RNA, 19 nt, Artificial Sequence
  RNA Oligomer
aauaaggcuguugaguacc

SEQ ID NO: 12673 - RNA, 19 nt, Artificial Sequence
  RNA Oligomer
auaaggcuguugaguacca

SEQ ID NO: 12674 - RNA, 19 nt, Artificial Sequence
  RNA Oligomer
cuucuccacaauugagugg

SEQ ID NO: 12675 - RNA, 19 nt, Artificial Sequence
  RNA Oligomer
augcuuucaagccuguauc

SEQ ID NO: 12676 - RNA, 19 nt, Artificial Sequence
  RNA Oligomer
uuagcccaguuuugcucac

SEQ ID NO: 12677 - RNA, 19 nt, Artificial Sequence
  RNA Oligomer
caagaagaauuguuucugu

SEQ ID NO: 12678 - RNA, 19 nt, Artificial Sequence
  RNA Oligomer
aucugcuucaagugcaugu

SEQ ID NO: 12679 - RNA, 19 nt, Artificial Sequence
  RNA Oligomer
uucaagugcauguccacau

SEQ ID NO: 12680 - RNA, 19 nt, Artificial Sequence
  RNA Oligomer
aagugcauguccacauuga

SEQ ID NO: 12681 - RNA, 19 nt, Artificial Sequence
  RNA Oligomer
uugacaccaucaguuuggg

SEQ ID NO: 12682 - RNA, 19 nt, Artificial Sequence
  RNA Oligomer
uucacaaccagguugcuga

SEQ ID NO: 12683 - RNA, 19 nt, Artificial Sequence
  RNA Oligomer
uugcugaguguuacaacga

SEQ ID NO: 12684 - RNA, 19 nt, Artificial Sequence
  RNA Oligomer
gugcaaacaucaaaguugc

SEQ ID NO: 12685 - RNA, 19 nt, Artificial Sequence
  RNA Oligomer
uagcauuacugcuauaucc

SEQ ID NO: 12686 - RNA, 19 nt, Artificial Sequence
  RNA Oligomer
auccuaaaaaaaggagaga

SEQ ID NO: 12687 - RNA, 19 nt, Artificial Sequence
  RNA Oligomer
aaccuugucaaggaguuug

SEQ ID NO: 12688 - RNA, 19 nt, Artificial Sequence
  RNA Oligomer
aacaccauaugugcauuau

SEQ ID NO: 12689 - RNA, 19 nt, Artificial Sequence
  RNA Oligomer
gaguuuauacuguaucugc

SEQ ID NO: 12690 - RNA, 19 nt, Artificial Sequence
  RNA Oligomer
gacuuaaggacaauccucu

SEQ ID NO: 12691 - RNA, 19 nt, Artificial Sequence
  RNA Oligomer
uaaggcuguugaguaccac

SEQ ID NO: 12692 - RNA, 19 nt, Artificial Sequence
  RNA Oligomer
uucuucuccacaauugagu

SEQ ID NO: 12693 - RNA, 19 nt, Artificial Sequence
  RNA Oligomer
uguaucuagaucuccaggu

SEQ ID NO: 12694 - RNA, 19 nt, Artificial Sequence
  RNA Oligomer
guaucuagaucuccagguc

SEQ ID NO: 12695 - RNA, 19 nt, Artificial Sequence
  RNA Oligomer
uaucuagaucuccagguca

SEQ ID NO: 12696 - RNA, 19 nt, Artificial Sequence
  RNA Oligomer
aagaauuguuucugucgcc

SEQ ID NO: 12697 - RNA, 19 nt, Artificial Sequence
  RNA Oligomer
auuuuugagacccacaguc

SEQ ID NO: 12698 - RNA, 19 nt, Artificial Sequence
  RNA Oligomer
aggauacugaugauguagg

SEQ ID NO: 12699 - RNA, 19 nt, Artificial Sequence
  RNA Oligomer
gaacacaugaucugaugga

SEQ ID NO: 12700 - RNA, 19 nt, Artificial Sequence
  RNA Oligomer
augaucugauggacuaggu

SEQ ID NO: 12701 - RNA, 19 nt, Artificial Sequence
  RNA Oligomer
uaaaaaaggcauuuggaga

SEQ ID NO: 12702 - RNA, 19 nt, Artificial Sequence
  RNA Oligomer
uaggcacauuuaauagucc

SEQ ID NO: 12703 - RNA, 19 nt, Artificial Sequence
  RNA Oligomer
uguaaacaccauauuggcc

SEQ ID NO: 12704 - RNA, 19 nt, Artificial Sequence
  RNA Oligomer
uugaacaccauaugugcau

SEQ ID NO: 12705 - RNA, 19 nt, Artificial Sequence
  RNA Oligomer
cgccaagugauugaacucc

SEQ ID NO: 12706 - RNA, 19 nt, Artificial Sequence
  RNA Oligomer
uucuccacaauugagugga

SEQ ID NO: 12707 - RNA, 19 nt, Artificial Sequence
  RNA Oligomer
aauucugguuaucaucggg

SEQ ID NO: 12708 - RNA, 19 nt, Artificial Sequence
  RNA Oligomer
uaauuagcccaguuuugcu

SEQ ID NO: 12709 - RNA, 19 nt, Artificial Sequence
  RNA Oligomer
ugacaccaucaguuugggc

SEQ ID NO: 12710 - RNA, 19 nt, Artificial Sequence
  RNA Oligomer
gacaccaucaguuugggca

SEQ ID NO: 12711 - RNA, 19 nt, Artificial Sequence
  RNA Oligomer
aaagacuugucauagcaga

SEQ ID NO: 12712 - RNA, 19 nt, Artificial Sequence
  RNA Oligomer
ggucacuccaaaagacugc

SEQ ID NO: 12713 - RNA, 19 nt, Artificial Sequence
  RNA Oligomer
auguaaacaccauauuggc

SEQ ID NO: 12714 - RNA, 19 nt, Artificial Sequence
  RNA Oligomer
ucgacacacauauaaguga

SEQ ID NO: 12715 - RNA, 19 nt, Artificial Sequence
  RNA Oligomer
cuggccagaauuauuucag

SEQ ID NO: 12716 - RNA, 19 nt, Artificial Sequence
  RNA Oligomer
ugguccacaauggcuagug

SEQ ID NO: 12717 - RNA, 19 nt, Artificial Sequence
  RNA Oligomer
cacaauggcuaguggcugu

SEQ ID NO: 12718 - RNA, 19 nt, Artificial Sequence
  RNA Oligomer
uuuuugagacccacagucu

SEQ ID NO: 12719 - RNA, 19 nt, Artificial Sequence
  RNA Oligomer
aucaguuugggcaaccuug

SEQ ID NO: 12720 - RNA, 19 nt, Artificial Sequence
  RNA Oligomer
acaacgaaaggcagacugc

SEQ ID NO: 12721 - RNA, 19 nt, Artificial Sequence
  RNA Oligomer
acgaaaggcagacugcuca

SEQ ID NO: 12722 - RNA, 19 nt, Artificial Sequence
  RNA Oligomer
uacauuacaugcaaugaag

SEQ ID NO: 12723 - RNA, 19 nt, Artificial Sequence
  RNA Oligomer
uuaguuguauguguacuac

SEQ ID NO: 12724 - RNA, 19 nt, Artificial Sequence
  RNA Oligomer
uuacuguguauuaaguagg

SEQ ID NO: 12725 - RNA, 19 nt, Artificial Sequence
  RNA Oligomer
uauccauaauaggauacac

SEQ ID NO: 12726 - RNA, 19 nt, Artificial Sequence
  RNA Oligomer
aaaagugugcuuuacuugc

SEQ ID NO: 12727 - RNA, 19 nt, Artificial Sequence
  RNA Oligomer
accuugucaaggaguuugc

SEQ ID NO: 12728 - RNA, 19 nt, Artificial Sequence
  RNA Oligomer
auccaugagaaagguucaa

SEQ ID NO: 12729 - RNA, 19 nt, Artificial Sequence
  RNA Oligomer
uucgacacacauauaagug

SEQ ID NO: 12730 - RNA, 19 nt, Artificial Sequence
  RNA Oligomer
ugugaguaguagcugagga

SEQ ID NO: 12731 - RNA, 19 nt, Artificial Sequence
  RNA Oligomer
uaaggacaauccucugucu

SEQ ID NO: 12732 - RNA, 19 nt, Artificial Sequence
  RNA Oligomer
uucuuguugaaaagaccua

SEQ ID NO: 12733 - RNA, 19 nt, Artificial Sequence
  RNA Oligomer
agucacgccaagugauuga

SEQ ID NO: 12734 - RNA, 19 nt, Artificial Sequence
  RNA Oligomer
cuguugaguaccaccucca

SEQ ID NO: 12735 - RNA, 19 nt, Artificial Sequence
  RNA Oligomer
gaagaauuguuucugucgc

SEQ ID NO: 12736 - RNA, 19 nt, Artificial Sequence
  RNA Oligomer
ugagacccacagucuuugg

SEQ ID NO: 12737 - RNA, 19 nt, Artificial Sequence
  RNA Oligomer
cagcacucaagcugaaucc

SEQ ID NO: 12738 - RNA, 19 nt, Artificial Sequence
  RNA Oligomer
ucugcuucaagugcauguc

SEQ ID NO: 12739 - RNA, 19 nt, Artificial Sequence
  RNA Oligomer
cauguccacauugacacca

SEQ ID NO: 12740 - RNA, 19 nt, Artificial Sequence
  RNA Oligomer
acaaccagguugcugagug

SEQ ID NO: 12741 - RNA, 19 nt, Artificial Sequence
  RNA Oligomer
ugaccguaguuuaacaugg

SEQ ID NO: 12742 - RNA, 19 nt, Artificial Sequence
  RNA Oligomer
gaugucuucaacauauagu

SEQ ID NO: 12743 - RNA, 19 nt, Artificial Sequence
  RNA Oligomer
aaccucucuugcauuccaa

SEQ ID NO: 12744 - RNA, 19 nt, Artificial Sequence
  RNA Oligomer
uacuguguauuaaguagga

SEQ ID NO: 12745 - RNA, 19 nt, Artificial Sequence
  RNA Oligomer
uuugaacaccauaugugca

SEQ ID NO: 12746 - RNA, 19 nt, Artificial Sequence
  RNA Oligomer
cacagaaccauucuuaggg

SEQ ID NO: 12747 - RNA, 19 nt, Artificial Sequence
  RNA Oligomer
aaggcuguugaguaccacc

SEQ ID NO: 12748 - RNA, 19 nt, Artificial Sequence
  RNA Oligomer
gaauucugguuaucaucgg

SEQ ID NO: 12749 - RNA, 19 nt, Artificial Sequence
  RNA Oligomer
uuagagauggugcuucccg

SEQ ID NO: 12750 - RNA, 19 nt, Artificial Sequence
  RNA Oligomer
uugcggcaagaagaauugu

SEQ ID NO: 12751 - RNA, 19 nt, Artificial Sequence
  RNA Oligomer
ugguaagggucgcucuuuc

SEQ ID NO: 12752 - RNA, 19 nt, Artificial Sequence
  RNA Oligomer
aucagcaagaaggccaccu

SEQ ID NO: 12753 - RNA, 19 nt, Artificial Sequence
  RNA Oligomer
aagaaggccaccucaaaga

SEQ ID NO: 12754 - RNA, 19 nt, Artificial Sequence
  RNA Oligomer
ugaugauguagguucgcag

SEQ ID NO: 12755 - RNA, 19 nt, Artificial Sequence
  RNA Oligomer
augauguagguucgcagca

SEQ ID NO: 12756 - RNA, 19 nt, Artificial Sequence
  RNA Oligomer
aaaggcagacugcucaucu

SEQ ID NO: 12757 - RNA, 19 nt, Artificial Sequence
  RNA Oligomer
aaggcagacugcucaucuc

SEQ ID NO: 12758 - RNA, 19 nt, Artificial Sequence
  RNA Oligomer
augcaaugaagcugaacau

SEQ ID NO: 12759 - RNA, 19 nt, Artificial Sequence
  RNA Oligomer
acugaauccucuuucaacc

SEQ ID NO: 12760 - RNA, 19 nt, Artificial Sequence
  RNA Oligomer
aaaguugcuggucacucca

SEQ ID NO: 12761 - RNA, 19 nt, Artificial Sequence
  RNA Oligomer
gucacuccaaaagacugcu

SEQ ID NO: 12762 - RNA, 19 nt, Artificial Sequence
  RNA Oligomer
uauuaaguaggaaaaccca

SEQ ID NO: 12763 - RNA, 19 nt, Artificial Sequence
  RNA Oligomer
uucaguaauagcauuacug

SEQ ID NO: 12764 - RNA, 19 nt, Artificial Sequence
  RNA Oligomer
auccauaauaggauacaca

SEQ ID NO: 12765 - RNA, 19 nt, Artificial Sequence
  RNA Oligomer
aaagugugcuuuacuugcc

SEQ ID NO: 12766 - RNA, 19 nt, Artificial Sequence
  RNA Oligomer
uguuugugaguuuauacug

SEQ ID NO: 12767 - RNA, 19 nt, Artificial Sequence
  RNA Oligomer
gcaaaugcauggaaaaucu

SEQ ID NO: 12768 - RNA, 19 nt, Artificial Sequence
  RNA Oligomer
uucugugggccuugucuga

SEQ ID NO: 12769 - RNA, 19 nt, Artificial Sequence
  RNA Oligomer
caggccuagaaagcuuacc

SEQ ID NO: 12770 - RNA, 19 nt, Artificial Sequence
  RNA Oligomer
aggccuagaaagcuuaccu

SEQ ID NO: 12771 - RNA, 19 nt, Artificial Sequence
  RNA Oligomer
aagucacgccaagugauug

SEQ ID NO: 12772 - RNA, 19 nt, Artificial Sequence
  RNA Oligomer
aucaccuaauggaacucuu

SEQ ID NO: 12773 - RNA, 19 nt, Artificial Sequence
  RNA Oligomer
agaagaauuguuucugucg

SEQ ID NO: 12774 - RNA, 19 nt, Artificial Sequence
  RNA Oligomer
uucaggcacucagaccugu

SEQ ID NO: 12775 - RNA, 19 nt, Artificial Sequence
  RNA Oligomer
agauugggaaagacuuguc

SEQ ID NO: 12776 - RNA, 19 nt, Artificial Sequence
  RNA Oligomer
ugucauagcagacauuuuc

SEQ ID NO: 12777 - RNA, 19 nt, Artificial Sequence
  RNA Oligomer
guugcugaguguuacaacg

SEQ ID NO: 12778 - RNA, 19 nt, Artificial Sequence
  RNA Oligomer
uacaugcaaugaagcugaa

SEQ ID NO: 12779 - RNA, 19 nt, Artificial Sequence
  RNA Oligomer
gcaaacaucaaaguugcug

SEQ ID NO: 12780 - RNA, 19 nt, Artificial Sequence
  RNA Oligomer
acuaaagccuguuuacagu

SEQ ID NO: 12781 - RNA, 19 nt, Artificial Sequence
  RNA Oligomer
ucaguaauagcauuacugc

SEQ ID NO: 12782 - RNA, 19 nt, Artificial Sequence
  RNA Oligomer
aguauccauaauaggauac

SEQ ID NO: 12783 - RNA, 19 nt, Artificial Sequence
  RNA Oligomer
aacaccauauuggcccaca

SEQ ID NO: 12784 - RNA, 19 nt, Artificial Sequence
  RNA Oligomer
aaauauuaagcauggcuug

SEQ ID NO: 12785 - RNA, 19 nt, Artificial Sequence
  RNA Oligomer
uuaagcauggcuugauucc

SEQ ID NO: 12786 - RNA, 19 nt, Artificial Sequence
  RNA Oligomer
aagcauggcuugauucccu

SEQ ID NO: 12787 - RNA, 19 nt, Artificial Sequence
  RNA Oligomer
caaguccauugacaccugg

SEQ ID NO: 12788 - RNA, 19 nt, Artificial Sequence
  RNA Oligomer
cuaagccucaugaauaagg

SEQ ID NO: 12789 - RNA, 19 nt, Artificial Sequence
  RNA Oligomer
uaaccagcuuguacccagg

SEQ ID NO: 12790 - RNA, 19 nt, Artificial Sequence
  RNA Oligomer
auguagguucgcagcaacc

SEQ ID NO: 12791 - RNA, 19 nt, Artificial Sequence
  RNA Oligomer
ucaugacagucagcaacau

SEQ ID NO: 12792 - RNA, 19 nt, Artificial Sequence
  RNA Oligomer
gcaccucauuccaacuccu

SEQ ID NO: 12793 - RNA, 19 nt, Artificial Sequence
  RNA Oligomer
acaaaugagcccgaaucau

SEQ ID NO: 12794 - RNA, 19 nt, Artificial Sequence
  RNA Oligomer
caccucauuccaacuccua

SEQ ID NO: 12795 - RNA, 19 nt, Artificial Sequence
  RNA Oligomer
acccugcaccucauuccaa

SEQ ID NO: 12796 - RNA, 19 nt, Artificial Sequence
  RNA Oligomer
agaggucggaugucuacag

SEQ ID NO: 12797 - RNA, 19 nt, Artificial Sequence
  RNA Oligomer
cugcaccucauuccaacuc

SEQ ID NO: 12798 - RNA, 19 nt, Artificial Sequence
  RNA Oligomer
gcccgaaucaugacaguca

SEQ ID NO: 12799 - RNA, 19 nt, Artificial Sequence
  RNA Oligomer
gaaacagcguaucacugag

SEQ ID NO: 12800 - RNA, 19 nt, Artificial Sequence
  RNA Oligomer
ggugcugacagugcucauu

SEQ ID NO: 12801 - RNA, 19 nt, Artificial Sequence
  RNA Oligomer
guaucacugagaccgaguc

SEQ ID NO: 12802 - RNA, 19 nt, Artificial Sequence
  RNA Oligomer
cccgaaucaugacagucag

SEQ ID NO: 12803 - RNA, 19 nt, Artificial Sequence
  RNA Oligomer
ugagaccgagucgccuuau

SEQ ID NO: 12804 - RNA, 19 nt, Artificial Sequence
  RNA Oligomer
agcgauugcaguugcucua

SEQ ID NO: 12805 - RNA, 19 nt, Artificial Sequence
  RNA Oligomer
ugagcccgaaucaugacag

SEQ ID NO: 12806 - RNA, 19 nt, Artificial Sequence
  RNA Oligomer
ccggaaacagcguaucacu

SEQ ID NO: 12807 - RNA, 19 nt, Artificial Sequence
  RNA Oligomer
agcgaccucaacacacaga

SEQ ID NO: 12808 - RNA, 19 nt, Artificial Sequence
  RNA Oligomer
cggaaacagcguaucacug

SEQ ID NO: 12809 - RNA, 19 nt, Artificial Sequence
  RNA Oligomer
ugcaguugcucuacgguga

SEQ ID NO: 12810 - RNA, 19 nt, Artificial Sequence
  RNA Oligomer
cgauugcaguugcucuacg

SEQ ID NO: 12811 - RNA, 19 nt, Artificial Sequence
  RNA Oligomer
ugacagugcucauugcccu

SEQ ID NO: 12812 - RNA, 19 nt, Artificial Sequence
  RNA Oligomer
gcgauugcaguugcucuac

SEQ ID NO: 12813 - RNA, 19 nt, Artificial Sequence
  RNA Oligomer
cagagcgauugcaguugcu

SEQ ID NO: 12814 - RNA, 19 nt, Artificial Sequence
  RNA Oligomer
auguugcugacugucauga

SEQ ID NO: 12815 - RNA, 19 nt, Artificial Sequence
  RNA Oligomer
aggaguuggaaugaggugc

SEQ ID NO: 12816 - RNA, 19 nt, Artificial Sequence
  RNA Oligomer
augauucgggcucauuugu

SEQ ID NO: 12817 - RNA, 19 nt, Artificial Sequence
  RNA Oligomer
uaggaguuggaaugaggug

SEQ ID NO: 12818 - RNA, 19 nt, Artificial Sequence
  RNA Oligomer
uuggaaugaggugcagggu

SEQ ID NO: 12819 - RNA, 19 nt, Artificial Sequence
  RNA Oligomer
cuguagacauccgaccucu

SEQ ID NO: 12820 - RNA, 19 nt, Artificial Sequence
  RNA Oligomer
gaguuggaaugaggugcag

SEQ ID NO: 12821 - RNA, 19 nt, Artificial Sequence
  RNA Oligomer
ugacugucaugauucgggc

SEQ ID NO: 12822 - RNA, 19 nt, Artificial Sequence
  RNA Oligomer
cucagugauacgcuguuuc

SEQ ID NO: 12823 - RNA, 19 nt, Artificial Sequence
  RNA Oligomer
aaugagcacugucagcacc

SEQ ID NO: 12824 - RNA, 19 nt, Artificial Sequence
  RNA Oligomer
gacucggucucagugauac

SEQ ID NO: 12825 - RNA, 19 nt, Artificial Sequence
  RNA Oligomer
cugacugucaugauucggg

SEQ ID NO: 12826 - RNA, 19 nt, Artificial Sequence
  RNA Oligomer
auaaggcgacucggucuca

SEQ ID NO: 12827 - RNA, 19 nt, Artificial Sequence
  RNA Oligomer
uagagcaacugcaaucgcu

SEQ ID NO: 12828 - RNA, 19 nt, Artificial Sequence
  RNA Oligomer
cugucaugauucgggcuca

SEQ ID NO: 12829 - RNA, 19 nt, Artificial Sequence
  RNA Oligomer
agugauacgcuguuuccgg

SEQ ID NO: 12830 - RNA, 19 nt, Artificial Sequence
  RNA Oligomer
ucuguguguugaggucgcu

SEQ ID NO: 12831 - RNA, 19 nt, Artificial Sequence
  RNA Oligomer
cagugauacgcuguuuccg

SEQ ID NO: 12832 - RNA, 19 nt, Artificial Sequence
  RNA Oligomer
ucaccguagagcaacugca

SEQ ID NO: 12833 - RNA, 19 nt, Artificial Sequence
  RNA Oligomer
cguagagcaacugcaaucg

SEQ ID NO: 12834 - RNA, 19 nt, Artificial Sequence
  RNA Oligomer
agggcaaugagcacuguca

SEQ ID NO: 12835 - RNA, 19 nt, Artificial Sequence
  RNA Oligomer
guagagcaacugcaaucgc

SEQ ID NO: 12836 - RNA, 19 nt, Artificial Sequence
  RNA Oligomer
agcaacugcaaucgcucug

SEQ ID NO: 12837 - RNA, 19 nt, Artificial Sequence
  RNA Oligomer
acaucucauuuuuccguaa

SEQ ID NO: 12838 - RNA, 19 nt, Artificial Sequence
  RNA Oligomer
acauuaagaagggcaaaaa

SEQ ID NO: 12839 - RNA, 19 nt, Artificial Sequence
  RNA Oligomer
gcaucuuauacgaguaaua

SEQ ID NO: 12840 - RNA, 19 nt, Artificial Sequence
  RNA Oligomer
cacaucucauuuuuccgua

SEQ ID NO: 12841 - RNA, 19 nt, Artificial Sequence
  RNA Oligomer
ggaaaauuuuagcgugcuc

SEQ ID NO: 12842 - RNA, 19 nt, Artificial Sequence
  RNA Oligomer
caucucauuuuuccguaaa

SEQ ID NO: 12843 - RNA, 19 nt, Artificial Sequence
  RNA Oligomer
ucacaucucauuuuuccgu

SEQ ID NO: 12844 - RNA, 19 nt, Artificial Sequence
  RNA Oligomer
agaacauuaagaagggcaa

SEQ ID NO: 12845 - RNA, 19 nt, Artificial Sequence
  RNA Oligomer
agacuugacaguggaacua

SEQ ID NO: 12846 - RNA, 19 nt, Artificial Sequence
  RNA Oligomer
ccacccaauucaaaacauu

SEQ ID NO: 12847 - RNA, 19 nt, Artificial Sequence
  RNA Oligomer
aacauuaagaagggcaaaa

SEQ ID NO: 12848 - RNA, 19 nt, Artificial Sequence
  RNA Oligomer
gaacauuaagaagggcaaa

SEQ ID NO: 12849 - RNA, 19 nt, Artificial Sequence
  RNA Oligomer
agcaucuuauacgaguaau

SEQ ID NO: 12850 - RNA, 19 nt, Artificial Sequence
  RNA Oligomer
ccagaauguauauuaaggu

SEQ ID NO: 12851 - RNA, 19 nt, Artificial Sequence
  RNA Oligomer
agcaccagaauguauauua

SEQ ID NO: 12852 - RNA, 19 nt, Artificial Sequence
  RNA Oligomer
cccacccaauucaaaacau

SEQ ID NO: 12853 - RNA, 19 nt, Artificial Sequence
  RNA Oligomer
ccgacuggaagacacguuu

SEQ ID NO: 12854 - RNA, 19 nt, Artificial Sequence
  RNA Oligomer
ggaagauguacggagacau

SEQ ID NO: 12855 - RNA, 19 nt, Artificial Sequence
  RNA Oligomer
accuggaagagaacauuaa

SEQ ID NO: 12856 - RNA, 19 nt, Artificial Sequence
  RNA Oligomer
ugauucgaaugacacuguu

SEQ ID NO: 12857 - RNA, 19 nt, Artificial Sequence
  RNA Oligomer
gccugcuauuugaagugua

SEQ ID NO: 12858 - RNA, 19 nt, Artificial Sequence
  RNA Oligomer
acgaguaauaugccugcua

SEQ ID NO: 12859 - RNA, 19 nt, Artificial Sequence
  RNA Oligomer
ccaugucaaacaaauaguc

SEQ ID NO: 12860 - RNA, 19 nt, Artificial Sequence
  RNA Oligomer
gccaugucaaacaaauagu

SEQ ID NO: 12861 - RNA, 19 nt, Artificial Sequence
  RNA Oligomer
ugaagaagaacaugauguu

SEQ ID NO: 12862 - RNA, 19 nt, Artificial Sequence
  RNA Oligomer
cgagcuaaauucuguggag

SEQ ID NO: 12863 - RNA, 19 nt, Artificial Sequence
  RNA Oligomer
aggaaaauuuuagcgugcu

SEQ ID NO: 12864 - RNA, 19 nt, Artificial Sequence
  RNA Oligomer
cagcaccagaauguauauu

SEQ ID NO: 12865 - RNA, 19 nt, Artificial Sequence
  RNA Oligomer
gagaacauuaagaagggca

SEQ ID NO: 12866 - RNA, 19 nt, Artificial Sequence
  RNA Oligomer
gaaaauuuuagcgugcuca

SEQ ID NO: 12867 - RNA, 19 nt, Artificial Sequence
  RNA Oligomer
uagcaucuuauacgaguaa

SEQ ID NO: 12868 - RNA, 19 nt, Artificial Sequence
  RNA Oligomer
cccagacccaacuaugauu

SEQ ID NO: 12869 - RNA, 19 nt, Artificial Sequence
  RNA Oligomer
acaggaagauguacggaga

SEQ ID NO: 12870 - RNA, 19 nt, Artificial Sequence
  RNA Oligomer
ccgagcuaaauucugugga

SEQ ID NO: 12871 - RNA, 19 nt, Artificial Sequence
  RNA Oligomer
ugaagacauaccgagcuaa

SEQ ID NO: 12872 - RNA, 19 nt, Artificial Sequence
  RNA Oligomer
ccuaucaaguuugagcuuu

SEQ ID NO: 12873 - RNA, 19 nt, Artificial Sequence
  RNA Oligomer
cuacuuugauaugacuguu

SEQ ID NO: 12874 - RNA, 19 nt, Artificial Sequence
  RNA Oligomer
ugaccuggaagagaacauu

SEQ ID NO: 12875 - RNA, 19 nt, Artificial Sequence
  RNA Oligomer
ucaucagauagcaucuuau

SEQ ID NO: 12876 - RNA, 19 nt, Artificial Sequence
  RNA Oligomer
acagcaccagaauguauau

SEQ ID NO: 12877 - RNA, 19 nt, Artificial Sequence
  RNA Oligomer
ccguaaaaaugauuucagu

SEQ ID NO: 12878 - RNA, 19 nt, Artificial Sequence
  RNA Oligomer
accgacuggaagacacguu

SEQ ID NO: 12879 - RNA, 19 nt, Artificial Sequence
  RNA Oligomer
cuaucaaguuugagcuuuc

SEQ ID NO: 12880 - RNA, 19 nt, Artificial Sequence
  RNA Oligomer
gccuaucaaguuugagcuu

SEQ ID NO: 12881 - RNA, 19 nt, Artificial Sequence
  RNA Oligomer
ccaaaaguuacauguuugc

SEQ ID NO: 12882 - RNA, 19 nt, Artificial Sequence
  RNA Oligomer
ugaccaaaaguuacauguu

SEQ ID NO: 12883 - RNA, 19 nt, Artificial Sequence
  RNA Oligomer
ggacaguuuauuuguugag

SEQ ID NO: 12884 - RNA, 19 nt, Artificial Sequence
  RNA Oligomer
guuguuugugccuuuuuau

SEQ ID NO: 12885 - RNA, 19 nt, Artificial Sequence
  RNA Oligomer
cugauucgaaugacacugu

SEQ ID NO: 12886 - RNA, 19 nt, Artificial Sequence
  RNA Oligomer
ccuuaagucagaacagcag

SEQ ID NO: 12887 - RNA, 19 nt, Artificial Sequence
  RNA Oligomer
gaguaauaugccugcuauu

SEQ ID NO: 12888 - RNA, 19 nt, Artificial Sequence
  RNA Oligomer
auagcaucuuauacgagua

SEQ ID NO: 12889 - RNA, 19 nt, Artificial Sequence
  RNA Oligomer
cgacuggaagacacguuug

SEQ ID NO: 12890 - RNA, 19 nt, Artificial Sequence
  RNA Oligomer
agcuaaauucuguggagua

SEQ ID NO: 12891 - RNA, 19 nt, Artificial Sequence
  RNA Oligomer
accaaaaguuacauguuug

SEQ ID NO: 12892 - RNA, 19 nt, Artificial Sequence
  RNA Oligomer
cugaccuggaagagaacau

SEQ ID NO: 12893 - RNA, 19 nt, Artificial Sequence
  RNA Oligomer
gcuauuugaaguguaauug

SEQ ID NO: 12894 - RNA, 19 nt, Artificial Sequence
  RNA Oligomer
caccagaauguauauuaag

SEQ ID NO: 12895 - RNA, 19 nt, Artificial Sequence
  RNA Oligomer
gacaguggaacuacauuag

SEQ ID NO: 12896 - RNA, 19 nt, Artificial Sequence
  RNA Oligomer
agaauguuaagacuugaca

SEQ ID NO: 12897 - RNA, 19 nt, Artificial Sequence
  RNA Oligomer
cugauucacaucucauuuu

SEQ ID NO: 12898 - RNA, 19 nt, Artificial Sequence
  RNA Oligomer
aggaagauguacggagaca

SEQ ID NO: 12899 - RNA, 19 nt, Artificial Sequence
  RNA Oligomer
ggcgaggucaugaagaaga

SEQ ID NO: 12900 - RNA, 19 nt, Artificial Sequence
  RNA Oligomer
acggcgaggucaugaagaa

SEQ ID NO: 12901 - RNA, 19 nt, Artificial Sequence
  RNA Oligomer
augaagacauaccgagcua

SEQ ID NO: 12902 - RNA, 19 nt, Artificial Sequence
  RNA Oligomer
cggacaguuuauuuguuga

SEQ ID NO: 12903 - RNA, 19 nt, Artificial Sequence
  RNA Oligomer
uaaugaacaaauggccuuu

SEQ ID NO: 12904 - RNA, 19 nt, Artificial Sequence
  RNA Oligomer
uuaaugaacaaauggccuu

SEQ ID NO: 12905 - RNA, 19 nt, Artificial Sequence
  RNA Oligomer
aucaucagauagcaucuua

SEQ ID NO: 12906 - RNA, 19 nt, Artificial Sequence
  RNA Oligomer
agaaagguuaguaucauca

SEQ ID NO: 12907 - RNA, 19 nt, Artificial Sequence
  RNA Oligomer
gaauguauauuaaggugug

SEQ ID NO: 12908 - RNA, 19 nt, Artificial Sequence
  RNA Oligomer
cagaauguauauuaaggug

SEQ ID NO: 12909 - RNA, 19 nt, Artificial Sequence
  RNA Oligomer
acaguggaacuacauuagu

SEQ ID NO: 12910 - RNA, 19 nt, Artificial Sequence
  RNA Oligomer
gcccagacccaacuaugau

SEQ ID NO: 12911 - RNA, 19 nt, Artificial Sequence
  RNA Oligomer
gagcuaaauucuguggagu

SEQ ID NO: 12912 - RNA, 19 nt, Artificial Sequence
  RNA Oligomer
agagugugaccaaaaguua

SEQ ID NO: 12913 - RNA, 19 nt, Artificial Sequence
  RNA Oligomer
cugauuucuagguaggaaa

SEQ ID NO: 12914 - RNA, 19 nt, Artificial Sequence
  RNA Oligomer
ggcaggcugauuucuaggu

SEQ ID NO: 12915 - RNA, 19 nt, Artificial Sequence
  RNA Oligomer
cugcucagauagaaugaca

SEQ ID NO: 12916 - RNA, 19 nt, Artificial Sequence
  RNA Oligomer
uuaaaguuguuugugccuu

SEQ ID NO: 12917 - RNA, 19 nt, Artificial Sequence
  RNA Oligomer
guguaauugagaaggaaaa

SEQ ID NO: 12918 - RNA, 19 nt, Artificial Sequence
  RNA Oligomer
cugcuauuugaaguguaau

SEQ ID NO: 12919 - RNA, 19 nt, Artificial Sequence
  RNA Oligomer
cagauagcaucuuauacga

SEQ ID NO: 12920 - RNA, 19 nt, Artificial Sequence
  RNA Oligomer
gguuugaagaauguuaaga

SEQ ID NO: 12921 - RNA, 19 nt, Artificial Sequence
  RNA Oligomer
cagacacugguuugaagaa

SEQ ID NO: 12922 - RNA, 19 nt, Artificial Sequence
  RNA Oligomer
ucccacccaauucaaaaca

SEQ ID NO: 12923 - RNA, 19 nt, Artificial Sequence
  RNA Oligomer
ucaguagcacaaguuauuu

SEQ ID NO: 12924 - RNA, 19 nt, Artificial Sequence
  RNA Oligomer
ugauuucaguagcacaagu

SEQ ID NO: 12925 - RNA, 19 nt, Artificial Sequence
  RNA Oligomer
acaucuuugaaucgcugua

SEQ ID NO: 12926 - RNA, 19 nt, Artificial Sequence
  RNA Oligomer
gugaccaaaaguuacaugu

SEQ ID NO: 12927 - RNA, 19 nt, Artificial Sequence
  RNA Oligomer
ugauuucuagguaggaaau

SEQ ID NO: 12928 - RNA, 19 nt, Artificial Sequence
  RNA Oligomer
caggcugauuucuagguag

SEQ ID NO: 12929 - RNA, 19 nt, Artificial Sequence
  RNA Oligomer
guaacaagccagauuuuuu

SEQ ID NO: 12930 - RNA, 19 nt, Artificial Sequence
  RNA Oligomer
cgaaugacacuguucagga

SEQ ID NO: 12931 - RNA, 19 nt, Artificial Sequence
  RNA Oligomer
gauuucaguagcacaaguu

SEQ ID NO: 12932 - RNA, 19 nt, Artificial Sequence
  RNA Oligomer
acggagacauggcaugaag

SEQ ID NO: 12933 - RNA, 19 nt, Artificial Sequence
  RNA Oligomer
uucggacaguuuauuuguu

SEQ ID NO: 12934 - RNA, 19 nt, Artificial Sequence
  RNA Oligomer
guuucuacuuugauaugac

SEQ ID NO: 12935 - RNA, 19 nt, Artificial Sequence
  RNA Oligomer
ggcugauuucuagguagga

SEQ ID NO: 12936 - RNA, 19 nt, Artificial Sequence
  RNA Oligomer
ugcucagauagaaugacag

SEQ ID NO: 12937 - RNA, 19 nt, Artificial Sequence
  RNA Oligomer
acacuguucaggaaucgga

SEQ ID NO: 12938 - RNA, 19 nt, Artificial Sequence
  RNA Oligomer
guaauaugccugcuauuug

SEQ ID NO: 12939 - RNA, 19 nt, Artificial Sequence
  RNA Oligomer
uucaguagcacaaguuauu

SEQ ID NO: 12940 - RNA, 19 nt, Artificial Sequence
  RNA Oligomer
cgcuguacuacaggaagau

SEQ ID NO: 12941 - RNA, 19 nt, Artificial Sequence
  RNA Oligomer
ucaaagcaugaaauggaua

SEQ ID NO: 12942 - RNA, 19 nt, Artificial Sequence
  RNA Oligomer
cuguucaggaaucggaauc

SEQ ID NO: 12943 - RNA, 19 nt, Artificial Sequence
  RNA Oligomer
ucagauagcaucuuauacg

SEQ ID NO: 12944 - RNA, 19 nt, Artificial Sequence
  RNA Oligomer
caucagauagcaucuuaua

SEQ ID NO: 12945 - RNA, 19 nt, Artificial Sequence
  RNA Oligomer
caacuaugauuagagccaa

SEQ ID NO: 12946 - RNA, 19 nt, Artificial Sequence
  RNA Oligomer
accugugccugccauuaca

SEQ ID NO: 12947 - RNA, 19 nt, Artificial Sequence
  RNA Oligomer
guuuuucggacaguuuauu

SEQ ID NO: 12948 - RNA, 19 nt, Artificial Sequence
  RNA Oligomer
uacggagacauggcaugaa

SEQ ID NO: 12949 - RNA, 19 nt, Artificial Sequence
  RNA Oligomer
ggaacuacauuaguacaca

SEQ ID NO: 12950 - RNA, 19 nt, Artificial Sequence
  RNA Oligomer
agaagaacaugauguucau

SEQ ID NO: 12951 - RNA, 19 nt, Artificial Sequence
  RNA Oligomer
gguagccucacuuuuaaug

SEQ ID NO: 12952 - RNA, 19 nt, Artificial Sequence
  RNA Oligomer
ugguagccucacuuuuaau

SEQ ID NO: 12953 - RNA, 19 nt, Artificial Sequence
  RNA Oligomer
cuggaagagaacauuaaga

SEQ ID NO: 12954 - RNA, 19 nt, Artificial Sequence
  RNA Oligomer
aaguguaauugagaaggaa

SEQ ID NO: 12955 - RNA, 19 nt, Artificial Sequence
  RNA Oligomer
cugguuugaagaauguuaa

SEQ ID NO: 12956 - RNA, 19 nt, Artificial Sequence
  RNA Oligomer
agacacugguuugaagaau

SEQ ID NO: 12957 - RNA, 19 nt, Artificial Sequence
  RNA Oligomer
aacugauucacaucucauu

SEQ ID NO: 12958 - RNA, 19 nt, Artificial Sequence
  RNA Oligomer
ugaacugauucacaucuca

SEQ ID NO: 12959 - RNA, 19 nt, Artificial Sequence
  RNA Oligomer
aggucaugaagaagaacau

SEQ ID NO: 12960 - RNA, 19 nt, Artificial Sequence
  RNA Oligomer
caagagacugagucaaguu

SEQ ID NO: 12961 - RNA, 19 nt, Artificial Sequence
  RNA Oligomer
gcauccguacucccaaaau

SEQ ID NO: 12962 - RNA, 19 nt, Artificial Sequence
  RNA Oligomer
caaaacagauuguuugcaa

SEQ ID NO: 12963 - RNA, 19 nt, Artificial Sequence
  RNA Oligomer
ggguuaccaaugacaacgc

SEQ ID NO: 12964 - RNA, 19 nt, Artificial Sequence
  RNA Oligomer
gucaaacaaauagucuauc

SEQ ID NO: 12965 - RNA, 19 nt, Artificial Sequence
  RNA Oligomer
uggaaauucugcucagaua

SEQ ID NO: 12966 - RNA, 19 nt, Artificial Sequence
  RNA Oligomer
cucugacauucugauucga

SEQ ID NO: 12967 - RNA, 19 nt, Artificial Sequence
  RNA Oligomer
agcucugacauucugauuc

SEQ ID NO: 12968 - RNA, 19 nt, Artificial Sequence
  RNA Oligomer
cccaauucaaaacauugug

SEQ ID NO: 12969 - RNA, 19 nt, Artificial Sequence
  RNA Oligomer
ccggagacaaugacaucuu

SEQ ID NO: 12970 - RNA, 19 nt, Artificial Sequence
  RNA Oligomer
ggcaaaaagugcauccgua

SEQ ID NO: 12971 - RNA, 19 nt, Artificial Sequence
  RNA Oligomer
gggcaaaaagugcauccgu

SEQ ID NO: 12972 - RNA, 19 nt, Artificial Sequence
  RNA Oligomer
cggaauccugucgauuaga

SEQ ID NO: 12973 - RNA, 19 nt, Artificial Sequence
  RNA Oligomer
ucggaauccugucgauuag

SEQ ID NO: 12974 - RNA, 19 nt, Artificial Sequence
  RNA Oligomer
cagcucugacauucugauu

SEQ ID NO: 12975 - RNA, 19 nt, Artificial Sequence
  RNA Oligomer
cccggguuaccaaugacaa

SEQ ID NO: 12976 - RNA, 19 nt, Artificial Sequence
  RNA Oligomer
acccggguuaccaaugaca

SEQ ID NO: 12977 - RNA, 19 nt, Artificial Sequence
  RNA Oligomer
uggaacuacauuaguacac

SEQ ID NO: 12978 - RNA, 19 nt, Artificial Sequence
  RNA Oligomer
acugguuugaagaauguua

SEQ ID NO: 12979 - RNA, 19 nt, Artificial Sequence
  RNA Oligomer
ugugccaugucaaacaaau

SEQ ID NO: 12980 - RNA, 19 nt, Artificial Sequence
  RNA Oligomer
cgucaaaacagauuguuug

SEQ ID NO: 12981 - RNA, 19 nt, Artificial Sequence
  RNA Oligomer
agggccucuucugugacuu

SEQ ID NO: 12982 - RNA, 19 nt, Artificial Sequence
  RNA Oligomer
ggaauccugucgauuagac

SEQ ID NO: 12983 - RNA, 19 nt, Artificial Sequence
  RNA Oligomer
ugccugcuauuugaagugu

SEQ ID NO: 12984 - RNA, 19 nt, Artificial Sequence
  RNA Oligomer
ggaaaagauucccacccaa

SEQ ID NO: 12985 - RNA, 19 nt, Artificial Sequence
  RNA Oligomer
ucaugaagaagaacaugau

SEQ ID NO: 12986 - RNA, 19 nt, Artificial Sequence
  RNA Oligomer
gaggucaugaagaagaaca

SEQ ID NO: 12987 - RNA, 19 nt, Artificial Sequence
  RNA Oligomer
gccucacuuuuaaugaaca

SEQ ID NO: 12988 - RNA, 19 nt, Artificial Sequence
  RNA Oligomer
gcaagugaauuugccugua

SEQ ID NO: 12989 - RNA, 19 nt, Artificial Sequence
  RNA Oligomer
cacugguuugaagaauguu

SEQ ID NO: 12990 - RNA, 19 nt, Artificial Sequence
  RNA Oligomer
acaugauguucaucaagac

SEQ ID NO: 12991 - RNA, 19 nt, Artificial Sequence
  RNA Oligomer
agaacaugauguucaucaa

SEQ ID NO: 12992 - RNA, 19 nt, Artificial Sequence
  RNA Oligomer
cgaggucaugaagaagaac

SEQ ID NO: 12993 - RNA, 19 nt, Artificial Sequence
  RNA Oligomer
gccuguaacaagccagauu

SEQ ID NO: 12994 - RNA, 19 nt, Artificial Sequence
  RNA Oligomer
caagugaauuugccuguaa

SEQ ID NO: 12995 - RNA, 19 nt, Artificial Sequence
  RNA Oligomer
ccggguuaccaaugacaac

SEQ ID NO: 12996 - RNA, 19 nt, Artificial Sequence
  RNA Oligomer
caguggaacuacauuagua

SEQ ID NO: 12997 - RNA, 19 nt, Artificial Sequence
  RNA Oligomer
ugaacaaauggccuuuauu

SEQ ID NO: 12998 - RNA, 19 nt, Artificial Sequence
  RNA Oligomer
ggaaauucugcucagauag

SEQ ID NO: 12999 - RNA, 19 nt, Artificial Sequence
  RNA Oligomer
gaaucggaauccugucgau

SEQ ID NO: 13000 - RNA, 19 nt, Artificial Sequence
  RNA Oligomer
ggaaucggaauccugucga

SEQ ID NO: 13001 - RNA, 19 nt, Artificial Sequence
  RNA Oligomer
cugacauucugauucgaau

SEQ ID NO: 13002 - RNA, 19 nt, Artificial Sequence
  RNA Oligomer
gucaaguuguuccuuaagu

SEQ ID NO: 13003 - RNA, 19 nt, Artificial Sequence
  RNA Oligomer
gagacugagucaaguuguu

SEQ ID NO: 13004 - RNA, 19 nt, Artificial Sequence
  RNA Oligomer
cuacauuaguacacagcac

SEQ ID NO: 13005 - RNA, 19 nt, Artificial Sequence
  RNA Oligomer
gaacuacauuaguacacag

SEQ ID NO: 13006 - RNA, 19 nt, Artificial Sequence
  RNA Oligomer
cccagacacugguuugaag

SEQ ID NO: 13007 - RNA, 19 nt, Artificial Sequence
  RNA Oligomer
gugagagacauuaacucau

SEQ ID NO: 13008 - RNA, 19 nt, Artificial Sequence
  RNA Oligomer
ucgcuguacuacaggaaga

SEQ ID NO: 13009 - RNA, 19 nt, Artificial Sequence
  RNA Oligomer
ccaagccuaucaaguuuga

SEQ ID NO: 13010 - RNA, 19 nt, Artificial Sequence
  RNA Oligomer
ccucacuuuuaaugaacaa

SEQ ID NO: 13011 - RNA, 19 nt, Artificial Sequence
  RNA Oligomer
aucguucaaagcaugaaau

SEQ ID NO: 13012 - RNA, 19 nt, Artificial Sequence
  RNA Oligomer
ccuguaacaagccagauuu

SEQ ID NO: 13013 - RNA, 19 nt, Artificial Sequence
  RNA Oligomer
acauucugauucgaaugac

SEQ ID NO: 13014 - RNA, 19 nt, Artificial Sequence
  RNA Oligomer
gacauucugauucgaauga

SEQ ID NO: 13015 - RNA, 19 nt, Artificial Sequence
  RNA Oligomer
cggguuaccaaugacaacg

SEQ ID NO: 13016 - RNA, 19 nt, Artificial Sequence
  RNA Oligomer
gccaucaagagacugaguc

SEQ ID NO: 13017 - RNA, 19 nt, Artificial Sequence
  RNA Oligomer
gugccaugucaaacaaaua

SEQ ID NO: 13018 - RNA, 19 nt, Artificial Sequence
  RNA Oligomer
gggaaaagauucccaccca

SEQ ID NO: 13019 - RNA, 19 nt, Artificial Sequence
  RNA Oligomer
cuguacuacaggaagaugu

SEQ ID NO: 13020 - RNA, 19 nt, Artificial Sequence
  RNA Oligomer
gccugccauuacaacuguc

SEQ ID NO: 13021 - RNA, 19 nt, Artificial Sequence
  RNA Oligomer
ugcaccagcaugaagacau

SEQ ID NO: 13022 - RNA, 19 nt, Artificial Sequence
  RNA Oligomer
ugcauccguacucccaaaa

SEQ ID NO: 13023 - RNA, 19 nt, Artificial Sequence
  RNA Oligomer
aaauucugcucagauagaa

SEQ ID NO: 13024 - RNA, 19 nt, Artificial Sequence
  RNA Oligomer
cugucgauuagacuggaca

SEQ ID NO: 13025 - RNA, 19 nt, Artificial Sequence
  RNA Oligomer
ucaagagacugagucaagu

SEQ ID NO: 13026 - RNA, 19 nt, Artificial Sequence
  RNA Oligomer
ccagccaucaagagacuga

SEQ ID NO: 13027 - RNA, 19 nt, Artificial Sequence
  RNA Oligomer
agguuaguaucaucagaua

SEQ ID NO: 13028 - RNA, 19 nt, Artificial Sequence
  RNA Oligomer
uuaguacacagcaccagaa

SEQ ID NO: 13029 - RNA, 19 nt, Artificial Sequence
  RNA Oligomer
ugccaugucaaacaaauag

SEQ ID NO: 13030 - RNA, 19 nt, Artificial Sequence
  RNA Oligomer
acccaauucaaaacauugu

SEQ ID NO: 13031 - RNA, 19 nt, Artificial Sequence
  RNA Oligomer
cccggagacaaugacaucu

SEQ ID NO: 13032 - RNA, 19 nt, Artificial Sequence
  RNA Oligomer
ccagcaugaagacauaccg

SEQ ID NO: 13033 - RNA, 19 nt, Artificial Sequence
  RNA Oligomer
gcaaaaagugcauccguac

SEQ ID NO: 13034 - RNA, 19 nt, Artificial Sequence
  RNA Oligomer
ucaaaacagauuguuugca

SEQ ID NO: 13035 - RNA, 19 nt, Artificial Sequence
  RNA Oligomer
gaaauucugcucagauaga

SEQ ID NO: 13036 - RNA, 19 nt, Artificial Sequence
  RNA Oligomer
ggcaagugaauuugccugu

SEQ ID NO: 13037 - RNA, 19 nt, Artificial Sequence
  RNA Oligomer
guuguuccuuaagucagaa

SEQ ID NO: 13038 - RNA, 19 nt, Artificial Sequence
  RNA Oligomer
ccagacacugguuugaaga

SEQ ID NO: 13039 - RNA, 19 nt, Artificial Sequence
  RNA Oligomer
ccaauucaaaacauugugc

SEQ ID NO: 13040 - RNA, 19 nt, Artificial Sequence
  RNA Oligomer
gagugagagacauuaacuc

SEQ ID NO: 13041 - RNA, 19 nt, Artificial Sequence
  RNA Oligomer
gacauggcaugaagccaga

SEQ ID NO: 13042 - RNA, 19 nt, Artificial Sequence
  RNA Oligomer
gucccggagacaaugacau

SEQ ID NO: 13043 - RNA, 19 nt, Artificial Sequence
  RNA Oligomer
caacugucccggagacaau

SEQ ID NO: 13044 - RNA, 19 nt, Artificial Sequence
  RNA Oligomer
gucaugaagaagaacauga

SEQ ID NO: 13045 - RNA, 19 nt, Artificial Sequence
  RNA Oligomer
gacuguuuuucggacaguu

SEQ ID NO: 13046 - RNA, 19 nt, Artificial Sequence
  RNA Oligomer
ugacuguuuuucggacagu

SEQ ID NO: 13047 - RNA, 19 nt, Artificial Sequence
  RNA Oligomer
agaagggcaaaaagugcau

SEQ ID NO: 13048 - RNA, 19 nt, Artificial Sequence
  RNA Oligomer
ccugucgauuagacuggac

SEQ ID NO: 13049 - RNA, 19 nt, Artificial Sequence
  RNA Oligomer
ugacagcuaggaugugcau

SEQ ID NO: 13050 - RNA, 19 nt, Artificial Sequence
  RNA Oligomer
agacccaacuaugauuaga

SEQ ID NO: 13051 - RNA, 19 nt, Artificial Sequence
  RNA Oligomer
ucaaaacauugugccaugu

SEQ ID NO: 13052 - RNA, 19 nt, Artificial Sequence
  RNA Oligomer
uccguaaaaaugauuucag

SEQ ID NO: 13053 - RNA, 19 nt, Artificial Sequence
  RNA Oligomer
gaaucgcuguacuacagga

SEQ ID NO: 13054 - RNA, 19 nt, Artificial Sequence
  RNA Oligomer
gugccugccauuacaacug

SEQ ID NO: 13055 - RNA, 19 nt, Artificial Sequence
  RNA Oligomer
ugauguucaucaagaccug

SEQ ID NO: 13056 - RNA, 19 nt, Artificial Sequence
  RNA Oligomer
gugugaccaaaaguuacau

SEQ ID NO: 13057 - RNA, 19 nt, Artificial Sequence
  RNA Oligomer
gugguagccucacuuuuaa

SEQ ID NO: 13058 - RNA, 19 nt, Artificial Sequence
  RNA Oligomer
aaaugugguagccucacuu

SEQ ID NO: 13059 - RNA, 19 nt, Artificial Sequence
  RNA Oligomer
cuguaacaagccagauuuu

SEQ ID NO: 13060 - RNA, 19 nt, Artificial Sequence
  RNA Oligomer
uccugucgauuagacugga

SEQ ID NO: 13061 - RNA, 19 nt, Artificial Sequence
  RNA Oligomer
cuccagccaucaagagacu

SEQ ID NO: 13062 - RNA, 19 nt, Artificial Sequence
  RNA Oligomer
ccauuacaacugucccgga

SEQ ID NO: 13063 - RNA, 19 nt, Artificial Sequence
  RNA Oligomer
caaggaccaaaccgugguu

SEQ ID NO: 13064 - RNA, 19 nt, Artificial Sequence
  RNA Oligomer
gugaauuugccuguaacaa

SEQ ID NO: 13065 - RNA, 19 nt, Artificial Sequence
  RNA Oligomer
aagguuaguaucaucagau

SEQ ID NO: 13066 - RNA, 19 nt, Artificial Sequence
  RNA Oligomer
gaacaugauguucaucaag

SEQ ID NO: 13067 - RNA, 19 nt, Artificial Sequence
  RNA Oligomer
agccuaucaaguuugagcu

SEQ ID NO: 13068 - RNA, 19 nt, Artificial Sequence
  RNA Oligomer
caaaacauugugccauguc

SEQ ID NO: 13069 - RNA, 19 nt, Artificial Sequence
  RNA Oligomer
agauucccacccaauucaa

SEQ ID NO: 13070 - RNA, 19 nt, Artificial Sequence
  RNA Oligomer
ggagacaaugacaucuuug

SEQ ID NO: 13071 - RNA, 19 nt, Artificial Sequence
  RNA Oligomer
uccaagccuaucaaguuug

SEQ ID NO: 13072 - RNA, 19 nt, Artificial Sequence
  RNA Oligomer
cuguuuuucggacaguuua

SEQ ID NO: 13073 - RNA, 19 nt, Artificial Sequence
  RNA Oligomer
agccucacuuuuaaugaac

SEQ ID NO: 13074 - RNA, 19 nt, Artificial Sequence
  RNA Oligomer
gaaaugugguagccucacu

SEQ ID NO: 13075 - RNA, 19 nt, Artificial Sequence
  RNA Oligomer
ggaaaugugguagccucac

SEQ ID NO: 13076 - RNA, 19 nt, Artificial Sequence
  RNA Oligomer
uucaaagcaugaaauggau

SEQ ID NO: 13077 - RNA, 19 nt, Artificial Sequence
  RNA Oligomer
cugagucaaguuguuccuu

SEQ ID NO: 13078 - RNA, 19 nt, Artificial Sequence
  RNA Oligomer
caucaagagacugagucaa

SEQ ID NO: 13079 - RNA, 19 nt, Artificial Sequence
  RNA Oligomer
agacauggcaugaagccag

SEQ ID NO: 13080 - RNA, 19 nt, Artificial Sequence
  RNA Oligomer
ugacaucuuugaaucgcug

SEQ ID NO: 13081 - RNA, 19 nt, Artificial Sequence
  RNA Oligomer
ugccugccauuacaacugu

SEQ ID NO: 13082 - RNA, 19 nt, Artificial Sequence
  RNA Oligomer
ccugugccugccauuacaa

SEQ ID NO: 13083 - RNA, 19 nt, Artificial Sequence
  RNA Oligomer
ugccuguaacaagccagau

SEQ ID NO: 13084 - RNA, 19 nt, Artificial Sequence
  RNA Oligomer
ccagugacagcuaggaugu

SEQ ID NO: 13085 - RNA, 19 nt, Artificial Sequence
  RNA Oligomer
ccaacuaugauuagagcca

SEQ ID NO: 13086 - RNA, 19 nt, Artificial Sequence
  RNA Oligomer
agaccugugccugccauua

SEQ ID NO: 13087 - RNA, 19 nt, Artificial Sequence
  RNA Oligomer
acuguuuuucggacaguuu

SEQ ID NO: 13088 - RNA, 19 nt, Artificial Sequence
  RNA Oligomer
uagccucacuuuuaaugaa

SEQ ID NO: 13089 - RNA, 19 nt, Artificial Sequence
  RNA Oligomer
agguguggcuuuaggagca

SEQ ID NO: 13090 - RNA, 19 nt, Artificial Sequence
  RNA Oligomer
agcugcaaguaccagugca

SEQ ID NO: 13091 - RNA, 19 nt, Artificial Sequence
  RNA Oligomer
ucagcucugacauucugau

SEQ ID NO: 13092 - RNA, 19 nt, Artificial Sequence
  RNA Oligomer
agacaaugacaucuuugaa

SEQ ID NO: 13093 - RNA, 19 nt, Artificial Sequence
  RNA Oligomer
gacccaacuaugauuagag

SEQ ID NO: 13094 - RNA, 19 nt, Artificial Sequence
  RNA Oligomer
uuacggaaaaaugagaugu

SEQ ID NO: 13095 - RNA, 19 nt, Artificial Sequence
  RNA Oligomer
uuuuugcccuucuuaaugu

SEQ ID NO: 13096 - RNA, 19 nt, Artificial Sequence
  RNA Oligomer
uauuacucguauaagaugc

SEQ ID NO: 13097 - RNA, 19 nt, Artificial Sequence
  RNA Oligomer
uacggaaaaaugagaugug

SEQ ID NO: 13098 - RNA, 19 nt, Artificial Sequence
  RNA Oligomer
gagcacgcuaaaauuuucc

SEQ ID NO: 13099 - RNA, 19 nt, Artificial Sequence
  RNA Oligomer
uuuacggaaaaaugagaug

SEQ ID NO: 13100 - RNA, 19 nt, Artificial Sequence
  RNA Oligomer
acggaaaaaugagauguga

SEQ ID NO: 13101 - RNA, 19 nt, Artificial Sequence
  RNA Oligomer
uugcccuucuuaauguucu

SEQ ID NO: 13102 - RNA, 19 nt, Artificial Sequence
  RNA Oligomer
uaguuccacugucaagucu

SEQ ID NO: 13103 - RNA, 19 nt, Artificial Sequence
  RNA Oligomer
aauguuuugaauugggugg

SEQ ID NO: 13104 - RNA, 19 nt, Artificial Sequence
  RNA Oligomer
uuuugcccuucuuaauguu

SEQ ID NO: 13105 - RNA, 19 nt, Artificial Sequence
  RNA Oligomer
uuugcccuucuuaauguuc

SEQ ID NO: 13106 - RNA, 19 nt, Artificial Sequence
  RNA Oligomer
auuacucguauaagaugcu

SEQ ID NO: 13107 - RNA, 19 nt, Artificial Sequence
  RNA Oligomer
accuuaauauacauucugg

SEQ ID NO: 13108 - RNA, 19 nt, Artificial Sequence
  RNA Oligomer
uaauauacauucuggugcu

SEQ ID NO: 13109 - RNA, 19 nt, Artificial Sequence
  RNA Oligomer
auguuuugaauuggguggg

SEQ ID NO: 13110 - RNA, 19 nt, Artificial Sequence
  RNA Oligomer
aaacgugucuuccagucgg

SEQ ID NO: 13111 - RNA, 19 nt, Artificial Sequence
  RNA Oligomer
augucuccguacaucuucc

SEQ ID NO: 13112 - RNA, 19 nt, Artificial Sequence
  RNA Oligomer
uuaauguucucuuccaggu

SEQ ID NO: 13113 - RNA, 19 nt, Artificial Sequence
  RNA Oligomer
aacagugucauucgaauca

SEQ ID NO: 13114 - RNA, 19 nt, Artificial Sequence
  RNA Oligomer
uacacuucaaauagcaggc

SEQ ID NO: 13115 - RNA, 19 nt, Artificial Sequence
  RNA Oligomer
uagcaggcauauuacucgu

SEQ ID NO: 13116 - RNA, 19 nt, Artificial Sequence
  RNA Oligomer
gacuauuuguuugacaugg

SEQ ID NO: 13117 - RNA, 19 nt, Artificial Sequence
  RNA Oligomer
acuauuuguuugacauggc

SEQ ID NO: 13118 - RNA, 19 nt, Artificial Sequence
  RNA Oligomer
aacaucauguucuucuuca

SEQ ID NO: 13119 - RNA, 19 nt, Artificial Sequence
  RNA Oligomer
cuccacagaauuuagcucg

SEQ ID NO: 13120 - RNA, 19 nt, Artificial Sequence
  RNA Oligomer
agcacgcuaaaauuuuccu

SEQ ID NO: 13121 - RNA, 19 nt, Artificial Sequence
  RNA Oligomer
aauauacauucuggugcug

SEQ ID NO: 13122 - RNA, 19 nt, Artificial Sequence
  RNA Oligomer
ugcccuucuuaauguucuc

SEQ ID NO: 13123 - RNA, 19 nt, Artificial Sequence
  RNA Oligomer
ugagcacgcuaaaauuuuc

SEQ ID NO: 13124 - RNA, 19 nt, Artificial Sequence
  RNA Oligomer
uuacucguauaagaugcua

SEQ ID NO: 13125 - RNA, 19 nt, Artificial Sequence
  RNA Oligomer
aaucauaguugggucuggg

SEQ ID NO: 13126 - RNA, 19 nt, Artificial Sequence
  RNA Oligomer
ucuccguacaucuuccugu

SEQ ID NO: 13127 - RNA, 19 nt, Artificial Sequence
  RNA Oligomer
uccacagaauuuagcucgg

SEQ ID NO: 13128 - RNA, 19 nt, Artificial Sequence
  RNA Oligomer
uuagcucgguaugucuuca

SEQ ID NO: 13129 - RNA, 19 nt, Artificial Sequence
  RNA Oligomer
aaagcucaaacuugauagg

SEQ ID NO: 13130 - RNA, 19 nt, Artificial Sequence
  RNA Oligomer
aacagucauaucaaaguag

SEQ ID NO: 13131 - RNA, 19 nt, Artificial Sequence
  RNA Oligomer
aauguucucuuccagguca

SEQ ID NO: 13132 - RNA, 19 nt, Artificial Sequence
  RNA Oligomer
auaagaugcuaucugauga

SEQ ID NO: 13133 - RNA, 19 nt, Artificial Sequence
  RNA Oligomer
auauacauucuggugcugu

SEQ ID NO: 13134 - RNA, 19 nt, Artificial Sequence
  RNA Oligomer
acugaaaucauuuuuacgg

SEQ ID NO: 13135 - RNA, 19 nt, Artificial Sequence
  RNA Oligomer
aacgugucuuccagucggu

SEQ ID NO: 13136 - RNA, 19 nt, Artificial Sequence
  RNA Oligomer
gaaagcucaaacuugauag

SEQ ID NO: 13137 - RNA, 19 nt, Artificial Sequence
  RNA Oligomer
aagcucaaacuugauaggc

SEQ ID NO: 13138 - RNA, 19 nt, Artificial Sequence
  RNA Oligomer
gcaaacauguaacuuuugg

SEQ ID NO: 13139 - RNA, 19 nt, Artificial Sequence
  RNA Oligomer
aacauguaacuuuugguca

SEQ ID NO: 13140 - RNA, 19 nt, Artificial Sequence
  RNA Oligomer
cucaacaaauaaacugucc

SEQ ID NO: 13141 - RNA, 19 nt, Artificial Sequence
  RNA Oligomer
auaaaaaggcacaaacaac

SEQ ID NO: 13142 - RNA, 19 nt, Artificial Sequence
  RNA Oligomer
acagugucauucgaaucag

SEQ ID NO: 13143 - RNA, 19 nt, Artificial Sequence
  RNA Oligomer
cugcuguucugacuuaagg

SEQ ID NO: 13144 - RNA, 19 nt, Artificial Sequence
  RNA Oligomer
aauagcaggcauauuacuc

SEQ ID NO: 13145 - RNA, 19 nt, Artificial Sequence
  RNA Oligomer
uacucguauaagaugcuau

SEQ ID NO: 13146 - RNA, 19 nt, Artificial Sequence
  RNA Oligomer
caaacgugucuuccagucg

SEQ ID NO: 13147 - RNA, 19 nt, Artificial Sequence
  RNA Oligomer
uacuccacagaauuuagcu

SEQ ID NO: 13148 - RNA, 19 nt, Artificial Sequence
  RNA Oligomer
caaacauguaacuuuuggu

SEQ ID NO: 13149 - RNA, 19 nt, Artificial Sequence
  RNA Oligomer
auguucucuuccaggucag

SEQ ID NO: 13150 - RNA, 19 nt, Artificial Sequence
  RNA Oligomer
caauuacacuucaaauagc

SEQ ID NO: 13151 - RNA, 19 nt, Artificial Sequence
  RNA Oligomer
cuuaauauacauucuggug

SEQ ID NO: 13152 - RNA, 19 nt, Artificial Sequence
  RNA Oligomer
cuaauguaguuccacuguc

SEQ ID NO: 13153 - RNA, 19 nt, Artificial Sequence
  RNA Oligomer
ugucaagucuuaacauucu

SEQ ID NO: 13154 - RNA, 19 nt, Artificial Sequence
  RNA Oligomer
aaaaugagaugugaaucag

SEQ ID NO: 13155 - RNA, 19 nt, Artificial Sequence
  RNA Oligomer
ugucuccguacaucuuccu

SEQ ID NO: 13156 - RNA, 19 nt, Artificial Sequence
  RNA Oligomer
ucuucuucaugaccucgcc

SEQ ID NO: 13157 - RNA, 19 nt, Artificial Sequence
  RNA Oligomer
uucuucaugaccucgccgu

SEQ ID NO: 13158 - RNA, 19 nt, Artificial Sequence
  RNA Oligomer
uagcucgguaugucuucau

SEQ ID NO: 13159 - RNA, 19 nt, Artificial Sequence
  RNA Oligomer
ucaacaaauaaacuguccg

SEQ ID NO: 13160 - RNA, 19 nt, Artificial Sequence
  RNA Oligomer
aaaggccauuuguucauua

SEQ ID NO: 13161 - RNA, 19 nt, Artificial Sequence
  RNA Oligomer
aaggccauuuguucauuaa

SEQ ID NO: 13162 - RNA, 19 nt, Artificial Sequence
  RNA Oligomer
uaagaugcuaucugaugau

SEQ ID NO: 13163 - RNA, 19 nt, Artificial Sequence
  RNA Oligomer
ugaugauacuaaccuuucu

SEQ ID NO: 13164 - RNA, 19 nt, Artificial Sequence
  RNA Oligomer
cacaccuuaauauacauuc

SEQ ID NO: 13165 - RNA, 19 nt, Artificial Sequence
  RNA Oligomer
caccuuaauauacauucug

SEQ ID NO: 13166 - RNA, 19 nt, Artificial Sequence
  RNA Oligomer
acuaauguaguuccacugu

SEQ ID NO: 13167 - RNA, 19 nt, Artificial Sequence
  RNA Oligomer
aucauaguugggucugggc

SEQ ID NO: 13168 - RNA, 19 nt, Artificial Sequence
  RNA Oligomer
acuccacagaauuuagcuc

SEQ ID NO: 13169 - RNA, 19 nt, Artificial Sequence
  RNA Oligomer
uaacuuuuggucacacucu

SEQ ID NO: 13170 - RNA, 19 nt, Artificial Sequence
  RNA Oligomer
uuuccuaccuagaaaucag

SEQ ID NO: 13171 - RNA, 19 nt, Artificial Sequence
  RNA Oligomer
accuagaaaucagccugcc

SEQ ID NO: 13172 - RNA, 19 nt, Artificial Sequence
  RNA Oligomer
ugucauucuaucugagcag

SEQ ID NO: 13173 - RNA, 19 nt, Artificial Sequence
  RNA Oligomer
aaggcacaaacaacuuuaa

SEQ ID NO: 13174 - RNA, 19 nt, Artificial Sequence
  RNA Oligomer
uuuuccuucucaauuacac

SEQ ID NO: 13175 - RNA, 19 nt, Artificial Sequence
  RNA Oligomer
auuacacuucaaauagcag

SEQ ID NO: 13176 - RNA, 19 nt, Artificial Sequence
  RNA Oligomer
ucguauaagaugcuaucug

SEQ ID NO: 13177 - RNA, 19 nt, Artificial Sequence
  RNA Oligomer
ucuuaacauucuucaaacc

SEQ ID NO: 13178 - RNA, 19 nt, Artificial Sequence
  RNA Oligomer
uucuucaaaccagugucug

SEQ ID NO: 13179 - RNA, 19 nt, Artificial Sequence
  RNA Oligomer
uguuuugaauuggguggga

SEQ ID NO: 13180 - RNA, 19 nt, Artificial Sequence
  RNA Oligomer
aaauaacuugugcuacuga

SEQ ID NO: 13181 - RNA, 19 nt, Artificial Sequence
  RNA Oligomer
acuugugcuacugaaauca

SEQ ID NO: 13182 - RNA, 19 nt, Artificial Sequence
  RNA Oligomer
uacagcgauucaaagaugu

SEQ ID NO: 13183 - RNA, 19 nt, Artificial Sequence
  RNA Oligomer
acauguaacuuuuggucac

SEQ ID NO: 13184 - RNA, 19 nt, Artificial Sequence
  RNA Oligomer
auuuccuaccuagaaauca

SEQ ID NO: 13185 - RNA, 19 nt, Artificial Sequence
  RNA Oligomer
cuaccuagaaaucagccug

SEQ ID NO: 13186 - RNA, 19 nt, Artificial Sequence
  RNA Oligomer
aaaaaaucuggcuuguuac

SEQ ID NO: 13187 - RNA, 19 nt, Artificial Sequence
  RNA Oligomer
uccugaacagugucauucg

SEQ ID NO: 13188 - RNA, 19 nt, Artificial Sequence
  RNA Oligomer
aacuugugcuacugaaauc

SEQ ID NO: 13189 - RNA, 19 nt, Artificial Sequence
  RNA Oligomer
cuucaugccaugucuccgu

SEQ ID NO: 13190 - RNA, 19 nt, Artificial Sequence
  RNA Oligomer
aacaaauaaacuguccgaa

SEQ ID NO: 13191 - RNA, 19 nt, Artificial Sequence
  RNA Oligomer
gucauaucaaaguagaaac

SEQ ID NO: 13192 - RNA, 19 nt, Artificial Sequence
  RNA Oligomer
uccuaccuagaaaucagcc

SEQ ID NO: 13193 - RNA, 19 nt, Artificial Sequence
  RNA Oligomer
cugucauucuaucugagca

SEQ ID NO: 13194 - RNA, 19 nt, Artificial Sequence
  RNA Oligomer
uccgauuccugaacagugu

SEQ ID NO: 13195 - RNA, 19 nt, Artificial Sequence
  RNA Oligomer
caaauagcaggcauauuac

SEQ ID NO: 13196 - RNA, 19 nt, Artificial Sequence
  RNA Oligomer
aauaacuugugcuacugaa

SEQ ID NO: 13197 - RNA, 19 nt, Artificial Sequence
  RNA Oligomer
aucuuccuguaguacagcg

SEQ ID NO: 13198 - RNA, 19 nt, Artificial Sequence
  RNA Oligomer
uauccauuucaugcuuuga

SEQ ID NO: 13199 - RNA, 19 nt, Artificial Sequence
  RNA Oligomer
gauuccgauuccugaacag

SEQ ID NO: 13200 - RNA, 19 nt, Artificial Sequence
  RNA Oligomer
cguauaagaugcuaucuga

SEQ ID NO: 13201 - RNA, 19 nt, Artificial Sequence
  RNA Oligomer
uauaagaugcuaucugaug

SEQ ID NO: 13202 - RNA, 19 nt, Artificial Sequence
  RNA Oligomer
uuggcucuaaucauaguug

SEQ ID NO: 13203 - RNA, 19 nt, Artificial Sequence
  RNA Oligomer
uguaauggcaggcacaggu

SEQ ID NO: 13204 - RNA, 19 nt, Artificial Sequence
  RNA Oligomer
aauaaacuguccgaaaaac

SEQ ID NO: 13205 - RNA, 19 nt, Artificial Sequence
  RNA Oligomer
uucaugccaugucuccgua

SEQ ID NO: 13206 - RNA, 19 nt, Artificial Sequence
  RNA Oligomer
uguguacuaauguaguucc

SEQ ID NO: 13207 - RNA, 19 nt, Artificial Sequence
  RNA Oligomer
augaacaucauguucuucu

SEQ ID NO: 13208 - RNA, 19 nt, Artificial Sequence
  RNA Oligomer
cauuaaaagugaggcuacc

SEQ ID NO: 13209 - RNA, 19 nt, Artificial Sequence
  RNA Oligomer
auuaaaagugaggcuacca

SEQ ID NO: 13210 - RNA, 19 nt, Artificial Sequence
  RNA Oligomer
ucuuaauguucucuuccag

SEQ ID NO: 13211 - RNA, 19 nt, Artificial Sequence
  RNA Oligomer
uuccuucucaauuacacuu

SEQ ID NO: 13212 - RNA, 19 nt, Artificial Sequence
  RNA Oligomer
uuaacauucuucaaaccag

SEQ ID NO: 13213 - RNA, 19 nt, Artificial Sequence
  RNA Oligomer
auucuucaaaccagugucu

SEQ ID NO: 13214 - RNA, 19 nt, Artificial Sequence
  RNA Oligomer
aaugagaugugaaucaguu

SEQ ID NO: 13215 - RNA, 19 nt, Artificial Sequence
  RNA Oligomer
ugagaugugaaucaguuca

SEQ ID NO: 13216 - RNA, 19 nt, Artificial Sequence
  RNA Oligomer
auguucuucuucaugaccu

SEQ ID NO: 13217 - RNA, 19 nt, Artificial Sequence
  RNA Oligomer
aacuugacucagucucuug

SEQ ID NO: 13218 - RNA, 19 nt, Artificial Sequence
  RNA Oligomer
auuuugggaguacggaugc

SEQ ID NO: 13219 - RNA, 19 nt, Artificial Sequence
  RNA Oligomer
uugcaaacaaucuguuuug

SEQ ID NO: 13220 - RNA, 19 nt, Artificial Sequence
  RNA Oligomer
gcguugucauugguaaccc

SEQ ID NO: 13221 - RNA, 19 nt, Artificial Sequence
  RNA Oligomer
gauagacuauuuguuugac

SEQ ID NO: 13222 - RNA, 19 nt, Artificial Sequence
  RNA Oligomer
uaucugagcagaauuucca

SEQ ID NO: 13223 - RNA, 19 nt, Artificial Sequence
  RNA Oligomer
ucgaaucagaaugucagag

SEQ ID NO: 13224 - RNA, 19 nt, Artificial Sequence
  RNA Oligomer
gaaucagaaugucagagcu

SEQ ID NO: 13225 - RNA, 19 nt, Artificial Sequence
  RNA Oligomer
cacaauguuuugaauuggg

SEQ ID NO: 13226 - RNA, 19 nt, Artificial Sequence
  RNA Oligomer
aagaugucauugucuccgg

SEQ ID NO: 13227 - RNA, 19 nt, Artificial Sequence
  RNA Oligomer
uacggaugcacuuuuugcc

SEQ ID NO: 13228 - RNA, 19 nt, Artificial Sequence
  RNA Oligomer
acggaugcacuuuuugccc

SEQ ID NO: 13229 - RNA, 19 nt, Artificial Sequence
  RNA Oligomer
ucuaaucgacaggauuccg

SEQ ID NO: 13230 - RNA, 19 nt, Artificial Sequence
  RNA Oligomer
cuaaucgacaggauuccga

SEQ ID NO: 13231 - RNA, 19 nt, Artificial Sequence
  RNA Oligomer
aaucagaaugucagagcug

SEQ ID NO: 13232 - RNA, 19 nt, Artificial Sequence
  RNA Oligomer
uugucauugguaacccggg

SEQ ID NO: 13233 - RNA, 19 nt, Artificial Sequence
  RNA Oligomer
ugucauugguaacccgggu

SEQ ID NO: 13234 - RNA, 19 nt, Artificial Sequence
  RNA Oligomer
guguacuaauguaguucca

SEQ ID NO: 13235 - RNA, 19 nt, Artificial Sequence
  RNA Oligomer
uaacauucuucaaaccagu

SEQ ID NO: 13236 - RNA, 19 nt, Artificial Sequence
  RNA Oligomer
auuuguuugacauggcaca

SEQ ID NO: 13237 - RNA, 19 nt, Artificial Sequence
  RNA Oligomer
caaacaaucuguuuugacg

SEQ ID NO: 13238 - RNA, 19 nt, Artificial Sequence
  RNA Oligomer
aagucacagaagaggcccu

SEQ ID NO: 13239 - RNA, 19 nt, Artificial Sequence
  RNA Oligomer
gucuaaucgacaggauucc

SEQ ID NO: 13240 - RNA, 19 nt, Artificial Sequence
  RNA Oligomer
acacuucaaauagcaggca

SEQ ID NO: 13241 - RNA, 19 nt, Artificial Sequence
  RNA Oligomer
uugggugggaaucuuuucc

SEQ ID NO: 13242 - RNA, 19 nt, Artificial Sequence
  RNA Oligomer
aucauguucuucuucauga

SEQ ID NO: 13243 - RNA, 19 nt, Artificial Sequence
  RNA Oligomer
uguucuucuucaugaccuc

SEQ ID NO: 13244 - RNA, 19 nt, Artificial Sequence
  RNA Oligomer
uguucauuaaaagugaggc

SEQ ID NO: 13245 - RNA, 19 nt, Artificial Sequence
  RNA Oligomer
uacaggcaaauucacuugc

SEQ ID NO: 13246 - RNA, 19 nt, Artificial Sequence
  RNA Oligomer
aacauucuucaaaccagug

SEQ ID NO: 13247 - RNA, 19 nt, Artificial Sequence
  RNA Oligomer
gucuugaugaacaucaugu

SEQ ID NO: 13248 - RNA, 19 nt, Artificial Sequence
  RNA Oligomer
uugaugaacaucauguucu

SEQ ID NO: 13249 - RNA, 19 nt, Artificial Sequence
  RNA Oligomer
guucuucuucaugaccucg

SEQ ID NO: 13250 - RNA, 19 nt, Artificial Sequence
  RNA Oligomer
aaucuggcuuguuacaggc

SEQ ID NO: 13251 - RNA, 19 nt, Artificial Sequence
  RNA Oligomer
uuacaggcaaauucacuug

SEQ ID NO: 13252 - RNA, 19 nt, Artificial Sequence
  RNA Oligomer
guugucauugguaacccgg

SEQ ID NO: 13253 - RNA, 19 nt, Artificial Sequence
  RNA Oligomer
uacuaauguaguuccacug

SEQ ID NO: 13254 - RNA, 19 nt, Artificial Sequence
  RNA Oligomer
aauaaaggccauuuguuca

SEQ ID NO: 13255 - RNA, 19 nt, Artificial Sequence
  RNA Oligomer
cuaucugagcagaauuucc

SEQ ID NO: 13256 - RNA, 19 nt, Artificial Sequence
  RNA Oligomer
aucgacaggauuccgauuc

SEQ ID NO: 13257 - RNA, 19 nt, Artificial Sequence
  RNA Oligomer
ucgacaggauuccgauucc

SEQ ID NO: 13258 - RNA, 19 nt, Artificial Sequence
  RNA Oligomer
auucgaaucagaaugucag

SEQ ID NO: 13259 - RNA, 19 nt, Artificial Sequence
  RNA Oligomer
acuuaaggaacaacuugac

SEQ ID NO: 13260 - RNA, 19 nt, Artificial Sequence
  RNA Oligomer
aacaacuugacucagucuc

SEQ ID NO: 13261 - RNA, 19 nt, Artificial Sequence
  RNA Oligomer
gugcuguguacuaauguag

SEQ ID NO: 13262 - RNA, 19 nt, Artificial Sequence
  RNA Oligomer
cuguguacuaauguaguuc

SEQ ID NO: 13263 - RNA, 19 nt, Artificial Sequence
  RNA Oligomer
cuucaaaccagugucuggg

SEQ ID NO: 13264 - RNA, 19 nt, Artificial Sequence
  RNA Oligomer
augaguuaaugucucucac

SEQ ID NO: 13265 - RNA, 19 nt, Artificial Sequence
  RNA Oligomer
ucuuccuguaguacagcga

SEQ ID NO: 13266 - RNA, 19 nt, Artificial Sequence
  RNA Oligomer
ucaaacuugauaggcuugg

SEQ ID NO: 13267 - RNA, 19 nt, Artificial Sequence
  RNA Oligomer
uuguucauuaaaagugagg

SEQ ID NO: 13268 - RNA, 19 nt, Artificial Sequence
  RNA Oligomer
auuucaugcuuugaacgau

SEQ ID NO: 13269 - RNA, 19 nt, Artificial Sequence
  RNA Oligomer
aaaucuggcuuguuacagg

SEQ ID NO: 13270 - RNA, 19 nt, Artificial Sequence
  RNA Oligomer
gucauucgaaucagaaugu

SEQ ID NO: 13271 - RNA, 19 nt, Artificial Sequence
  RNA Oligomer
ucauucgaaucagaauguc

SEQ ID NO: 13272 - RNA, 19 nt, Artificial Sequence
  RNA Oligomer
cguugucauugguaacccg

SEQ ID NO: 13273 - RNA, 19 nt, Artificial Sequence
  RNA Oligomer
gacucagucucuugauggc

SEQ ID NO: 13274 - RNA, 19 nt, Artificial Sequence
  RNA Oligomer
uauuuguuugacauggcac

SEQ ID NO: 13275 - RNA, 19 nt, Artificial Sequence
  RNA Oligomer
ugggugggaaucuuuuccc

SEQ ID NO: 13276 - RNA, 19 nt, Artificial Sequence
  RNA Oligomer
acaucuuccuguaguacag

SEQ ID NO: 13277 - RNA, 19 nt, Artificial Sequence
  RNA Oligomer
gacaguuguaauggcaggc

SEQ ID NO: 13278 - RNA, 19 nt, Artificial Sequence
  RNA Oligomer
augucuucaugcuggugca

SEQ ID NO: 13279 - RNA, 19 nt, Artificial Sequence
  RNA Oligomer
uuuugggaguacggaugca

SEQ ID NO: 13280 - RNA, 19 nt, Artificial Sequence
  RNA Oligomer
uucuaucugagcagaauuu

SEQ ID NO: 13281 - RNA, 19 nt, Artificial Sequence
  RNA Oligomer
uguccagucuaaucgacag

SEQ ID NO: 13282 - RNA, 19 nt, Artificial Sequence
  RNA Oligomer
acuugacucagucucuuga

SEQ ID NO: 13283 - RNA, 19 nt, Artificial Sequence
  RNA Oligomer
ucagucucuugauggcugg

SEQ ID NO: 13284 - RNA, 19 nt, Artificial Sequence
  RNA Oligomer
uaucugaugauacuaaccu

SEQ ID NO: 13285 - RNA, 19 nt, Artificial Sequence
  RNA Oligomer
uucuggugcuguguacuaa

SEQ ID NO: 13286 - RNA, 19 nt, Artificial Sequence
  RNA Oligomer
cuauuuguuugacauggca

SEQ ID NO: 13287 - RNA, 19 nt, Artificial Sequence
  RNA Oligomer
acaauguuuugaauugggu

SEQ ID NO: 13288 - RNA, 19 nt, Artificial Sequence
  RNA Oligomer
agaugucauugucuccggg

SEQ ID NO: 13289 - RNA, 19 nt, Artificial Sequence
  RNA Oligomer
cgguaugucuucaugcugg

SEQ ID NO: 13290 - RNA, 19 nt, Artificial Sequence
  RNA Oligomer
guacggaugcacuuuuugc

SEQ ID NO: 13291 - RNA, 19 nt, Artificial Sequence
  RNA Oligomer
ugcaaacaaucuguuuuga

SEQ ID NO: 13292 - RNA, 19 nt, Artificial Sequence
  RNA Oligomer
ucuaucugagcagaauuuc

SEQ ID NO: 13293 - RNA, 19 nt, Artificial Sequence
  RNA Oligomer
acaggcaaauucacuugcc

SEQ ID NO: 13294 - RNA, 19 nt, Artificial Sequence
  RNA Oligomer
uucugacuuaaggaacaac

SEQ ID NO: 13295 - RNA, 19 nt, Artificial Sequence
  RNA Oligomer
ucuucaaaccagugucugg

SEQ ID NO: 13296 - RNA, 19 nt, Artificial Sequence
  RNA Oligomer
gcacaauguuuugaauugg

SEQ ID NO: 13297 - RNA, 19 nt, Artificial Sequence
  RNA Oligomer
gaguuaaugucucucacuc

SEQ ID NO: 13298 - RNA, 19 nt, Artificial Sequence
  RNA Oligomer
ucuggcuucaugccauguc

SEQ ID NO: 13299 - RNA, 19 nt, Artificial Sequence
  RNA Oligomer
augucauugucuccgggac

SEQ ID NO: 13300 - RNA, 19 nt, Artificial Sequence
  RNA Oligomer
auugucuccgggacaguug

SEQ ID NO: 13301 - RNA, 19 nt, Artificial Sequence
  RNA Oligomer
ucauguucuucuucaugac

SEQ ID NO: 13302 - RNA, 19 nt, Artificial Sequence
  RNA Oligomer
aacuguccgaaaaacaguc

SEQ ID NO: 13303 - RNA, 19 nt, Artificial Sequence
  RNA Oligomer
acuguccgaaaaacaguca

SEQ ID NO: 13304 - RNA, 19 nt, Artificial Sequence
  RNA Oligomer
augcacuuuuugcccuucu

SEQ ID NO: 13305 - RNA, 19 nt, Artificial Sequence
  RNA Oligomer
guccagucuaaucgacagg

SEQ ID NO: 13306 - RNA, 19 nt, Artificial Sequence
  RNA Oligomer
augcacauccuagcuguca

SEQ ID NO: 13307 - RNA, 19 nt, Artificial Sequence
  RNA Oligomer
ucuaaucauaguugggucu

SEQ ID NO: 13308 - RNA, 19 nt, Artificial Sequence
  RNA Oligomer
acauggcacaauguuuuga

SEQ ID NO: 13309 - RNA, 19 nt, Artificial Sequence
  RNA Oligomer
cugaaaucauuuuuacgga

SEQ ID NO: 13310 - RNA, 19 nt, Artificial Sequence
  RNA Oligomer
uccuguaguacagcgauuc

SEQ ID NO: 13311 - RNA, 19 nt, Artificial Sequence
  RNA Oligomer
caguuguaauggcaggcac

SEQ ID NO: 13312 - RNA, 19 nt, Artificial Sequence
  RNA Oligomer
caggucuugaugaacauca

SEQ ID NO: 13313 - RNA, 19 nt, Artificial Sequence
  RNA Oligomer
auguaacuuuuggucacac

SEQ ID NO: 13314 - RNA, 19 nt, Artificial Sequence
  RNA Oligomer
uuaaaagugaggcuaccac

SEQ ID NO: 13315 - RNA, 19 nt, Artificial Sequence
  RNA Oligomer
aagugaggcuaccacauuu

SEQ ID NO: 13316 - RNA, 19 nt, Artificial Sequence
  RNA Oligomer
aaaaucuggcuuguuacag

SEQ ID NO: 13317 - RNA, 19 nt, Artificial Sequence
  RNA Oligomer
uccagucuaaucgacagga

SEQ ID NO: 13318 - RNA, 19 nt, Artificial Sequence
  RNA Oligomer
agucucuugauggcuggag

SEQ ID NO: 13319 - RNA, 19 nt, Artificial Sequence
  RNA Oligomer
uccgggacaguuguaaugg

SEQ ID NO: 13320 - RNA, 19 nt, Artificial Sequence
  RNA Oligomer
aaccacgguuugguccuug

SEQ ID NO: 13321 - RNA, 19 nt, Artificial Sequence
  RNA Oligomer
uuguuacaggcaaauucac

SEQ ID NO: 13322 - RNA, 19 nt, Artificial Sequence
  RNA Oligomer
aucugaugauacuaaccuu

SEQ ID NO: 13323 - RNA, 19 nt, Artificial Sequence
  RNA Oligomer
cuugaugaacaucauguuc

SEQ ID NO: 13324 - RNA, 19 nt, Artificial Sequence
  RNA Oligomer
agcucaaacuugauaggcu

SEQ ID NO: 13325 - RNA, 19 nt, Artificial Sequence
  RNA Oligomer
gacauggcacaauguuuug

SEQ ID NO: 13326 - RNA, 19 nt, Artificial Sequence
  RNA Oligomer
uugaauugggugggaaucu

SEQ ID NO: 13327 - RNA, 19 nt, Artificial Sequence
  RNA Oligomer
caaagaugucauugucucc

SEQ ID NO: 13328 - RNA, 19 nt, Artificial Sequence
  RNA Oligomer
caaacuugauaggcuugga

SEQ ID NO: 13329 - RNA, 19 nt, Artificial Sequence
  RNA Oligomer
uaaacuguccgaaaaacag

SEQ ID NO: 13330 - RNA, 19 nt, Artificial Sequence
  RNA Oligomer
guucauuaaaagugaggcu

SEQ ID NO: 13331 - RNA, 19 nt, Artificial Sequence
  RNA Oligomer
agugaggcuaccacauuuc

SEQ ID NO: 13332 - RNA, 19 nt, Artificial Sequence
  RNA Oligomer
gugaggcuaccacauuucc

SEQ ID NO: 13333 - RNA, 19 nt, Artificial Sequence
  RNA Oligomer
auccauuucaugcuuugaa

SEQ ID NO: 13334 - RNA, 19 nt, Artificial Sequence
  RNA Oligomer
aaggaacaacuugacucag

SEQ ID NO: 13335 - RNA, 19 nt, Artificial Sequence
  RNA Oligomer
uugacucagucucuugaug

SEQ ID NO: 13336 - RNA, 19 nt, Artificial Sequence
  RNA Oligomer
cuggcuucaugccaugucu

SEQ ID NO: 13337 - RNA, 19 nt, Artificial Sequence
  RNA Oligomer
cagcgauucaaagauguca

SEQ ID NO: 13338 - RNA, 19 nt, Artificial Sequence
  RNA Oligomer
acaguuguaauggcaggca

SEQ ID NO: 13339 - RNA, 19 nt, Artificial Sequence
  RNA Oligomer
uuguaauggcaggcacagg

SEQ ID NO: 13340 - RNA, 19 nt, Artificial Sequence
  RNA Oligomer
aucuggcuuguuacaggca

SEQ ID NO: 13341 - RNA, 19 nt, Artificial Sequence
  RNA Oligomer
acauccuagcugucacugg

SEQ ID NO: 13342 - RNA, 19 nt, Artificial Sequence
  RNA Oligomer
uggcucuaaucauaguugg

SEQ ID NO: 13343 - RNA, 19 nt, Artificial Sequence
  RNA Oligomer
uaauggcaggcacaggucu

SEQ ID NO: 13344 - RNA, 19 nt, Artificial Sequence
  RNA Oligomer
aaacuguccgaaaaacagu

SEQ ID NO: 13345 - RNA, 19 nt, Artificial Sequence
  RNA Oligomer
uucauuaaaagugaggcua

SEQ ID NO: 13346 - RNA, 19 nt, Artificial Sequence
  RNA Oligomer
ugcuccuaaagccacaccu

SEQ ID NO: 13347 - RNA, 19 nt, Artificial Sequence
  RNA Oligomer
ugcacugguacuugcagcu

SEQ ID NO: 13348 - RNA, 19 nt, Artificial Sequence
  RNA Oligomer
aucagaaugucagagcuga

SEQ ID NO: 13349 - RNA, 19 nt, Artificial Sequence
  RNA Oligomer
uucaaagaugucauugucu

SEQ ID NO: 13350 - RNA, 19 nt, Artificial Sequence
  RNA Oligomer
cucuaaucauaguuggguc

SEQ ID NO: 13351 - RNA, 19 nt, Artificial Sequence
  RNA Oligomer
gcaaaaugaaagagaacau

SEQ ID NO: 13352 - RNA, 19 nt, Artificial Sequence
  RNA Oligomer
cuaaaagcuucaggguuau

SEQ ID NO: 13353 - RNA, 19 nt, Artificial Sequence
  RNA Oligomer
agaagauaaacaccugaaa

SEQ ID NO: 13354 - RNA, 19 nt, Artificial Sequence
  RNA Oligomer
guccagcaauuaauaaaac

SEQ ID NO: 13355 - RNA, 19 nt, Artificial Sequence
  RNA Oligomer
ggaagaagauaaacaccug

SEQ ID NO: 13356 - RNA, 19 nt, Artificial Sequence
  RNA Oligomer
ccaaaaguaaggaagaaga

SEQ ID NO: 13357 - RNA, 19 nt, Artificial Sequence
  RNA Oligomer
ucccuguaaacuaaaagcu

SEQ ID NO: 13358 - RNA, 19 nt, Artificial Sequence
  RNA Oligomer
ccaugagaauugcagugau

SEQ ID NO: 13359 - RNA, 19 nt, Artificial Sequence
  RNA Oligomer
gcagcagcauuuaaauucu

SEQ ID NO: 13360 - RNA, 19 nt, Artificial Sequence
  RNA Oligomer
aacucccuguaaacuaaaa

SEQ ID NO: 13361 - RNA, 19 nt, Artificial Sequence
  RNA Oligomer
ugaaucugaugaacugguc

SEQ ID NO: 13362 - RNA, 19 nt, Artificial Sequence
  RNA Oligomer
ggguuaugucuauguucau

SEQ ID NO: 13363 - RNA, 19 nt, Artificial Sequence
  RNA Oligomer
cuauuugagucuggaaaua

SEQ ID NO: 13364 - RNA, 19 nt, Artificial Sequence
  RNA Oligomer
agcaaaaugaaagagaaca

SEQ ID NO: 13365 - RNA, 19 nt, Artificial Sequence
  RNA Oligomer
gcaucuucugaggucaauu

SEQ ID NO: 13366 - RNA, 19 nt, Artificial Sequence
  RNA Oligomer
ugcaucuucugaggucaau

SEQ ID NO: 13367 - RNA, 19 nt, Artificial Sequence
  RNA Oligomer
aagaagauaaacaccugaa

SEQ ID NO: 13368 - RNA, 19 nt, Artificial Sequence
  RNA Oligomer
gaagaagauaaacaccuga

SEQ ID NO: 13369 - RNA, 19 nt, Artificial Sequence
  RNA Oligomer
uucugaugaaucugaugaa

SEQ ID NO: 13370 - RNA, 19 nt, Artificial Sequence
  RNA Oligomer
ggucaauuaaaaggagaaa

SEQ ID NO: 13371 - RNA, 19 nt, Artificial Sequence
  RNA Oligomer
caaaaguaaggaagaagau

SEQ ID NO: 13372 - RNA, 19 nt, Artificial Sequence
  RNA Oligomer
cgaugugauugauagucag

SEQ ID NO: 13373 - RNA, 19 nt, Artificial Sequence
  RNA Oligomer
gcaaugagcauuccgaugu

SEQ ID NO: 13374 - RNA, 19 nt, Artificial Sequence
  RNA Oligomer
ugaugauguagaugacacu

SEQ ID NO: 13375 - RNA, 19 nt, Artificial Sequence
  RNA Oligomer
acauaaccuuuuuuacugc

SEQ ID NO: 13376 - RNA, 19 nt, Artificial Sequence
  RNA Oligomer
cuauagaagaaaugcaaac

SEQ ID NO: 13377 - RNA, 19 nt, Artificial Sequence
  RNA Oligomer
guguaucuauuugagucug

SEQ ID NO: 13378 - RNA, 19 nt, Artificial Sequence
  RNA Oligomer
cucaguuuauugguugaau

SEQ ID NO: 13379 - RNA, 19 nt, Artificial Sequence
  RNA Oligomer
acaguagacacauaugaug

SEQ ID NO: 13380 - RNA, 19 nt, Artificial Sequence
  RNA Oligomer
cugaugauguagaugacac

SEQ ID NO: 13381 - RNA, 19 nt, Artificial Sequence
  RNA Oligomer
uguguaucuauuugagucu

SEQ ID NO: 13382 - RNA, 19 nt, Artificial Sequence
  RNA Oligomer
gcuucuuucucaguuuauu

SEQ ID NO: 13383 - RNA, 19 nt, Artificial Sequence
  RNA Oligomer
ucacuuugcauuuagucaa

SEQ ID NO: 13384 - RNA, 19 nt, Artificial Sequence
  RNA Oligomer
aggucaauuaaaaggagaa

SEQ ID NO: 13385 - RNA, 19 nt, Artificial Sequence
  RNA Oligomer
aggaagaagauaaacaccu

SEQ ID NO: 13386 - RNA, 19 nt, Artificial Sequence
  RNA Oligomer
ugugauugauagucaggaa

SEQ ID NO: 13387 - RNA, 19 nt, Artificial Sequence
  RNA Oligomer
ccgaggugauagugugguu

SEQ ID NO: 13388 - RNA, 19 nt, Artificial Sequence
  RNA Oligomer
cacaguagacacauaugau

SEQ ID NO: 13389 - RNA, 19 nt, Artificial Sequence
  RNA Oligomer
cucugaugauguagaugac

SEQ ID NO: 13390 - RNA, 19 nt, Artificial Sequence
  RNA Oligomer
gcauuuaaauucugggagg

SEQ ID NO: 13391 - RNA, 19 nt, Artificial Sequence
  RNA Oligomer
aggguuaugucuauguuca

SEQ ID NO: 13392 - RNA, 19 nt, Artificial Sequence
  RNA Oligomer
guaucuauuugagucugga

SEQ ID NO: 13393 - RNA, 19 nt, Artificial Sequence
  RNA Oligomer
gugcaucuucugaggucaa

SEQ ID NO: 13394 - RNA, 19 nt, Artificial Sequence
  RNA Oligomer
gauugauagucaggaacuu

SEQ ID NO: 13395 - RNA, 19 nt, Artificial Sequence
  RNA Oligomer
caaugagcauuccgaugug

SEQ ID NO: 13396 - RNA, 19 nt, Artificial Sequence
  RNA Oligomer
ugaaacgagucagcuggau

SEQ ID NO: 13397 - RNA, 19 nt, Artificial Sequence
  RNA Oligomer
aggaguugaauggugcaua

SEQ ID NO: 13398 - RNA, 19 nt, Artificial Sequence
  RNA Oligomer
cgaggugauagugugguuu

SEQ ID NO: 13399 - RNA, 19 nt, Artificial Sequence
  RNA Oligomer
cacauaugauggccgaggu

SEQ ID NO: 13400 - RNA, 19 nt, Artificial Sequence
  RNA Oligomer
ugaacuggucacugauuuu

SEQ ID NO: 13401 - RNA, 19 nt, Artificial Sequence
  RNA Oligomer
cagcagcauuuaaauucug

SEQ ID NO: 13402 - RNA, 19 nt, Artificial Sequence
  RNA Oligomer
aucuauuugagucuggaaa

SEQ ID NO: 13403 - RNA, 19 nt, Artificial Sequence
  RNA Oligomer
ugaggucaauuaaaaggag

SEQ ID NO: 13404 - RNA, 19 nt, Artificial Sequence
  RNA Oligomer
ugaagauaugcugguugua

SEQ ID NO: 13405 - RNA, 19 nt, Artificial Sequence
  RNA Oligomer
ccaaagucagccgugaauu

SEQ ID NO: 13406 - RNA, 19 nt, Artificial Sequence
  RNA Oligomer
gugauugauagucaggaac

SEQ ID NO: 13407 - RNA, 19 nt, Artificial Sequence
  RNA Oligomer
uccgaugugauugauaguc

SEQ ID NO: 13408 - RNA, 19 nt, Artificial Sequence
  RNA Oligomer
agcauuccgaugugauuga

SEQ ID NO: 13409 - RNA, 19 nt, Artificial Sequence
  RNA Oligomer
ugagcauuccgaugugauu

SEQ ID NO: 13410 - RNA, 19 nt, Artificial Sequence
  RNA Oligomer
gaggaguugaauggugcau

SEQ ID NO: 13411 - RNA, 19 nt, Artificial Sequence
  RNA Oligomer
uggaaagcgaggaguugaa

SEQ ID NO: 13412 - RNA, 19 nt, Artificial Sequence
  RNA Oligomer
acauggaaagcgaggaguu

SEQ ID NO: 13413 - RNA, 19 nt, Artificial Sequence
  RNA Oligomer
gcagcauuuaaauucuggg

SEQ ID NO: 13414 - RNA, 19 nt, Artificial Sequence
  RNA Oligomer
ucuauuugagucuggaaau

SEQ ID NO: 13415 - RNA, 19 nt, Artificial Sequence
  RNA Oligomer
ugcuucuuucucaguuuau

SEQ ID NO: 13416 - RNA, 19 nt, Artificial Sequence
  RNA Oligomer
gaggucaauuaaaaggaga

SEQ ID NO: 13417 - RNA, 19 nt, Artificial Sequence
  RNA Oligomer
ugauugauagucaggaacu

SEQ ID NO: 13418 - RNA, 19 nt, Artificial Sequence
  RNA Oligomer
ccauucugaugaaucugau

SEQ ID NO: 13419 - RNA, 19 nt, Artificial Sequence
  RNA Oligomer
ugagucucaccauucugau

SEQ ID NO: 13420 - RNA, 19 nt, Artificial Sequence
  RNA Oligomer
acgacucugaugauguaga

SEQ ID NO: 13421 - RNA, 19 nt, Artificial Sequence
  RNA Oligomer
agcauuuaaauucugggag

SEQ ID NO: 13422 - RNA, 19 nt, Artificial Sequence
  RNA Oligomer
cagcauuuaaauucuggga

SEQ ID NO: 13423 - RNA, 19 nt, Artificial Sequence
  RNA Oligomer
caguuuauugguugaaugu

SEQ ID NO: 13424 - RNA, 19 nt, Artificial Sequence
  RNA Oligomer
ucucaguuuauugguugaa

SEQ ID NO: 13425 - RNA, 19 nt, Artificial Sequence
  RNA Oligomer
acaauuucucacuuugcau

SEQ ID NO: 13426 - RNA, 19 nt, Artificial Sequence
  RNA Oligomer
cugaggucaauuaaaagga

SEQ ID NO: 13427 - RNA, 19 nt, Artificial Sequence
  RNA Oligomer
cuguguugguggaggaugu

SEQ ID NO: 13428 - RNA, 19 nt, Artificial Sequence
  RNA Oligomer
aucuuuuuguggugugaau

SEQ ID NO: 13429 - RNA, 19 nt, Artificial Sequence
  RNA Oligomer
accaugagaauugcaguga

SEQ ID NO: 13430 - RNA, 19 nt, Artificial Sequence
  RNA Oligomer
cgaggaguugaauggugca

SEQ ID NO: 13431 - RNA, 19 nt, Artificial Sequence
  RNA Oligomer
uuaguuuaguuuguggcuu

SEQ ID NO: 13432 - RNA, 19 nt, Artificial Sequence
  RNA Oligomer
cuuucucaguuuauugguu

SEQ ID NO: 13433 - RNA, 19 nt, Artificial Sequence
  RNA Oligomer
agcgaggaguugaauggug

SEQ ID NO: 13434 - RNA, 19 nt, Artificial Sequence
  RNA Oligomer
ugauggccgaggugauagu

SEQ ID NO: 13435 - RNA, 19 nt, Artificial Sequence
  RNA Oligomer
ugagaauugcagugauuug

SEQ ID NO: 13436 - RNA, 19 nt, Artificial Sequence
  RNA Oligomer
aaugcuucuuucucaguuu

SEQ ID NO: 13437 - RNA, 19 nt, Artificial Sequence
  RNA Oligomer
caaaaugaaagagaacaug

SEQ ID NO: 13438 - RNA, 19 nt, Artificial Sequence
  RNA Oligomer
cccuguaaacuaaaagcuu

SEQ ID NO: 13439 - RNA, 19 nt, Artificial Sequence
  RNA Oligomer
ccaugaauuucacagccau

SEQ ID NO: 13440 - RNA, 19 nt, Artificial Sequence
  RNA Oligomer
cgguuguccagcaauuaau

SEQ ID NO: 13441 - RNA, 19 nt, Artificial Sequence
  RNA Oligomer
accauucugaugaaucuga

SEQ ID NO: 13442 - RNA, 19 nt, Artificial Sequence
  RNA Oligomer
ccuguaaacuaaaagcuuc

SEQ ID NO: 13443 - RNA, 19 nt, Artificial Sequence
  RNA Oligomer
gccaugaauuucacagcca

SEQ ID NO: 13444 - RNA, 19 nt, Artificial Sequence
  RNA Oligomer
ucaggaacuuuccaaaguc

SEQ ID NO: 13445 - RNA, 19 nt, Artificial Sequence
  RNA Oligomer
gaacuggucacugauuuuc

SEQ ID NO: 13446 - RNA, 19 nt, Artificial Sequence
  RNA Oligomer
ugaugaacuggucacugau

SEQ ID NO: 13447 - RNA, 19 nt, Artificial Sequence
  RNA Oligomer
uggaugaugaagaugauga

SEQ ID NO: 13448 - RNA, 19 nt, Artificial Sequence
  RNA Oligomer
gucugcagcagcauuuaaa

SEQ ID NO: 13449 - RNA, 19 nt, Artificial Sequence
  RNA Oligomer
cuguaaacuaaaagcuuca

SEQ ID NO: 13450 - RNA, 19 nt, Artificial Sequence
  RNA Oligomer
caggaacuuuccaaaguca

SEQ ID NO: 13451 - RNA, 19 nt, Artificial Sequence
  RNA Oligomer
gucaggaacuuuccaaagu

SEQ ID NO: 13452 - RNA, 19 nt, Artificial Sequence
  RNA Oligomer
gccagcaaccgaaguuuuc

SEQ ID NO: 13453 - RNA, 19 nt, Artificial Sequence
  RNA Oligomer
ugccagcaaccgaaguuuu

SEQ ID NO: 13454 - RNA, 19 nt, Artificial Sequence
  RNA Oligomer
acgguuguccagcaauuaa

SEQ ID NO: 13455 - RNA, 19 nt, Artificial Sequence
  RNA Oligomer
cccaaaaguaaggaagaag

SEQ ID NO: 13456 - RNA, 19 nt, Artificial Sequence
  RNA Oligomer
gccaugaagauaugcuggu

SEQ ID NO: 13457 - RNA, 19 nt, Artificial Sequence
  RNA Oligomer
acgaggacaucaccucaca

SEQ ID NO: 13458 - RNA, 19 nt, Artificial Sequence
  RNA Oligomer
ccagcaaccgaaguuuuca

SEQ ID NO: 13459 - RNA, 19 nt, Artificial Sequence
  RNA Oligomer
acagccaggacuccauuga

SEQ ID NO: 13460 - RNA, 19 nt, Artificial Sequence
  RNA Oligomer
auagucaggaacuuuccaa

SEQ ID NO: 13461 - RNA, 19 nt, Artificial Sequence
  RNA Oligomer
gagcaaugagcauuccgau

SEQ ID NO: 13462 - RNA, 19 nt, Artificial Sequence
  RNA Oligomer
cagcaaccgaaguuuucac

SEQ ID NO: 13463 - RNA, 19 nt, Artificial Sequence
  RNA Oligomer
cugccagcaaccgaaguuu

SEQ ID NO: 13464 - RNA, 19 nt, Artificial Sequence
  RNA Oligomer
gucucaccauucugaugaa

SEQ ID NO: 13465 - RNA, 19 nt, Artificial Sequence
  RNA Oligomer
ucugaugagucucaccauu

SEQ ID NO: 13466 - RNA, 19 nt, Artificial Sequence
  RNA Oligomer
cacgguuguccagcaauua

SEQ ID NO: 13467 - RNA, 19 nt, Artificial Sequence
  RNA Oligomer
cacuuugcauuuagucaaa

SEQ ID NO: 13468 - RNA, 19 nt, Artificial Sequence
  RNA Oligomer
gaauuagauagugcaucuu

SEQ ID NO: 13469 - RNA, 19 nt, Artificial Sequence
  RNA Oligomer
acagccaugaagauaugcu

SEQ ID NO: 13470 - RNA, 19 nt, Artificial Sequence
  RNA Oligomer
ucagcuggaugaccagagu

SEQ ID NO: 13471 - RNA, 19 nt, Artificial Sequence
  RNA Oligomer
ucaccauucugaugaaucu

SEQ ID NO: 13472 - RNA, 19 nt, Artificial Sequence
  RNA Oligomer
ccagucugaugagucucac

SEQ ID NO: 13473 - RNA, 19 nt, Artificial Sequence
  RNA Oligomer
uucauggaaacucccugua

SEQ ID NO: 13474 - RNA, 19 nt, Artificial Sequence
  RNA Oligomer
cagccaugaagauaugcug

SEQ ID NO: 13475 - RNA, 19 nt, Artificial Sequence
  RNA Oligomer
gaugaccagagugcugaaa

SEQ ID NO: 13476 - RNA, 19 nt, Artificial Sequence
  RNA Oligomer
agacacauaugauggccga

SEQ ID NO: 13477 - RNA, 19 nt, Artificial Sequence
  RNA Oligomer
ugaauuagauagugcaucu

SEQ ID NO: 13478 - RNA, 19 nt, Artificial Sequence
  RNA Oligomer
ggaugaccagagugcugaa

SEQ ID NO: 13479 - RNA, 19 nt, Artificial Sequence
  RNA Oligomer
ccucacacauggaaagcga

SEQ ID NO: 13480 - RNA, 19 nt, Artificial Sequence
  RNA Oligomer
cccacaguagacacauaug

SEQ ID NO: 13481 - RNA, 19 nt, Artificial Sequence
  RNA Oligomer
agccaggacuccauugacu

SEQ ID NO: 13482 - RNA, 19 nt, Artificial Sequence
  RNA Oligomer
uucacagccaugaagauau

SEQ ID NO: 13483 - RNA, 19 nt, Artificial Sequence
  RNA Oligomer
gaauuccacagccaugaau

SEQ ID NO: 13484 - RNA, 19 nt, Artificial Sequence
  RNA Oligomer
acacauggaaagcgaggag

SEQ ID NO: 13485 - RNA, 19 nt, Artificial Sequence
  RNA Oligomer
gaggacaucaccucacaca

SEQ ID NO: 13486 - RNA, 19 nt, Artificial Sequence
  RNA Oligomer
ucucaccauucugaugaau

SEQ ID NO: 13487 - RNA, 19 nt, Artificial Sequence
  RNA Oligomer
ugaugauucucaccagucu

SEQ ID NO: 13488 - RNA, 19 nt, Artificial Sequence
  RNA Oligomer
cacugaugauucucaccag

SEQ ID NO: 13489 - RNA, 19 nt, Artificial Sequence
  RNA Oligomer
acacugaugauucucacca

SEQ ID NO: 13490 - RNA, 19 nt, Artificial Sequence
  RNA Oligomer
ugacacugaugauucucac

SEQ ID NO: 13491 - RNA, 19 nt, Artificial Sequence
  RNA Oligomer
uccaaagucagccgugaau

SEQ ID NO: 13492 - RNA, 19 nt, Artificial Sequence
  RNA Oligomer
agagugcugaaacccacag

SEQ ID NO: 13493 - RNA, 19 nt, Artificial Sequence
  RNA Oligomer
cucacuaccaugagaauug

SEQ ID NO: 13494 - RNA, 19 nt, Artificial Sequence
  RNA Oligomer
aggacaucaccucacacau

SEQ ID NO: 13495 - RNA, 19 nt, Artificial Sequence
  RNA Oligomer
gucugaugagucucaccau

SEQ ID NO: 13496 - RNA, 19 nt, Artificial Sequence
  RNA Oligomer
ugcagcagcauuuaaauuc

SEQ ID NO: 13497 - RNA, 19 nt, Artificial Sequence
  RNA Oligomer
cugcagcagcauuuaaauu

SEQ ID NO: 13498 - RNA, 19 nt, Artificial Sequence
  RNA Oligomer
uuauuuguuuucccacggu

SEQ ID NO: 13499 - RNA, 19 nt, Artificial Sequence
  RNA Oligomer
cugaaacccacagccacaa

SEQ ID NO: 13500 - RNA, 19 nt, Artificial Sequence
  RNA Oligomer
ucaccucacacauggaaag

SEQ ID NO: 13501 - RNA, 19 nt, Artificial Sequence
  RNA Oligomer
ugaugagucucaccauucu

SEQ ID NO: 13502 - RNA, 19 nt, Artificial Sequence
  RNA Oligomer
accagucugaugagucuca

SEQ ID NO: 13503 - RNA, 19 nt, Artificial Sequence
  RNA Oligomer
ugauucucaccagucugau

SEQ ID NO: 13504 - RNA, 19 nt, Artificial Sequence
  RNA Oligomer
acagccaugaauuucacag

SEQ ID NO: 13505 - RNA, 19 nt, Artificial Sequence
  RNA Oligomer
ugaauuccacagccaugaa

SEQ ID NO: 13506 - RNA, 19 nt, Artificial Sequence
  RNA Oligomer
ucacugauuuucccacgga

SEQ ID NO: 13507 - RNA, 19 nt, Artificial Sequence
  RNA Oligomer
guuauucucucaugaauag

SEQ ID NO: 13508 - RNA, 19 nt, Artificial Sequence
  RNA Oligomer
cuuugcauuuagucaaaag

SEQ ID NO: 13509 - RNA, 19 nt, Artificial Sequence
  RNA Oligomer
ccgugaauuccacagccau

SEQ ID NO: 13510 - RNA, 19 nt, Artificial Sequence
  RNA Oligomer
ggcuucauggaaacucccu

SEQ ID NO: 13511 - RNA, 19 nt, Artificial Sequence
  RNA Oligomer
ggaugucugcagcagcauu

SEQ ID NO: 13512 - RNA, 19 nt, Artificial Sequence
  RNA Oligomer
cacugauuuucccacggac

SEQ ID NO: 13513 - RNA, 19 nt, Artificial Sequence
  RNA Oligomer
gcuuauuuguuuucccacg

SEQ ID NO: 13514 - RNA, 19 nt, Artificial Sequence
  RNA Oligomer
gugaauuccacagccauga

SEQ ID NO: 13515 - RNA, 19 nt, Artificial Sequence
  RNA Oligomer
aaacucacuaccaugagaa

SEQ ID NO: 13516 - RNA, 19 nt, Artificial Sequence
  RNA Oligomer
gagaacaugaaaugcuucu

SEQ ID NO: 13517 - RNA, 19 nt, Artificial Sequence
  RNA Oligomer
gaugucugcagcagcauuu

SEQ ID NO: 13518 - RNA, 19 nt, Artificial Sequence
  RNA Oligomer
ugaauuucacagccaugaa

SEQ ID NO: 13519 - RNA, 19 nt, Artificial Sequence
  RNA Oligomer
ccacagccaugaauuucac

SEQ ID NO: 13520 - RNA, 19 nt, Artificial Sequence
  RNA Oligomer
agccacaagcaguccagau

SEQ ID NO: 13521 - RNA, 19 nt, Artificial Sequence
  RNA Oligomer
gaauuucacagccaugaag

SEQ ID NO: 13522 - RNA, 19 nt, Artificial Sequence
  RNA Oligomer
agauagugcaucuucugag

SEQ ID NO: 13523 - RNA, 19 nt, Artificial Sequence
  RNA Oligomer
agaacaugaaaugcuucuu

SEQ ID NO: 13524 - RNA, 19 nt, Artificial Sequence
  RNA Oligomer
uccacagccaugaauuuca

SEQ ID NO: 13525 - RNA, 19 nt, Artificial Sequence
  RNA Oligomer
ugaaaugcuucuuucucag

SEQ ID NO: 13526 - RNA, 19 nt, Artificial Sequence
  RNA Oligomer
gugccauaccaguuaaaca

SEQ ID NO: 13527 - RNA, 19 nt, Artificial Sequence
  RNA Oligomer
auguucucuuucauuuugc

SEQ ID NO: 13528 - RNA, 19 nt, Artificial Sequence
  RNA Oligomer
auaacccugaagcuuuuag

SEQ ID NO: 13529 - RNA, 19 nt, Artificial Sequence
  RNA Oligomer
uuucagguguuuaucuucu

SEQ ID NO: 13530 - RNA, 19 nt, Artificial Sequence
  RNA Oligomer
guuuuauuaauugcuggac

SEQ ID NO: 13531 - RNA, 19 nt, Artificial Sequence
  RNA Oligomer
cagguguuuaucuucuucc

SEQ ID NO: 13532 - RNA, 19 nt, Artificial Sequence
  RNA Oligomer
ucuucuuccuuacuuuugg

SEQ ID NO: 13533 - RNA, 19 nt, Artificial Sequence
  RNA Oligomer
agcuuuuaguuuacaggga

SEQ ID NO: 13534 - RNA, 19 nt, Artificial Sequence
  RNA Oligomer
aucacugcaauucucaugg

SEQ ID NO: 13535 - RNA, 19 nt, Artificial Sequence
  RNA Oligomer
agaauuuaaaugcugcugc

SEQ ID NO: 13536 - RNA, 19 nt, Artificial Sequence
  RNA Oligomer
uuuuaguuuacagggaguu

SEQ ID NO: 13537 - RNA, 19 nt, Artificial Sequence
  RNA Oligomer
gaccaguucaucagauuca

SEQ ID NO: 13538 - RNA, 19 nt, Artificial Sequence
  RNA Oligomer
augaacauagacauaaccc

SEQ ID NO: 13539 - RNA, 19 nt, Artificial Sequence
  RNA Oligomer
uauuuccagacucaaauag

SEQ ID NO: 13540 - RNA, 19 nt, Artificial Sequence
  RNA Oligomer
uguucucuuucauuuugcu

SEQ ID NO: 13541 - RNA, 19 nt, Artificial Sequence
  RNA Oligomer
aauugaccucagaagaugc

SEQ ID NO: 13542 - RNA, 19 nt, Artificial Sequence
  RNA Oligomer
auugaccucagaagaugca

SEQ ID NO: 13543 - RNA, 19 nt, Artificial Sequence
  RNA Oligomer
uucagguguuuaucuucuu

SEQ ID NO: 13544 - RNA, 19 nt, Artificial Sequence
  RNA Oligomer
ucagguguuuaucuucuuc

SEQ ID NO: 13545 - RNA, 19 nt, Artificial Sequence
  RNA Oligomer
uucaucagauucaucagaa

SEQ ID NO: 13546 - RNA, 19 nt, Artificial Sequence
  RNA Oligomer
uuucuccuuuuaauugacc

SEQ ID NO: 13547 - RNA, 19 nt, Artificial Sequence
  RNA Oligomer
aucuucuuccuuacuuuug

SEQ ID NO: 13548 - RNA, 19 nt, Artificial Sequence
  RNA Oligomer
cugacuaucaaucacaucg

SEQ ID NO: 13549 - RNA, 19 nt, Artificial Sequence
  RNA Oligomer
acaucggaaugcucauugc

SEQ ID NO: 13550 - RNA, 19 nt, Artificial Sequence
  RNA Oligomer
agugucaucuacaucauca

SEQ ID NO: 13551 - RNA, 19 nt, Artificial Sequence
  RNA Oligomer
gcaguaaaaaagguuaugu

SEQ ID NO: 13552 - RNA, 19 nt, Artificial Sequence
  RNA Oligomer
guuugcauuucuucuauag

SEQ ID NO: 13553 - RNA, 19 nt, Artificial Sequence
  RNA Oligomer
cagacucaaauagauacac

SEQ ID NO: 13554 - RNA, 19 nt, Artificial Sequence
  RNA Oligomer
auucaaccaauaaacugag

SEQ ID NO: 13555 - RNA, 19 nt, Artificial Sequence
  RNA Oligomer
caucauaugugucuacugu

SEQ ID NO: 13556 - RNA, 19 nt, Artificial Sequence
  RNA Oligomer
gugucaucuacaucaucag

SEQ ID NO: 13557 - RNA, 19 nt, Artificial Sequence
  RNA Oligomer
agacucaaauagauacaca

SEQ ID NO: 13558 - RNA, 19 nt, Artificial Sequence
  RNA Oligomer
aauaaacugagaaagaagc

SEQ ID NO: 13559 - RNA, 19 nt, Artificial Sequence
  RNA Oligomer
uugacuaaaugcaaaguga

SEQ ID NO: 13560 - RNA, 19 nt, Artificial Sequence
  RNA Oligomer
uucuccuuuuaauugaccu

SEQ ID NO: 13561 - RNA, 19 nt, Artificial Sequence
  RNA Oligomer
agguguuuaucuucuuccu

SEQ ID NO: 13562 - RNA, 19 nt, Artificial Sequence
  RNA Oligomer
uuccugacuaucaaucaca

SEQ ID NO: 13563 - RNA, 19 nt, Artificial Sequence
  RNA Oligomer
aaccacacuaucaccucgg

SEQ ID NO: 13564 - RNA, 19 nt, Artificial Sequence
  RNA Oligomer
aucauaugugucuacugug

SEQ ID NO: 13565 - RNA, 19 nt, Artificial Sequence
  RNA Oligomer
gucaucuacaucaucagag

SEQ ID NO: 13566 - RNA, 19 nt, Artificial Sequence
  RNA Oligomer
ccucccagaauuuaaaugc

SEQ ID NO: 13567 - RNA, 19 nt, Artificial Sequence
  RNA Oligomer
ugaacauagacauaacccu

SEQ ID NO: 13568 - RNA, 19 nt, Artificial Sequence
  RNA Oligomer
uccagacucaaauagauac

SEQ ID NO: 13569 - RNA, 19 nt, Artificial Sequence
  RNA Oligomer
uugaccucagaagaugcac

SEQ ID NO: 13570 - RNA, 19 nt, Artificial Sequence
  RNA Oligomer
aaguuccugacuaucaauc

SEQ ID NO: 13571 - RNA, 19 nt, Artificial Sequence
  RNA Oligomer
cacaucggaaugcucauug

SEQ ID NO: 13572 - RNA, 19 nt, Artificial Sequence
  RNA Oligomer
auccagcugacucguuuca

SEQ ID NO: 13573 - RNA, 19 nt, Artificial Sequence
  RNA Oligomer
uaugcaccauucaacuccu

SEQ ID NO: 13574 - RNA, 19 nt, Artificial Sequence
  RNA Oligomer
aaaccacacuaucaccucg

SEQ ID NO: 13575 - RNA, 19 nt, Artificial Sequence
  RNA Oligomer
accucggccaucauaugug

SEQ ID NO: 13576 - RNA, 19 nt, Artificial Sequence
  RNA Oligomer
aaaaucagugaccaguuca

SEQ ID NO: 13577 - RNA, 19 nt, Artificial Sequence
  RNA Oligomer
cagaauuuaaaugcugcug

SEQ ID NO: 13578 - RNA, 19 nt, Artificial Sequence
  RNA Oligomer
uuuccagacucaaauagau

SEQ ID NO: 13579 - RNA, 19 nt, Artificial Sequence
  RNA Oligomer
cuccuuuuaauugaccuca

SEQ ID NO: 13580 - RNA, 19 nt, Artificial Sequence
  RNA Oligomer
uacaaccagcauaucuuca

SEQ ID NO: 13581 - RNA, 19 nt, Artificial Sequence
  RNA Oligomer
aauucacggcugacuuugg

SEQ ID NO: 13582 - RNA, 19 nt, Artificial Sequence
  RNA Oligomer
guuccugacuaucaaucac

SEQ ID NO: 13583 - RNA, 19 nt, Artificial Sequence
  RNA Oligomer
gacuaucaaucacaucgga

SEQ ID NO: 13584 - RNA, 19 nt, Artificial Sequence
  RNA Oligomer
ucaaucacaucggaaugcu

SEQ ID NO: 13585 - RNA, 19 nt, Artificial Sequence
  RNA Oligomer
aaucacaucggaaugcuca

SEQ ID NO: 13586 - RNA, 19 nt, Artificial Sequence
  RNA Oligomer
augcaccauucaacuccuc

SEQ ID NO: 13587 - RNA, 19 nt, Artificial Sequence
  RNA Oligomer
uucaacuccucgcuuucca

SEQ ID NO: 13588 - RNA, 19 nt, Artificial Sequence
  RNA Oligomer
aacuccucgcuuuccaugu

SEQ ID NO: 13589 - RNA, 19 nt, Artificial Sequence
  RNA Oligomer
cccagaauuuaaaugcugc

SEQ ID NO: 13590 - RNA, 19 nt, Artificial Sequence
  RNA Oligomer
auuuccagacucaaauaga

SEQ ID NO: 13591 - RNA, 19 nt, Artificial Sequence
  RNA Oligomer
auaaacugagaaagaagca

SEQ ID NO: 13592 - RNA, 19 nt, Artificial Sequence
  RNA Oligomer
ucuccuuuuaauugaccuc

SEQ ID NO: 13593 - RNA, 19 nt, Artificial Sequence
  RNA Oligomer
aguuccugacuaucaauca

SEQ ID NO: 13594 - RNA, 19 nt, Artificial Sequence
  RNA Oligomer
aucagauucaucagaaugg

SEQ ID NO: 13595 - RNA, 19 nt, Artificial Sequence
  RNA Oligomer
aucagaauggugagacuca

SEQ ID NO: 13596 - RNA, 19 nt, Artificial Sequence
  RNA Oligomer
ucuacaucaucagagucgu

SEQ ID NO: 13597 - RNA, 19 nt, Artificial Sequence
  RNA Oligomer
cucccagaauuuaaaugcu

SEQ ID NO: 13598 - RNA, 19 nt, Artificial Sequence
  RNA Oligomer
ucccagaauuuaaaugcug

SEQ ID NO: 13599 - RNA, 19 nt, Artificial Sequence
  RNA Oligomer
acauucaaccaauaaacug

SEQ ID NO: 13600 - RNA, 19 nt, Artificial Sequence
  RNA Oligomer
uucaaccaauaaacugaga

SEQ ID NO: 13601 - RNA, 19 nt, Artificial Sequence
  RNA Oligomer
augcaaagugagaaauugu

SEQ ID NO: 13602 - RNA, 19 nt, Artificial Sequence
  RNA Oligomer
uccuuuuaauugaccucag

SEQ ID NO: 13603 - RNA, 19 nt, Artificial Sequence
  RNA Oligomer
acauccuccaccaacacag

SEQ ID NO: 13604 - RNA, 19 nt, Artificial Sequence
  RNA Oligomer
auucacaccacaaaaagau

SEQ ID NO: 13605 - RNA, 19 nt, Artificial Sequence
  RNA Oligomer
ucacugcaauucucauggu

SEQ ID NO: 13606 - RNA, 19 nt, Artificial Sequence
  RNA Oligomer
ugcaccauucaacuccucg

SEQ ID NO: 13607 - RNA, 19 nt, Artificial Sequence
  RNA Oligomer
aagccacaaacuaaacuaa

SEQ ID NO: 13608 - RNA, 19 nt, Artificial Sequence
  RNA Oligomer
aaccaauaaacugagaaag

SEQ ID NO: 13609 - RNA, 19 nt, Artificial Sequence
  RNA Oligomer
caccauucaacuccucgcu

SEQ ID NO: 13610 - RNA, 19 nt, Artificial Sequence
  RNA Oligomer
acuaucaccucggccauca

SEQ ID NO: 13611 - RNA, 19 nt, Artificial Sequence
  RNA Oligomer
caaaucacugcaauucuca

SEQ ID NO: 13612 - RNA, 19 nt, Artificial Sequence
  RNA Oligomer
aaacugagaaagaagcauu

SEQ ID NO: 13613 - RNA, 19 nt, Artificial Sequence
  RNA Oligomer
cauguucucuuucauuuug

SEQ ID NO: 13614 - RNA, 19 nt, Artificial Sequence
  RNA Oligomer
aagcuuuuaguuuacaggg

SEQ ID NO: 13615 - RNA, 19 nt, Artificial Sequence
  RNA Oligomer
auggcugugaaauucaugg

SEQ ID NO: 13616 - RNA, 19 nt, Artificial Sequence
  RNA Oligomer
auuaauugcuggacaaccg

SEQ ID NO: 13617 - RNA, 19 nt, Artificial Sequence
  RNA Oligomer
ucagauucaucagaauggu

SEQ ID NO: 13618 - RNA, 19 nt, Artificial Sequence
  RNA Oligomer
gaagcuuuuaguuuacagg

SEQ ID NO: 13619 - RNA, 19 nt, Artificial Sequence
  RNA Oligomer
uggcugugaaauucauggc

SEQ ID NO: 13620 - RNA, 19 nt, Artificial Sequence
  RNA Oligomer
gacuuuggaaaguuccuga

SEQ ID NO: 13621 - RNA, 19 nt, Artificial Sequence
  RNA Oligomer
gaaaaucagugaccaguuc

SEQ ID NO: 13622 - RNA, 19 nt, Artificial Sequence
  RNA Oligomer
aucagugaccaguucauca

SEQ ID NO: 13623 - RNA, 19 nt, Artificial Sequence
  RNA Oligomer
ucaucaucuucaucaucca

SEQ ID NO: 13624 - RNA, 19 nt, Artificial Sequence
  RNA Oligomer
uuuaaaugcugcugcagac

SEQ ID NO: 13625 - RNA, 19 nt, Artificial Sequence
  RNA Oligomer
ugaagcuuuuaguuuacag

SEQ ID NO: 13626 - RNA, 19 nt, Artificial Sequence
  RNA Oligomer
ugacuuuggaaaguuccug

SEQ ID NO: 13627 - RNA, 19 nt, Artificial Sequence
  RNA Oligomer
acuuuggaaaguuccugac

SEQ ID NO: 13628 - RNA, 19 nt, Artificial Sequence
  RNA Oligomer
gaaaacuucgguugcuggc

SEQ ID NO: 13629 - RNA, 19 nt, Artificial Sequence
  RNA Oligomer
aaaacuucgguugcuggca

SEQ ID NO: 13630 - RNA, 19 nt, Artificial Sequence
  RNA Oligomer
uuaauugcuggacaaccgu

SEQ ID NO: 13631 - RNA, 19 nt, Artificial Sequence
  RNA Oligomer
cuucuuccuuacuuuuggg

SEQ ID NO: 13632 - RNA, 19 nt, Artificial Sequence
  RNA Oligomer
accagcauaucuucauggc

SEQ ID NO: 13633 - RNA, 19 nt, Artificial Sequence
  RNA Oligomer
ugugaggugauguccucgu

SEQ ID NO: 13634 - RNA, 19 nt, Artificial Sequence
  RNA Oligomer
ugaaaacuucgguugcugg

SEQ ID NO: 13635 - RNA, 19 nt, Artificial Sequence
  RNA Oligomer
ucaauggaguccuggcugu

SEQ ID NO: 13636 - RNA, 19 nt, Artificial Sequence
  RNA Oligomer
uuggaaaguuccugacuau

SEQ ID NO: 13637 - RNA, 19 nt, Artificial Sequence
  RNA Oligomer
aucggaaugcucauugcuc

SEQ ID NO: 13638 - RNA, 19 nt, Artificial Sequence
  RNA Oligomer
gugaaaacuucgguugcug

SEQ ID NO: 13639 - RNA, 19 nt, Artificial Sequence
  RNA Oligomer
aaacuucgguugcuggcag

SEQ ID NO: 13640 - RNA, 19 nt, Artificial Sequence
  RNA Oligomer
uucaucagaauggugagac

SEQ ID NO: 13641 - RNA, 19 nt, Artificial Sequence
  RNA Oligomer
aauggugagacucaucaga

SEQ ID NO: 13642 - RNA, 19 nt, Artificial Sequence
  RNA Oligomer
uaauugcuggacaaccgug

SEQ ID NO: 13643 - RNA, 19 nt, Artificial Sequence
  RNA Oligomer
uuugacuaaaugcaaagug

SEQ ID NO: 13644 - RNA, 19 nt, Artificial Sequence
  RNA Oligomer
aagaugcacuaucuaauuc

SEQ ID NO: 13645 - RNA, 19 nt, Artificial Sequence
  RNA Oligomer
agcauaucuucauggcugu

SEQ ID NO: 13646 - RNA, 19 nt, Artificial Sequence
  RNA Oligomer
acucuggucauccagcuga

SEQ ID NO: 13647 - RNA, 19 nt, Artificial Sequence
  RNA Oligomer
agauucaucagaaugguga

SEQ ID NO: 13648 - RNA, 19 nt, Artificial Sequence
  RNA Oligomer
gugagacucaucagacugg

SEQ ID NO: 13649 - RNA, 19 nt, Artificial Sequence
  RNA Oligomer
uacagggaguuuccaugaa

SEQ ID NO: 13650 - RNA, 19 nt, Artificial Sequence
  RNA Oligomer
cagcauaucuucauggcug

SEQ ID NO: 13651 - RNA, 19 nt, Artificial Sequence
  RNA Oligomer
uuucagcacucuggucauc

SEQ ID NO: 13652 - RNA, 19 nt, Artificial Sequence
  RNA Oligomer
ucggccaucauaugugucu

SEQ ID NO: 13653 - RNA, 19 nt, Artificial Sequence
  RNA Oligomer
agaugcacuaucuaauuca

SEQ ID NO: 13654 - RNA, 19 nt, Artificial Sequence
  RNA Oligomer
uucagcacucuggucaucc

SEQ ID NO: 13655 - RNA, 19 nt, Artificial Sequence
  RNA Oligomer
ucgcuuuccaugugugagg

SEQ ID NO: 13656 - RNA, 19 nt, Artificial Sequence
  RNA Oligomer
cauaugugucuacuguggg

SEQ ID NO: 13657 - RNA, 19 nt, Artificial Sequence
  RNA Oligomer
agucaauggaguccuggcu

SEQ ID NO: 13658 - RNA, 19 nt, Artificial Sequence
  RNA Oligomer
auaucuucauggcugugaa

SEQ ID NO: 13659 - RNA, 19 nt, Artificial Sequence
  RNA Oligomer
auucauggcuguggaauuc

SEQ ID NO: 13660 - RNA, 19 nt, Artificial Sequence
  RNA Oligomer
cuccucgcuuuccaugugu

SEQ ID NO: 13661 - RNA, 19 nt, Artificial Sequence
  RNA Oligomer
ugugugaggugauguccuc

SEQ ID NO: 13662 - RNA, 19 nt, Artificial Sequence
  RNA Oligomer
auucaucagaauggugaga

SEQ ID NO: 13663 - RNA, 19 nt, Artificial Sequence
  RNA Oligomer
agacuggugagaaucauca

SEQ ID NO: 13664 - RNA, 19 nt, Artificial Sequence
  RNA Oligomer
cuggugagaaucaucagug

SEQ ID NO: 13665 - RNA, 19 nt, Artificial Sequence
  RNA Oligomer
uggugagaaucaucagugu

SEQ ID NO: 13666 - RNA, 19 nt, Artificial Sequence
  RNA Oligomer
gugagaaucaucaguguca

SEQ ID NO: 13667 - RNA, 19 nt, Artificial Sequence
  RNA Oligomer
auucacggcugacuuugga

SEQ ID NO: 13668 - RNA, 19 nt, Artificial Sequence
  RNA Oligomer
cuguggguuucagcacucu

SEQ ID NO: 13669 - RNA, 19 nt, Artificial Sequence
  RNA Oligomer
caauucucaugguagugag

SEQ ID NO: 13670 - RNA, 19 nt, Artificial Sequence
  RNA Oligomer
augugugaggugauguccu

SEQ ID NO: 13671 - RNA, 19 nt, Artificial Sequence
  RNA Oligomer
auggugagacucaucagac

SEQ ID NO: 13672 - RNA, 19 nt, Artificial Sequence
  RNA Oligomer
gaauuuaaaugcugcugca

SEQ ID NO: 13673 - RNA, 19 nt, Artificial Sequence
  RNA Oligomer
aauuuaaaugcugcugcag

SEQ ID NO: 13674 - RNA, 19 nt, Artificial Sequence
  RNA Oligomer
accgugggaaaacaaauaa

SEQ ID NO: 13675 - RNA, 19 nt, Artificial Sequence
  RNA Oligomer
uuguggcuguggguuucag

SEQ ID NO: 13676 - RNA, 19 nt, Artificial Sequence
  RNA Oligomer
cuuuccaugugugagguga

SEQ ID NO: 13677 - RNA, 19 nt, Artificial Sequence
  RNA Oligomer
agaauggugagacucauca

SEQ ID NO: 13678 - RNA, 19 nt, Artificial Sequence
  RNA Oligomer
ugagacucaucagacuggu

SEQ ID NO: 13679 - RNA, 19 nt, Artificial Sequence
  RNA Oligomer
aucagacuggugagaauca

SEQ ID NO: 13680 - RNA, 19 nt, Artificial Sequence
  RNA Oligomer
cugugaaauucauggcugu

SEQ ID NO: 13681 - RNA, 19 nt, Artificial Sequence
  RNA Oligomer
uucauggcuguggaauuca

SEQ ID NO: 13682 - RNA, 19 nt, Artificial Sequence
  RNA Oligomer
uccgugggaaaaucaguga

SEQ ID NO: 13683 - RNA, 19 nt, Artificial Sequence
  RNA Oligomer
cuauucaugagagaauaac

SEQ ID NO: 13684 - RNA, 19 nt, Artificial Sequence
  RNA Oligomer
cuuuugacuaaaugcaaag

SEQ ID NO: 13685 - RNA, 19 nt, Artificial Sequence
  RNA Oligomer
auggcuguggaauucacgg

SEQ ID NO: 13686 - RNA, 19 nt, Artificial Sequence
  RNA Oligomer
agggaguuuccaugaagcc

SEQ ID NO: 13687 - RNA, 19 nt, Artificial Sequence
  RNA Oligomer
aaugcugcugcagacaucc

SEQ ID NO: 13688 - RNA, 19 nt, Artificial Sequence
  RNA Oligomer
guccgugggaaaaucagug

SEQ ID NO: 13689 - RNA, 19 nt, Artificial Sequence
  RNA Oligomer
cgugggaaaacaaauaagc

SEQ ID NO: 13690 - RNA, 19 nt, Artificial Sequence
  RNA Oligomer
ucauggcuguggaauucac

SEQ ID NO: 13691 - RNA, 19 nt, Artificial Sequence
  RNA Oligomer
uucucaugguagugaguuu

SEQ ID NO: 13692 - RNA, 19 nt, Artificial Sequence
  RNA Oligomer
agaagcauuucauguucuc

SEQ ID NO: 13693 - RNA, 19 nt, Artificial Sequence
  RNA Oligomer
aaaugcugcugcagacauc

SEQ ID NO: 13694 - RNA, 19 nt, Artificial Sequence
  RNA Oligomer
uucauggcugugaaauuca

SEQ ID NO: 13695 - RNA, 19 nt, Artificial Sequence
  RNA Oligomer
gugaaauucauggcugugg

SEQ ID NO: 13696 - RNA, 19 nt, Artificial Sequence
  RNA Oligomer
aucuggacugcuuguggcu

SEQ ID NO: 13697 - RNA, 19 nt, Artificial Sequence
  RNA Oligomer
cuucauggcugugaaauuc

SEQ ID NO: 13698 - RNA, 19 nt, Artificial Sequence
  RNA Oligomer
cucagaagaugcacuaucu

SEQ ID NO: 13699 - RNA, 19 nt, Artificial Sequence
  RNA Oligomer
aagaagcauuucauguucu

SEQ ID NO: 13700 - RNA, 19 nt, Artificial Sequence
  RNA Oligomer
ugaaauucauggcugugga

SEQ ID NO: 13701 - RNA, 19 nt, Artificial Sequence
  RNA Oligomer
cugagaaagaagcauuuca

SEQ ID NO: 13702 - RNA, 19 nt, Artificial Sequence
  RNA Oligomer
uguuuaacugguauggcac

SEQ ID NO: 13703 - RNA, 19 nt, Artificial Sequence
  RNA Oligomer
ggccuuuuucauuuaucua

SEQ ID NO: 13704 - RNA, 19 nt, Artificial Sequence
  RNA Oligomer
gggcaguuuuuugaaaaug

SEQ ID NO: 13705 - RNA, 19 nt, Artificial Sequence
  RNA Oligomer
ccuuuugacacugcucuaa

SEQ ID NO: 13706 - RNA, 19 nt, Artificial Sequence
  RNA Oligomer
cuggccuuuuucauuuauc

SEQ ID NO: 13707 - RNA, 19 nt, Artificial Sequence
  RNA Oligomer
acuggccuuuuucauuuau

SEQ ID NO: 13708 - RNA, 19 nt, Artificial Sequence
  RNA Oligomer
ugggcaguuuuuugaaaau

SEQ ID NO: 13709 - RNA, 19 nt, Artificial Sequence
  RNA Oligomer
ccaacuaugauuauuaacg

SEQ ID NO: 13710 - RNA, 19 nt, Artificial Sequence
  RNA Oligomer
ugagagagguuuuugaaau

SEQ ID NO: 13711 - RNA, 19 nt, Artificial Sequence
  RNA Oligomer
ugauuauuaacgaugucca

SEQ ID NO: 13712 - RNA, 19 nt, Artificial Sequence
  RNA Oligomer
gcaguuuuuugaaaauggg

SEQ ID NO: 13713 - RNA, 19 nt, Artificial Sequence
  RNA Oligomer
ggcaguuuuuugaaaaugg

SEQ ID NO: 13714 - RNA, 19 nt, Artificial Sequence
  RNA Oligomer
uacuggccuuuuucauuua

SEQ ID NO: 13715 - RNA, 19 nt, Artificial Sequence
  RNA Oligomer
gugggcaguuuuuugaaaa

SEQ ID NO: 13716 - RNA, 19 nt, Artificial Sequence
  RNA Oligomer
ggcgcuaauucaaggaauu

SEQ ID NO: 13717 - RNA, 19 nt, Artificial Sequence
  RNA Oligomer
uuacuggccuuuuucauuu

SEQ ID NO: 13718 - RNA, 19 nt, Artificial Sequence
  RNA Oligomer
ggugccuugucuugugaaa

SEQ ID NO: 13719 - RNA, 19 nt, Artificial Sequence
  RNA Oligomer
agauggagugagagagguu

SEQ ID NO: 13720 - RNA, 19 nt, Artificial Sequence
  RNA Oligomer
acagugcucuuuucuccuc

SEQ ID NO: 13721 - RNA, 19 nt, Artificial Sequence
  RNA Oligomer
acacuuuggaagauggcau

SEQ ID NO: 13722 - RNA, 19 nt, Artificial Sequence
  RNA Oligomer
ggcaauuagacacuuugga

SEQ ID NO: 13723 - RNA, 19 nt, Artificial Sequence
  RNA Oligomer
ggauuuccuaauacuguca

SEQ ID NO: 13724 - RNA, 19 nt, Artificial Sequence
  RNA Oligomer
ccagaaaagcccaaguuca

SEQ ID NO: 13725 - RNA, 19 nt, Artificial Sequence
  RNA Oligomer
ggugggcaguuuuuugaaa

SEQ ID NO: 13726 - RNA, 19 nt, Artificial Sequence
  RNA Oligomer
uccuuuugacacugcucua

SEQ ID NO: 13727 - RNA, 19 nt, Artificial Sequence
  RNA Oligomer
agaagccaacuaugauuau

SEQ ID NO: 13728 - RNA, 19 nt, Artificial Sequence
  RNA Oligomer
ggaagaaaaaaucugggug

SEQ ID NO: 13729 - RNA, 19 nt, Artificial Sequence
  RNA Oligomer
cggaaugaugagcacacaa

SEQ ID NO: 13730 - RNA, 19 nt, Artificial Sequence
  RNA Oligomer
cagugcucuuuucuccuca

SEQ ID NO: 13731 - RNA, 19 nt, Artificial Sequence
  RNA Oligomer
cacuuuggaagauggcaua

SEQ ID NO: 13732 - RNA, 19 nt, Artificial Sequence
  RNA Oligomer
ugaggcaauuagacacuuu

SEQ ID NO: 13733 - RNA, 19 nt, Artificial Sequence
  RNA Oligomer
ugauaaaagauggccauau

SEQ ID NO: 13734 - RNA, 19 nt, Artificial Sequence
  RNA Oligomer
gggcuuuacuccguaacag

SEQ ID NO: 13735 - RNA, 19 nt, Artificial Sequence
  RNA Oligomer
gggaagaaaaaaucugggu

SEQ ID NO: 13736 - RNA, 19 nt, Artificial Sequence
  RNA Oligomer
agacgugggaagaaaaaau

SEQ ID NO: 13737 - RNA, 19 nt, Artificial Sequence
  RNA Oligomer
gagagagguuuuugaaaug

SEQ ID NO: 13738 - RNA, 19 nt, Artificial Sequence
  RNA Oligomer
cagaaaagcccaaguucau

SEQ ID NO: 13739 - RNA, 19 nt, Artificial Sequence
  RNA Oligomer
agauuacaaaucagaaguc

SEQ ID NO: 13740 - RNA, 19 nt, Artificial Sequence
  RNA Oligomer
cgguuaauuuugaagugcu

SEQ ID NO: 13741 - RNA, 19 nt, Artificial Sequence
  RNA Oligomer
gucuugugaaaccuugcug

SEQ ID NO: 13742 - RNA, 19 nt, Artificial Sequence
  RNA Oligomer
gggugccuugucuugugaa

SEQ ID NO: 13743 - RNA, 19 nt, Artificial Sequence
  RNA Oligomer
gaaaaaaucugggugccuu

SEQ ID NO: 13744 - RNA, 19 nt, Artificial Sequence
  RNA Oligomer
guggcacucagucucucuu

SEQ ID NO: 13745 - RNA, 19 nt, Artificial Sequence
  RNA Oligomer
cuaauacugucauccucaa

SEQ ID NO: 13746 - RNA, 19 nt, Artificial Sequence
  RNA Oligomer
gggugggcaguuuuuugaa

SEQ ID NO: 13747 - RNA, 19 nt, Artificial Sequence
  RNA Oligomer
uccugccuauuaucuguca

SEQ ID NO: 13748 - RNA, 19 nt, Artificial Sequence
  RNA Oligomer
aggcgcuaauucaaggaau

SEQ ID NO: 13749 - RNA, 19 nt, Artificial Sequence
  RNA Oligomer
agcuagacgugggaagaaa

SEQ ID NO: 13750 - RNA, 19 nt, Artificial Sequence
  RNA Oligomer
gaaggaucuucggaaugau

SEQ ID NO: 13751 - RNA, 19 nt, Artificial Sequence
  RNA Oligomer
gguugggaauaagaaggau

SEQ ID NO: 13752 - RNA, 19 nt, Artificial Sequence
  RNA Oligomer
cuaauagaauaaaggcagu

SEQ ID NO: 13753 - RNA, 19 nt, Artificial Sequence
  RNA Oligomer
caaagaaaguguauugguu

SEQ ID NO: 13754 - RNA, 19 nt, Artificial Sequence
  RNA Oligomer
gauuuccuaauacugucau

SEQ ID NO: 13755 - RNA, 19 nt, Artificial Sequence
  RNA Oligomer
agauuuuguuggcauagcu

SEQ ID NO: 13756 - RNA, 19 nt, Artificial Sequence
  RNA Oligomer
uuagaagccaacuaugauu

SEQ ID NO: 13757 - RNA, 19 nt, Artificial Sequence
  RNA Oligomer
ugcgguuaauuuugaagug

SEQ ID NO: 13758 - RNA, 19 nt, Artificial Sequence
  RNA Oligomer
gaagaaaaaaucugggugc

SEQ ID NO: 13759 - RNA, 19 nt, Artificial Sequence
  RNA Oligomer
cgugggaagaaaaaaucug

SEQ ID NO: 13760 - RNA, 19 nt, Artificial Sequence
  RNA Oligomer
cuagacgugggaagaaaaa

SEQ ID NO: 13761 - RNA, 19 nt, Artificial Sequence
  RNA Oligomer
agagguuuuugaaauggcu

SEQ ID NO: 13762 - RNA, 19 nt, Artificial Sequence
  RNA Oligomer
ucggaaugaugagcacaca

SEQ ID NO: 13763 - RNA, 19 nt, Artificial Sequence
  RNA Oligomer
caauuagacacuuuggaag

SEQ ID NO: 13764 - RNA, 19 nt, Artificial Sequence
  RNA Oligomer
cugaggcaauuagacacuu

SEQ ID NO: 13765 - RNA, 19 nt, Artificial Sequence
  RNA Oligomer
aacagauuuuguuggcaua

SEQ ID NO: 13766 - RNA, 19 nt, Artificial Sequence
  RNA Oligomer
guccugccuauuaucuguc

SEQ ID NO: 13767 - RNA, 19 nt, Artificial Sequence
  RNA Oligomer
caggcgcuaauucaaggaa

SEQ ID NO: 13768 - RNA, 19 nt, Artificial Sequence
  RNA Oligomer
ccaggcgcuaauucaagga

SEQ ID NO: 13769 - RNA, 19 nt, Artificial Sequence
  RNA Oligomer
gcgguuaauuuugaagugc

SEQ ID NO: 13770 - RNA, 19 nt, Artificial Sequence
  RNA Oligomer
ugggugccuugucuuguga

SEQ ID NO: 13771 - RNA, 19 nt, Artificial Sequence
  RNA Oligomer
gacgugggaagaaaaaauc

SEQ ID NO: 13772 - RNA, 19 nt, Artificial Sequence
  RNA Oligomer
agagagguuuuugaaaugg

SEQ ID NO: 13773 - RNA, 19 nt, Artificial Sequence
  RNA Oligomer
gcauaaccugucucaccug

SEQ ID NO: 13774 - RNA, 19 nt, Artificial Sequence
  RNA Oligomer
gaggcaauuagacacuuug

SEQ ID NO: 13775 - RNA, 19 nt, Artificial Sequence
  RNA Oligomer
aaagucagauggaaaauuc

SEQ ID NO: 13776 - RNA, 19 nt, Artificial Sequence
  RNA Oligomer
uccuaauacugucauccuc

SEQ ID NO: 13777 - RNA, 19 nt, Artificial Sequence
  RNA Oligomer
gccuauuaucugucagcug

SEQ ID NO: 13778 - RNA, 19 nt, Artificial Sequence
  RNA Oligomer
gcuagacgugggaagaaaa

SEQ ID NO: 13779 - RNA, 19 nt, Artificial Sequence
  RNA Oligomer
agguuuuugaaauggcuac

SEQ ID NO: 13780 - RNA, 19 nt, Artificial Sequence
  RNA Oligomer
gagguuuuugaaauggcua

SEQ ID NO: 13781 - RNA, 19 nt, Artificial Sequence
  RNA Oligomer
gggagcuagccaagaugaa

SEQ ID NO: 13782 - RNA, 19 nt, Artificial Sequence
  RNA Oligomer
ugguugggaauaagaagga

SEQ ID NO: 13783 - RNA, 19 nt, Artificial Sequence
  RNA Oligomer
uccaucgacagcccugaua

SEQ ID NO: 13784 - RNA, 19 nt, Artificial Sequence
  RNA Oligomer
gcugacuaaacuuuuuuuc

SEQ ID NO: 13785 - RNA, 19 nt, Artificial Sequence
  RNA Oligomer
cacucagucucucuucucu

SEQ ID NO: 13786 - RNA, 19 nt, Artificial Sequence
  RNA Oligomer
ccaguucccagagguguau

SEQ ID NO: 13787 - RNA, 19 nt, Artificial Sequence
  RNA Oligomer
gguuaauuuugaagugcug

SEQ ID NO: 13788 - RNA, 19 nt, Artificial Sequence
  RNA Oligomer
ccugaggcaauuagacacu

SEQ ID NO: 13789 - RNA, 19 nt, Artificial Sequence
  RNA Oligomer
cagauuuuguuggcauagc

SEQ ID NO: 13790 - RNA, 19 nt, Artificial Sequence
  RNA Oligomer
acagauuuuguuggcauag

SEQ ID NO: 13791 - RNA, 19 nt, Artificial Sequence
  RNA Oligomer
ggaucuucggaaugaugag

SEQ ID NO: 13792 - RNA, 19 nt, Artificial Sequence
  RNA Oligomer
cgucgguucucucguuagu

SEQ ID NO: 13793 - RNA, 19 nt, Artificial Sequence
  RNA Oligomer
cugucauccucaaagaaag

SEQ ID NO: 13794 - RNA, 19 nt, Artificial Sequence
  RNA Oligomer
auacugucauccucaaaga

SEQ ID NO: 13795 - RNA, 19 nt, Artificial Sequence
  RNA Oligomer
cagucucucuucucuccag

SEQ ID NO: 13796 - RNA, 19 nt, Artificial Sequence
  RNA Oligomer
cucuuuucuccucacugua

SEQ ID NO: 13797 - RNA, 19 nt, Artificial Sequence
  RNA Oligomer
ggagcuagccaagaugaag

SEQ ID NO: 13798 - RNA, 19 nt, Artificial Sequence
  RNA Oligomer
ucgacagcccugauaguuu

SEQ ID NO: 13799 - RNA, 19 nt, Artificial Sequence
  RNA Oligomer
ucaaagaaaguguauuggu

SEQ ID NO: 13800 - RNA, 19 nt, Artificial Sequence
  RNA Oligomer
ggguccuuuugacacugcu

SEQ ID NO: 13801 - RNA, 19 nt, Artificial Sequence
  RNA Oligomer
acagcccuuaugcgguuaa

SEQ ID NO: 13802 - RNA, 19 nt, Artificial Sequence
  RNA Oligomer
ucauccugguugggaauaa

SEQ ID NO: 13803 - RNA, 19 nt, Artificial Sequence
  RNA Oligomer
ggaauugguuucacgccug

SEQ ID NO: 13804 - RNA, 19 nt, Artificial Sequence
  RNA Oligomer
cagcccuuaugcgguuaau

SEQ ID NO: 13805 - RNA, 19 nt, Artificial Sequence
  RNA Oligomer
gccuugucuugugaaaccu

SEQ ID NO: 13806 - RNA, 19 nt, Artificial Sequence
  RNA Oligomer
cgguucucucguuagucca

SEQ ID NO: 13807 - RNA, 19 nt, Artificial Sequence
  RNA Oligomer
agaccaaagauggagugag

SEQ ID NO: 13808 - RNA, 19 nt, Artificial Sequence
  RNA Oligomer
ccaucauccugguugggaa

SEQ ID NO: 13809 - RNA, 19 nt, Artificial Sequence
  RNA Oligomer
ccagcugacuaaacuuuuu

SEQ ID NO: 13810 - RNA, 19 nt, Artificial Sequence
  RNA Oligomer
cccguuuugucacuuuuuc

SEQ ID NO: 13811 - RNA, 19 nt, Artificial Sequence
  RNA Oligomer
ccaggguccuuuugacacu

SEQ ID NO: 13812 - RNA, 19 nt, Artificial Sequence
  RNA Oligomer
ucugauaaaagauggccau

SEQ ID NO: 13813 - RNA, 19 nt, Artificial Sequence
  RNA Oligomer
cacagcccuuaugcgguua

SEQ ID NO: 13814 - RNA, 19 nt, Artificial Sequence
  RNA Oligomer
ccuugucuugugaaaccuu

SEQ ID NO: 13815 - RNA, 19 nt, Artificial Sequence
  RNA Oligomer
gcaaagaccaaagauggag

SEQ ID NO: 13816 - RNA, 19 nt, Artificial Sequence
  RNA Oligomer
gaauugguuucacgccuga

SEQ ID NO: 13817 - RNA, 19 nt, Artificial Sequence
  RNA Oligomer
cugauaaaagauggccaua

SEQ ID NO: 13818 - RNA, 19 nt, Artificial Sequence
  RNA Oligomer
uuacuccguaacagauuuu

SEQ ID NO: 13819 - RNA, 19 nt, Artificial Sequence
  RNA Oligomer
gccaacuaugauuauuaac

SEQ ID NO: 13820 - RNA, 19 nt, Artificial Sequence
  RNA Oligomer
cgcuaauucaaggaauuuc

SEQ ID NO: 13821 - RNA, 19 nt, Artificial Sequence
  RNA Oligomer
acaaaucagaagucaucuu

SEQ ID NO: 13822 - RNA, 19 nt, Artificial Sequence
  RNA Oligomer
agcccuuaugcgguuaauu

SEQ ID NO: 13823 - RNA, 19 nt, Artificial Sequence
  RNA Oligomer
caaagaccaaagauggagu

SEQ ID NO: 13824 - RNA, 19 nt, Artificial Sequence
  RNA Oligomer
ucccguuuugucacuuuuu

SEQ ID NO: 13825 - RNA, 19 nt, Artificial Sequence
  RNA Oligomer
acacugcucuaacagcccu

SEQ ID NO: 13826 - RNA, 19 nt, Artificial Sequence
  RNA Oligomer
uccgucgguucucucguua

SEQ ID NO: 13827 - RNA, 19 nt, Artificial Sequence
  RNA Oligomer
cucuaauucacagugcucu

SEQ ID NO: 13828 - RNA, 19 nt, Artificial Sequence
  RNA Oligomer
uucccguuuugucacuuuu

SEQ ID NO: 13829 - RNA, 19 nt, Artificial Sequence
  RNA Oligomer
guaacagauuuuguuggca

SEQ ID NO: 13830 - RNA, 19 nt, Artificial Sequence
  RNA Oligomer
gcuaauucaaggaauuucu

SEQ ID NO: 13831 - RNA, 19 nt, Artificial Sequence
  RNA Oligomer
cccuuaugcgguuaauuuu

SEQ ID NO: 13832 - RNA, 19 nt, Artificial Sequence
  RNA Oligomer
ggaauaagaaggaucuucg

SEQ ID NO: 13833 - RNA, 19 nt, Artificial Sequence
  RNA Oligomer
ucacgccugaggcaauuag

SEQ ID NO: 13834 - RNA, 19 nt, Artificial Sequence
  RNA Oligomer
ccguuuugucacuuuuucu

SEQ ID NO: 13835 - RNA, 19 nt, Artificial Sequence
  RNA Oligomer
cagggcuuuacuccguaac

SEQ ID NO: 13836 - RNA, 19 nt, Artificial Sequence
  RNA Oligomer
guccuuuugacacugcucu

SEQ ID NO: 13837 - RNA, 19 nt, Artificial Sequence
  RNA Oligomer
gaaauggcuacgagagcug

SEQ ID NO: 13838 - RNA, 19 nt, Artificial Sequence
  RNA Oligomer
auaagaaggaucuucggaa

SEQ ID NO: 13839 - RNA, 19 nt, Artificial Sequence
  RNA Oligomer
gcauuucugucccaacgug

SEQ ID NO: 13840 - RNA, 19 nt, Artificial Sequence
  RNA Oligomer
acggucuggucuucagcua

SEQ ID NO: 13841 - RNA, 19 nt, Artificial Sequence
  RNA Oligomer
acuuaagcaucuggcucua

SEQ ID NO: 13842 - RNA, 19 nt, Artificial Sequence
  RNA Oligomer
accuggacuuaagcaucug

SEQ ID NO: 13843 - RNA, 19 nt, Artificial Sequence
  RNA Oligomer
cucaccuggacuuaagcau

SEQ ID NO: 13844 - RNA, 19 nt, Artificial Sequence
  RNA Oligomer
accugucucaccuggacuu

SEQ ID NO: 13845 - RNA, 19 nt, Artificial Sequence
  RNA Oligomer
uccucaaagaaaguguauu

SEQ ID NO: 13846 - RNA, 19 nt, Artificial Sequence
  RNA Oligomer
aaccagaaaagcccaaguu

SEQ ID NO: 13847 - RNA, 19 nt, Artificial Sequence
  RNA Oligomer
ccguaacagauuuuguugg

SEQ ID NO: 13848 - RNA, 19 nt, Artificial Sequence
  RNA Oligomer
cuccguaacagauuuuguu

SEQ ID NO: 13849 - RNA, 19 nt, Artificial Sequence
  RNA Oligomer
ucagggcuuuacuccguaa

SEQ ID NO: 13850 - RNA, 19 nt, Artificial Sequence
  RNA Oligomer
caggguccuuuugacacug

SEQ ID NO: 13851 - RNA, 19 nt, Artificial Sequence
  RNA Oligomer
ucaagcauuucugucccaa

SEQ ID NO: 13852 - RNA, 19 nt, Artificial Sequence
  RNA Oligomer
cuuuuuuucuguaccaguu

SEQ ID NO: 13853 - RNA, 19 nt, Artificial Sequence
  RNA Oligomer
ccugucucaccuggacuua

SEQ ID NO: 13854 - RNA, 19 nt, Artificial Sequence
  RNA Oligomer
ggcauaaccugucucaccu

SEQ ID NO: 13855 - RNA, 19 nt, Artificial Sequence
  RNA Oligomer
agauggcauaaccugucuc

SEQ ID NO: 13856 - RNA, 19 nt, Artificial Sequence
  RNA Oligomer
aggaauugguuucacgccu

SEQ ID NO: 13857 - RNA, 19 nt, Artificial Sequence
  RNA Oligomer
uaacagauuuuguuggcau

SEQ ID NO: 13858 - RNA, 19 nt, Artificial Sequence
  RNA Oligomer
cguaacagauuuuguuggc

SEQ ID NO: 13859 - RNA, 19 nt, Artificial Sequence
  RNA Oligomer
aacauguccugccuauuau

SEQ ID NO: 13860 - RNA, 19 nt, Artificial Sequence
  RNA Oligomer
gcgcuaauucaaggaauuu

SEQ ID NO: 13861 - RNA, 19 nt, Artificial Sequence
  RNA Oligomer
ucagaagucaucuugcuac

SEQ ID NO: 13862 - RNA, 19 nt, Artificial Sequence
  RNA Oligomer
ugcaagcacagcccuuaug

SEQ ID NO: 13863 - RNA, 19 nt, Artificial Sequence
  RNA Oligomer
ugccuugucuugugaaacc

SEQ ID NO: 13864 - RNA, 19 nt, Artificial Sequence
  RNA Oligomer
gggaauaagaaggaucuuc

SEQ ID NO: 13865 - RNA, 19 nt, Artificial Sequence
  RNA Oligomer
uccggaagaaacuggugau

SEQ ID NO: 13866 - RNA, 19 nt, Artificial Sequence
  RNA Oligomer
agguguaugugcccacagu

SEQ ID NO: 13867 - RNA, 19 nt, Artificial Sequence
  RNA Oligomer
agcccaaguucaugcagcu

SEQ ID NO: 13868 - RNA, 19 nt, Artificial Sequence
  RNA Oligomer
gcuuuacuccguaacagau

SEQ ID NO: 13869 - RNA, 19 nt, Artificial Sequence
  RNA Oligomer
ggcuuuacuccguaacaga

SEQ ID NO: 13870 - RNA, 19 nt, Artificial Sequence
  RNA Oligomer
ccugccuauuaucugucag

SEQ ID NO: 13871 - RNA, 19 nt, Artificial Sequence
  RNA Oligomer
ucuugcuucuuucuagaaa

SEQ ID NO: 13872 - RNA, 19 nt, Artificial Sequence
  RNA Oligomer
cugcaagcacagcccuuau

SEQ ID NO: 13873 - RNA, 19 nt, Artificial Sequence
  RNA Oligomer
cagcugacuaaacuuuuuu

SEQ ID NO: 13874 - RNA, 19 nt, Artificial Sequence
  RNA Oligomer
caccuggacuuaagcaucu

SEQ ID NO: 13875 - RNA, 19 nt, Artificial Sequence
  RNA Oligomer
cugucucaccuggacuuaa

SEQ ID NO: 13876 - RNA, 19 nt, Artificial Sequence
  RNA Oligomer
uggauuuccuaauacuguc

SEQ ID NO: 13877 - RNA, 19 nt, Artificial Sequence
  RNA Oligomer
uaacauguccugccuauua

SEQ ID NO: 13878 - RNA, 19 nt, Artificial Sequence
  RNA Oligomer
uaagaaggaucuucggaau

SEQ ID NO: 13879 - RNA, 19 nt, Artificial Sequence
  RNA Oligomer
ccauccggaagaaacuggu

SEQ ID NO: 13880 - RNA, 19 nt, Artificial Sequence
  RNA Oligomer
cauccucaaagaaagugua

SEQ ID NO: 13881 - RNA, 19 nt, Artificial Sequence
  RNA Oligomer
ugccuauuaucugucagcu

SEQ ID NO: 13882 - RNA, 19 nt, Artificial Sequence
  RNA Oligomer
ugaaauggcuacgagagcu

SEQ ID NO: 13883 - RNA, 19 nt, Artificial Sequence
  RNA Oligomer
agaaggaucuucggaauga

SEQ ID NO: 13884 - RNA, 19 nt, Artificial Sequence
  RNA Oligomer
ugggaauaagaaggaucuu

SEQ ID NO: 13885 - RNA, 19 nt, Artificial Sequence
  RNA Oligomer
uccugguugggaauaagaa

SEQ ID NO: 13886 - RNA, 19 nt, Artificial Sequence
  RNA Oligomer
gacuuaagcaucuggcucu

SEQ ID NO: 13887 - RNA, 19 nt, Artificial Sequence
  RNA Oligomer
ggacuuaagcaucuggcuc

SEQ ID NO: 13888 - RNA, 19 nt, Artificial Sequence
  RNA Oligomer
cguuuugucacuuuuucug

SEQ ID NO: 13889 - RNA, 19 nt, Artificial Sequence
  RNA Oligomer
ccucaaagaaaguguauug

SEQ ID NO: 13890 - RNA, 19 nt, Artificial Sequence
  RNA Oligomer
agggcuuuacuccguaaca

SEQ ID NO: 13891 - RNA, 19 nt, Artificial Sequence
  RNA Oligomer
cucuggugagucaccacuu

SEQ ID NO: 13892 - RNA, 19 nt, Artificial Sequence
  RNA Oligomer
cuccagcugacuaaacuuu

SEQ ID NO: 13893 - RNA, 19 nt, Artificial Sequence
  RNA Oligomer
guaugugcccacaguguuu

SEQ ID NO: 13894 - RNA, 19 nt, Artificial Sequence
  RNA Oligomer
gccugaggcaauuagacac

SEQ ID NO: 13895 - RNA, 19 nt, Artificial Sequence
  RNA Oligomer
cgccugaggcaauuagaca

SEQ ID NO: 13896 - RNA, 19 nt, Artificial Sequence
  RNA Oligomer
agagguguaugugcccaca

SEQ ID NO: 13897 - RNA, 19 nt, Artificial Sequence
  RNA Oligomer
acaccaggcgcuaauucaa

SEQ ID NO: 13898 - RNA, 19 nt, Artificial Sequence
  RNA Oligomer
agcuagccaagaugaagca

SEQ ID NO: 13899 - RNA, 19 nt, Artificial Sequence
  RNA Oligomer
uccagcugacuaaacuuuu

SEQ ID NO: 13900 - RNA, 19 nt, Artificial Sequence
  RNA Oligomer
ucauccucaaagaaagugu

SEQ ID NO: 13901 - RNA, 19 nt, Artificial Sequence
  RNA Oligomer
guacucuggugagucacca

SEQ ID NO: 13902 - RNA, 19 nt, Artificial Sequence
  RNA Oligomer
caaccagaaaagcccaagu

SEQ ID NO: 13903 - RNA, 19 nt, Artificial Sequence
  RNA Oligomer
cucaaccagaaaagcccaa

SEQ ID NO: 13904 - RNA, 19 nt, Artificial Sequence
  RNA Oligomer
ggcuaaguaaauaggaauu

SEQ ID NO: 13905 - RNA, 19 nt, Artificial Sequence
  RNA Oligomer
gggcuaaguaaauaggaau

SEQ ID NO: 13906 - RNA, 19 nt, Artificial Sequence
  RNA Oligomer
uagauaaaugaaaaaggcc

SEQ ID NO: 13907 - RNA, 19 nt, Artificial Sequence
  RNA Oligomer
cauuuucaaaaaacugccc

SEQ ID NO: 13908 - RNA, 19 nt, Artificial Sequence
  RNA Oligomer
uuagagcagugucaaaagg

SEQ ID NO: 13909 - RNA, 19 nt, Artificial Sequence
  RNA Oligomer
gauaaaugaaaaaggccag

SEQ ID NO: 13910 - RNA, 19 nt, Artificial Sequence
  RNA Oligomer
auaaaugaaaaaggccagu

SEQ ID NO: 13911 - RNA, 19 nt, Artificial Sequence
  RNA Oligomer
auuuucaaaaaacugccca

SEQ ID NO: 13912 - RNA, 19 nt, Artificial Sequence
  RNA Oligomer
cguuaauaaucauaguugg

SEQ ID NO: 13913 - RNA, 19 nt, Artificial Sequence
  RNA Oligomer
auuucaaaaaccucucuca

SEQ ID NO: 13914 - RNA, 19 nt, Artificial Sequence
  RNA Oligomer
uggacaucguuaauaauca

SEQ ID NO: 13915 - RNA, 19 nt, Artificial Sequence
  RNA Oligomer
cccauuuucaaaaaacugc

SEQ ID NO: 13916 - RNA, 19 nt, Artificial Sequence
  RNA Oligomer
ccauuuucaaaaaacugcc

SEQ ID NO: 13917 - RNA, 19 nt, Artificial Sequence
  RNA Oligomer
uaaaugaaaaaggccagua

SEQ ID NO: 13918 - RNA, 19 nt, Artificial Sequence
  RNA Oligomer
uuuucaaaaaacugcccac

SEQ ID NO: 13919 - RNA, 19 nt, Artificial Sequence
  RNA Oligomer
aauuccuugaauuagcgcc

SEQ ID NO: 13920 - RNA, 19 nt, Artificial Sequence
  RNA Oligomer
aaaugaaaaaggccaguaa

SEQ ID NO: 13921 - RNA, 19 nt, Artificial Sequence
  RNA Oligomer
uuucacaagacaaggcacc

SEQ ID NO: 13922 - RNA, 19 nt, Artificial Sequence
  RNA Oligomer
aaccucucucacuccaucu

SEQ ID NO: 13923 - RNA, 19 nt, Artificial Sequence
  RNA Oligomer
gaggagaaaagagcacugu

SEQ ID NO: 13924 - RNA, 19 nt, Artificial Sequence
  RNA Oligomer
augccaucuuccaaagugu

SEQ ID NO: 13925 - RNA, 19 nt, Artificial Sequence
  RNA Oligomer
uccaaagugucuaauugcc

SEQ ID NO: 13926 - RNA, 19 nt, Artificial Sequence
  RNA Oligomer
ugacaguauuaggaaaucc

SEQ ID NO: 13927 - RNA, 19 nt, Artificial Sequence
  RNA Oligomer
ugaacuugggcuuuucugg

SEQ ID NO: 13928 - RNA, 19 nt, Artificial Sequence
  RNA Oligomer
uuucaaaaaacugcccacc

SEQ ID NO: 13929 - RNA, 19 nt, Artificial Sequence
  RNA Oligomer
uagagcagugucaaaagga

SEQ ID NO: 13930 - RNA, 19 nt, Artificial Sequence
  RNA Oligomer
auaaucauaguuggcuucu

SEQ ID NO: 13931 - RNA, 19 nt, Artificial Sequence
  RNA Oligomer
cacccagauuuuuucuucc

SEQ ID NO: 13932 - RNA, 19 nt, Artificial Sequence
  RNA Oligomer
uugugugcucaucauuccg

SEQ ID NO: 13933 - RNA, 19 nt, Artificial Sequence
  RNA Oligomer
ugaggagaaaagagcacug

SEQ ID NO: 13934 - RNA, 19 nt, Artificial Sequence
  RNA Oligomer
uaugccaucuuccaaagug

SEQ ID NO: 13935 - RNA, 19 nt, Artificial Sequence
  RNA Oligomer
aaagugucuaauugccuca

SEQ ID NO: 13936 - RNA, 19 nt, Artificial Sequence
  RNA Oligomer
auauggccaucuuuuauca

SEQ ID NO: 13937 - RNA, 19 nt, Artificial Sequence
  RNA Oligomer
cuguuacggaguaaagccc

SEQ ID NO: 13938 - RNA, 19 nt, Artificial Sequence
  RNA Oligomer
acccagauuuuuucuuccc

SEQ ID NO: 13939 - RNA, 19 nt, Artificial Sequence
  RNA Oligomer
auuuuuucuucccacgucu

SEQ ID NO: 13940 - RNA, 19 nt, Artificial Sequence
  RNA Oligomer
cauuucaaaaaccucucuc

SEQ ID NO: 13941 - RNA, 19 nt, Artificial Sequence
  RNA Oligomer
augaacuugggcuuuucug

SEQ ID NO: 13942 - RNA, 19 nt, Artificial Sequence
  RNA Oligomer
gacuucugauuuguaaucu

SEQ ID NO: 13943 - RNA, 19 nt, Artificial Sequence
  RNA Oligomer
agcacuucaaaauuaaccg

SEQ ID NO: 13944 - RNA, 19 nt, Artificial Sequence
  RNA Oligomer
cagcaagguuucacaagac

SEQ ID NO: 13945 - RNA, 19 nt, Artificial Sequence
  RNA Oligomer
uucacaagacaaggcaccc

SEQ ID NO: 13946 - RNA, 19 nt, Artificial Sequence
  RNA Oligomer
aaggcacccagauuuuuuc

SEQ ID NO: 13947 - RNA, 19 nt, Artificial Sequence
  RNA Oligomer
aagagagacugagugccac

SEQ ID NO: 13948 - RNA, 19 nt, Artificial Sequence
  RNA Oligomer
uugaggaugacaguauuag

SEQ ID NO: 13949 - RNA, 19 nt, Artificial Sequence
  RNA Oligomer
uucaaaaaacugcccaccc

SEQ ID NO: 13950 - RNA, 19 nt, Artificial Sequence
  RNA Oligomer
ugacagauaauaggcagga

SEQ ID NO: 13951 - RNA, 19 nt, Artificial Sequence
  RNA Oligomer
auuccuugaauuagcgccu

SEQ ID NO: 13952 - RNA, 19 nt, Artificial Sequence
  RNA Oligomer
uuucuucccacgucuagcu

SEQ ID NO: 13953 - RNA, 19 nt, Artificial Sequence
  RNA Oligomer
aucauuccgaagauccuuc

SEQ ID NO: 13954 - RNA, 19 nt, Artificial Sequence
  RNA Oligomer
auccuucuuauucccaacc

SEQ ID NO: 13955 - RNA, 19 nt, Artificial Sequence
  RNA Oligomer
acugccuuuauucuauuag

SEQ ID NO: 13956 - RNA, 19 nt, Artificial Sequence
  RNA Oligomer
aaccaauacacuuucuuug

SEQ ID NO: 13957 - RNA, 19 nt, Artificial Sequence
  RNA Oligomer
augacaguauuaggaaauc

SEQ ID NO: 13958 - RNA, 19 nt, Artificial Sequence
  RNA Oligomer
agcuaugccaacaaaaucu

SEQ ID NO: 13959 - RNA, 19 nt, Artificial Sequence
  RNA Oligomer
aaucauaguuggcuucuaa

SEQ ID NO: 13960 - RNA, 19 nt, Artificial Sequence
  RNA Oligomer
cacuucaaaauuaaccgca

SEQ ID NO: 13961 - RNA, 19 nt, Artificial Sequence
  RNA Oligomer
gcacccagauuuuuucuuc

SEQ ID NO: 13962 - RNA, 19 nt, Artificial Sequence
  RNA Oligomer
cagauuuuuucuucccacg

SEQ ID NO: 13963 - RNA, 19 nt, Artificial Sequence
  RNA Oligomer
uuuuucuucccacgucuag

SEQ ID NO: 13964 - RNA, 19 nt, Artificial Sequence
  RNA Oligomer
agccauuucaaaaaccucu

SEQ ID NO: 13965 - RNA, 19 nt, Artificial Sequence
  RNA Oligomer
ugugugcucaucauuccga

SEQ ID NO: 13966 - RNA, 19 nt, Artificial Sequence
  RNA Oligomer
cuuccaaagugucuaauug

SEQ ID NO: 13967 - RNA, 19 nt, Artificial Sequence
  RNA Oligomer
aagugucuaauugccucag

SEQ ID NO: 13968 - RNA, 19 nt, Artificial Sequence
  RNA Oligomer
uaugccaacaaaaucuguu

SEQ ID NO: 13969 - RNA, 19 nt, Artificial Sequence
  RNA Oligomer
gacagauaauaggcaggac

SEQ ID NO: 13970 - RNA, 19 nt, Artificial Sequence
  RNA Oligomer
uuccuugaauuagcgccug

SEQ ID NO: 13971 - RNA, 19 nt, Artificial Sequence
  RNA Oligomer
uccuugaauuagcgccugg

SEQ ID NO: 13972 - RNA, 19 nt, Artificial Sequence
  RNA Oligomer
gcacuucaaaauuaaccgc

SEQ ID NO: 13973 - RNA, 19 nt, Artificial Sequence
  RNA Oligomer
ucacaagacaaggcaccca

SEQ ID NO: 13974 - RNA, 19 nt, Artificial Sequence
  RNA Oligomer
gauuuuuucuucccacguc

SEQ ID NO: 13975 - RNA, 19 nt, Artificial Sequence
  RNA Oligomer
ccauuucaaaaaccucucu

SEQ ID NO: 13976 - RNA, 19 nt, Artificial Sequence
  RNA Oligomer
caggugagacagguuaugc

SEQ ID NO: 13977 - RNA, 19 nt, Artificial Sequence
  RNA Oligomer
caaagugucuaauugccuc

SEQ ID NO: 13978 - RNA, 19 nt, Artificial Sequence
  RNA Oligomer
gaauuuuccaucugacuuu

SEQ ID NO: 13979 - RNA, 19 nt, Artificial Sequence
  RNA Oligomer
gaggaugacaguauuagga

SEQ ID NO: 13980 - RNA, 19 nt, Artificial Sequence
  RNA Oligomer
cagcugacagauaauaggc

SEQ ID NO: 13981 - RNA, 19 nt, Artificial Sequence
  RNA Oligomer
uuuucuucccacgucuagc

SEQ ID NO: 13982 - RNA, 19 nt, Artificial Sequence
  RNA Oligomer
guagccauuucaaaaaccu

SEQ ID NO: 13983 - RNA, 19 nt, Artificial Sequence
  RNA Oligomer
uagccauuucaaaaaccuc

SEQ ID NO: 13984 - RNA, 19 nt, Artificial Sequence
  RNA Oligomer
uucaucuuggcuagcuccc

SEQ ID NO: 13985 - RNA, 19 nt, Artificial Sequence
  RNA Oligomer
uccuucuuauucccaacca

SEQ ID NO: 13986 - RNA, 19 nt, Artificial Sequence
  RNA Oligomer
uaucagggcugucgaugga

SEQ ID NO: 13987 - RNA, 19 nt, Artificial Sequence
  RNA Oligomer
gaaaaaaaguuuagucagc

SEQ ID NO: 13988 - RNA, 19 nt, Artificial Sequence
  RNA Oligomer
agagaagagagacugagug

SEQ ID NO: 13989 - RNA, 19 nt, Artificial Sequence
  RNA Oligomer
auacaccucugggaacugg

SEQ ID NO: 13990 - RNA, 19 nt, Artificial Sequence
  RNA Oligomer
cagcacuucaaaauuaacc

SEQ ID NO: 13991 - RNA, 19 nt, Artificial Sequence
  RNA Oligomer
agugucuaauugccucagg

SEQ ID NO: 13992 - RNA, 19 nt, Artificial Sequence
  RNA Oligomer
gcuaugccaacaaaaucug

SEQ ID NO: 13993 - RNA, 19 nt, Artificial Sequence
  RNA Oligomer
cuaugccaacaaaaucugu

SEQ ID NO: 13994 - RNA, 19 nt, Artificial Sequence
  RNA Oligomer
cucaucauuccgaagaucc

SEQ ID NO: 13995 - RNA, 19 nt, Artificial Sequence
  RNA Oligomer
acuaacgagagaaccgacg

SEQ ID NO: 13996 - RNA, 19 nt, Artificial Sequence
  RNA Oligomer
cuuucuuugaggaugacag

SEQ ID NO: 13997 - RNA, 19 nt, Artificial Sequence
  RNA Oligomer
ucuuugaggaugacaguau

SEQ ID NO: 13998 - RNA, 19 nt, Artificial Sequence
  RNA Oligomer
cuggagagaagagagacug

SEQ ID NO: 13999 - RNA, 19 nt, Artificial Sequence
  RNA Oligomer
uacagugaggagaaaagag

SEQ ID NO: 14000 - RNA, 19 nt, Artificial Sequence
  RNA Oligomer
cuucaucuuggcuagcucc

SEQ ID NO: 14001 - RNA, 19 nt, Artificial Sequence
  RNA Oligomer
aaacuaucagggcugucga

SEQ ID NO: 14002 - RNA, 19 nt, Artificial Sequence
  RNA Oligomer
accaauacacuuucuuuga

SEQ ID NO: 14003 - RNA, 19 nt, Artificial Sequence
  RNA Oligomer
agcagugucaaaaggaccc

SEQ ID NO: 14004 - RNA, 19 nt, Artificial Sequence
  RNA Oligomer
uuaaccgcauaagggcugu

SEQ ID NO: 14005 - RNA, 19 nt, Artificial Sequence
  RNA Oligomer
uuauucccaaccaggauga

SEQ ID NO: 14006 - RNA, 19 nt, Artificial Sequence
  RNA Oligomer
caggcgugaaaccaauucc

SEQ ID NO: 14007 - RNA, 19 nt, Artificial Sequence
  RNA Oligomer
auuaaccgcauaagggcug

SEQ ID NO: 14008 - RNA, 19 nt, Artificial Sequence
  RNA Oligomer
agguuucacaagacaaggc

SEQ ID NO: 14009 - RNA, 19 nt, Artificial Sequence
  RNA Oligomer
uggacuaacgagagaaccg

SEQ ID NO: 14010 - RNA, 19 nt, Artificial Sequence
  RNA Oligomer
cucacuccaucuuuggucu

SEQ ID NO: 14011 - RNA, 19 nt, Artificial Sequence
  RNA Oligomer
uucccaaccaggaugaugg

SEQ ID NO: 14012 - RNA, 19 nt, Artificial Sequence
  RNA Oligomer
aaaaaguuuagucagcugg

SEQ ID NO: 14013 - RNA, 19 nt, Artificial Sequence
  RNA Oligomer
gaaaaagugacaaaacggg

SEQ ID NO: 14014 - RNA, 19 nt, Artificial Sequence
  RNA Oligomer
agugucaaaaggacccugg

SEQ ID NO: 14015 - RNA, 19 nt, Artificial Sequence
  RNA Oligomer
auggccaucuuuuaucaga

SEQ ID NO: 14016 - RNA, 19 nt, Artificial Sequence
  RNA Oligomer
uaaccgcauaagggcugug

SEQ ID NO: 14017 - RNA, 19 nt, Artificial Sequence
  RNA Oligomer
aagguuucacaagacaagg

SEQ ID NO: 14018 - RNA, 19 nt, Artificial Sequence
  RNA Oligomer
cuccaucuuuggucuuugc

SEQ ID NO: 14019 - RNA, 19 nt, Artificial Sequence
  RNA Oligomer
ucaggcgugaaaccaauuc

SEQ ID NO: 14020 - RNA, 19 nt, Artificial Sequence
  RNA Oligomer
uauggccaucuuuuaucag

SEQ ID NO: 14021 - RNA, 19 nt, Artificial Sequence
  RNA Oligomer
aaaaucuguuacggaguaa

SEQ ID NO: 14022 - RNA, 19 nt, Artificial Sequence
  RNA Oligomer
guuaauaaucauaguuggc

SEQ ID NO: 14023 - RNA, 19 nt, Artificial Sequence
  RNA Oligomer
gaaauuccuugaauuagcg

SEQ ID NO: 14024 - RNA, 19 nt, Artificial Sequence
  RNA Oligomer
aagaugacuucugauuugu

SEQ ID NO: 14025 - RNA, 19 nt, Artificial Sequence
  RNA Oligomer
aauuaaccgcauaagggcu

SEQ ID NO: 14026 - RNA, 19 nt, Artificial Sequence
  RNA Oligomer
acuccaucuuuggucuuug

SEQ ID NO: 14027 - RNA, 19 nt, Artificial Sequence
  RNA Oligomer
aaaaagugacaaaacggga

SEQ ID NO: 14028 - RNA, 19 nt, Artificial Sequence
  RNA Oligomer
agggcuguuagagcagugu

SEQ ID NO: 14029 - RNA, 19 nt, Artificial Sequence
  RNA Oligomer
uaacgagagaaccgacgga

SEQ ID NO: 14030 - RNA, 19 nt, Artificial Sequence
  RNA Oligomer
agagcacugugaauuagag

SEQ ID NO: 14031 - RNA, 19 nt, Artificial Sequence
  RNA Oligomer
aaaagugacaaaacgggaa

SEQ ID NO: 14032 - RNA, 19 nt, Artificial Sequence
  RNA Oligomer
ugccaacaaaaucuguuac

SEQ ID NO: 14033 - RNA, 19 nt, Artificial Sequence
  RNA Oligomer
agaaauuccuugaauuagc

SEQ ID NO: 14034 - RNA, 19 nt, Artificial Sequence
  RNA Oligomer
aaaauuaaccgcauaaggg

SEQ ID NO: 14035 - RNA, 19 nt, Artificial Sequence
  RNA Oligomer
cgaagauccuucuuauucc

SEQ ID NO: 14036 - RNA, 19 nt, Artificial Sequence
  RNA Oligomer
cuaauugccucaggcguga

SEQ ID NO: 14037 - RNA, 19 nt, Artificial Sequence
  RNA Oligomer
agaaaaagugacaaaacgg

SEQ ID NO: 14038 - RNA, 19 nt, Artificial Sequence
  RNA Oligomer
guuacggaguaaagcccug

SEQ ID NO: 14039 - RNA, 19 nt, Artificial Sequence
  RNA Oligomer
agagcagugucaaaaggac

SEQ ID NO: 14040 - RNA, 19 nt, Artificial Sequence
  RNA Oligomer
cagcucucguagccauuuc

SEQ ID NO: 14041 - RNA, 19 nt, Artificial Sequence
  RNA Oligomer
uuccgaagauccuucuuau

SEQ ID NO: 14042 - RNA, 19 nt, Artificial Sequence
  RNA Oligomer
cacguugggacagaaaugc

SEQ ID NO: 14043 - RNA, 19 nt, Artificial Sequence
  RNA Oligomer
uagcugaagaccagaccgu

SEQ ID NO: 14044 - RNA, 19 nt, Artificial Sequence
  RNA Oligomer
uagagccagaugcuuaagu

SEQ ID NO: 14045 - RNA, 19 nt, Artificial Sequence
  RNA Oligomer
cagaugcuuaaguccaggu

SEQ ID NO: 14046 - RNA, 19 nt, Artificial Sequence
  RNA Oligomer
augcuuaaguccaggugag

SEQ ID NO: 14047 - RNA, 19 nt, Artificial Sequence
  RNA Oligomer
aaguccaggugagacaggu

SEQ ID NO: 14048 - RNA, 19 nt, Artificial Sequence
  RNA Oligomer
aauacacuuucuuugagga

SEQ ID NO: 14049 - RNA, 19 nt, Artificial Sequence
  RNA Oligomer
aacuugggcuuuucugguu

SEQ ID NO: 14050 - RNA, 19 nt, Artificial Sequence
  RNA Oligomer
ccaacaaaaucuguuacgg

SEQ ID NO: 14051 - RNA, 19 nt, Artificial Sequence
  RNA Oligomer
aacaaaaucuguuacggag

SEQ ID NO: 14052 - RNA, 19 nt, Artificial Sequence
  RNA Oligomer
uuacggaguaaagcccuga

SEQ ID NO: 14053 - RNA, 19 nt, Artificial Sequence
  RNA Oligomer
cagugucaaaaggacccug

SEQ ID NO: 14054 - RNA, 19 nt, Artificial Sequence
  RNA Oligomer
uugggacagaaaugcuuga

SEQ ID NO: 14055 - RNA, 19 nt, Artificial Sequence
  RNA Oligomer
aacugguacagaaaaaaag

SEQ ID NO: 14056 - RNA, 19 nt, Artificial Sequence
  RNA Oligomer
uaaguccaggugagacagg

SEQ ID NO: 14057 - RNA, 19 nt, Artificial Sequence
  RNA Oligomer
aggugagacagguuaugcc

SEQ ID NO: 14058 - RNA, 19 nt, Artificial Sequence
  RNA Oligomer
gagacagguuaugccaucu

SEQ ID NO: 14059 - RNA, 19 nt, Artificial Sequence
  RNA Oligomer
aggcgugaaaccaauuccu

SEQ ID NO: 14060 - RNA, 19 nt, Artificial Sequence
  RNA Oligomer
augccaacaaaaucuguua

SEQ ID NO: 14061 - RNA, 19 nt, Artificial Sequence
  RNA Oligomer
gccaacaaaaucuguuacg

SEQ ID NO: 14062 - RNA, 19 nt, Artificial Sequence
  RNA Oligomer
auaauaggcaggacauguu

SEQ ID NO: 14063 - RNA, 19 nt, Artificial Sequence
  RNA Oligomer
aaauuccuugaauuagcgc

SEQ ID NO: 14064 - RNA, 19 nt, Artificial Sequence
  RNA Oligomer
guagcaagaugacuucuga

SEQ ID NO: 14065 - RNA, 19 nt, Artificial Sequence
  RNA Oligomer
cauaagggcugugcuugca

SEQ ID NO: 14066 - RNA, 19 nt, Artificial Sequence
  RNA Oligomer
gguuucacaagacaaggca

SEQ ID NO: 14067 - RNA, 19 nt, Artificial Sequence
  RNA Oligomer
gaagauccuucuuauuccc

SEQ ID NO: 14068 - RNA, 19 nt, Artificial Sequence
  RNA Oligomer
aucaccaguuucuuccgga

SEQ ID NO: 14069 - RNA, 19 nt, Artificial Sequence
  RNA Oligomer
acugugggcacauacaccu

SEQ ID NO: 14070 - RNA, 19 nt, Artificial Sequence
  RNA Oligomer
agcugcaugaacuugggcu

SEQ ID NO: 14071 - RNA, 19 nt, Artificial Sequence
  RNA Oligomer
aucuguuacggaguaaagc

SEQ ID NO: 14072 - RNA, 19 nt, Artificial Sequence
  RNA Oligomer
ucuguuacggaguaaagcc

SEQ ID NO: 14073 - RNA, 19 nt, Artificial Sequence
  RNA Oligomer
cugacagauaauaggcagg

SEQ ID NO: 14074 - RNA, 19 nt, Artificial Sequence
  RNA Oligomer
uuucuagaaagaagcaaga

SEQ ID NO: 14075 - RNA, 19 nt, Artificial Sequence
  RNA Oligomer
auaagggcugugcuugcag

SEQ ID NO: 14076 - RNA, 19 nt, Artificial Sequence
  RNA Oligomer
aaaaaaguuuagucagcug

SEQ ID NO: 14077 - RNA, 19 nt, Artificial Sequence
  RNA Oligomer
agaugcuuaaguccaggug

SEQ ID NO: 14078 - RNA, 19 nt, Artificial Sequence
  RNA Oligomer
uuaaguccaggugagacag

SEQ ID NO: 14079 - RNA, 19 nt, Artificial Sequence
  RNA Oligomer
gacaguauuaggaaaucca

SEQ ID NO: 14080 - RNA, 19 nt, Artificial Sequence
  RNA Oligomer
uaauaggcaggacauguua

SEQ ID NO: 14081 - RNA, 19 nt, Artificial Sequence
  RNA Oligomer
auuccgaagauccuucuua

SEQ ID NO: 14082 - RNA, 19 nt, Artificial Sequence
  RNA Oligomer
accaguuucuuccggaugg

SEQ ID NO: 14083 - RNA, 19 nt, Artificial Sequence
  RNA Oligomer
uacacuuucuuugaggaug

SEQ ID NO: 14084 - RNA, 19 nt, Artificial Sequence
  RNA Oligomer
agcugacagauaauaggca

SEQ ID NO: 14085 - RNA, 19 nt, Artificial Sequence
  RNA Oligomer
agcucucguagccauuuca

SEQ ID NO: 14086 - RNA, 19 nt, Artificial Sequence
  RNA Oligomer
ucauuccgaagauccuucu

SEQ ID NO: 14087 - RNA, 19 nt, Artificial Sequence
  RNA Oligomer
aagauccuucuuauuccca

SEQ ID NO: 14088 - RNA, 19 nt, Artificial Sequence
  RNA Oligomer
uucuuauucccaaccagga

SEQ ID NO: 14089 - RNA, 19 nt, Artificial Sequence
  RNA Oligomer
agagccagaugcuuaaguc

SEQ ID NO: 14090 - RNA, 19 nt, Artificial Sequence
  RNA Oligomer
gagccagaugcuuaagucc

SEQ ID NO: 14091 - RNA, 19 nt, Artificial Sequence
  RNA Oligomer
cagaaaaagugacaaaacg

SEQ ID NO: 14092 - RNA, 19 nt, Artificial Sequence
  RNA Oligomer
caauacacuuucuuugagg

SEQ ID NO: 14093 - RNA, 19 nt, Artificial Sequence
  RNA Oligomer
uguuacggaguaaagcccu

SEQ ID NO: 14094 - RNA, 19 nt, Artificial Sequence
  RNA Oligomer
aaguggugacucaccagag

SEQ ID NO: 14095 - RNA, 19 nt, Artificial Sequence
  RNA Oligomer
aaaguuuagucagcuggag

SEQ ID NO: 14096 - RNA, 19 nt, Artificial Sequence
  RNA Oligomer
aaacacugugggcacauac

SEQ ID NO: 14097 - RNA, 19 nt, Artificial Sequence
  RNA Oligomer
gugucuaauugccucaggc

SEQ ID NO: 14098 - RNA, 19 nt, Artificial Sequence
  RNA Oligomer
ugucuaauugccucaggcg

SEQ ID NO: 14099 - RNA, 19 nt, Artificial Sequence
  RNA Oligomer
ugugggcacauacaccucu

SEQ ID NO: 14100 - RNA, 19 nt, Artificial Sequence
  RNA Oligomer
uugaauuagcgccuggugu

SEQ ID NO: 14101 - RNA, 19 nt, Artificial Sequence
  RNA Oligomer
ugcuucaucuuggcuagcu

SEQ ID NO: 14102 - RNA, 19 nt, Artificial Sequence
  RNA Oligomer
aaaaguuuagucagcugga

SEQ ID NO: 14103 - RNA, 19 nt, Artificial Sequence
  RNA Oligomer
acacuuucuuugaggauga

SEQ ID NO: 14104 - RNA, 19 nt, Artificial Sequence
  RNA Oligomer
uggugacucaccagaguac

SEQ ID NO: 14105 - RNA, 19 nt, Artificial Sequence
  RNA Oligomer
acuugggcuuuucugguug

SEQ ID NO: 14106 - RNA, 19 nt, Artificial Sequence
  RNA Oligomer
uugggcuuuucugguugag

SEQ ID NO: 14107 - RNA, 19 nt, Artificial Sequence
  RNA Oligomer
aauuccuauuuacuuagcc

SEQ ID NO: 14108 - RNA, 19 nt, Artificial Sequence
  RNA Oligomer
auuccuauuuacuuagccc

SEQ ID NO: 14109 - RNA, 19 nt, Artificial Sequence
  RNA Oligomer
cacaacuaauuucacccaa

SEQ ID NO: 14110 - RNA, 19 nt, Artificial Sequence
  RNA Oligomer
acaacuaauuucacccaag

SEQ ID NO: 14111 - RNA, 19 nt, Artificial Sequence
  RNA Oligomer
ccaagguuuuaagcacguu

SEQ ID NO: 14112 - RNA, 19 nt, Artificial Sequence
  RNA Oligomer
ccagacuucagaaacaaau

SEQ ID NO: 14113 - RNA, 19 nt, Artificial Sequence
  RNA Oligomer
gcaucucuuucauguucuc

SEQ ID NO: 14114 - RNA, 19 nt, Artificial Sequence
  RNA Oligomer
ccauuuugggacauucuaa

SEQ ID NO: 14115 - RNA, 19 nt, Artificial Sequence
  RNA Oligomer
gggucaucaaucggaacuc

SEQ ID NO: 14116 - RNA, 19 nt, Artificial Sequence
  RNA Oligomer
gcaucuuagaacccucccu

SEQ ID NO: 14117 - RNA, 19 nt, Artificial Sequence
  RNA Oligomer
cccuauuauuuucaucaug

SEQ ID NO: 14118 - RNA, 19 nt, Artificial Sequence
  RNA Oligomer
ugaacaauuugugcggcua

SEQ ID NO: 14119 - RNA, 19 nt, Artificial Sequence
  RNA Oligomer
cccaagguuuuaagcacgu

SEQ ID NO: 14120 - RNA, 19 nt, Artificial Sequence
  RNA Oligomer
caacuaauuucacccaagg

SEQ ID NO: 14121 - RNA, 19 nt, Artificial Sequence
  RNA Oligomer
gcaccgagagaaguuccaa

SEQ ID NO: 14122 - RNA, 19 nt, Artificial Sequence
  RNA Oligomer
gccuuauguuccgcaugua

SEQ ID NO: 14123 - RNA, 19 nt, Artificial Sequence
  RNA Oligomer
ccaaugucuuugucuggca

SEQ ID NO: 14124 - RNA, 19 nt, Artificial Sequence
  RNA Oligomer
gucaucaaucggaacucaa

SEQ ID NO: 14125 - RNA, 19 nt, Artificial Sequence
  RNA Oligomer
cgagaccuuagcaacacca

SEQ ID NO: 14126 - RNA, 19 nt, Artificial Sequence
  RNA Oligomer
accauuaugagaacuucua

SEQ ID NO: 14127 - RNA, 19 nt, Artificial Sequence
  RNA Oligomer
guaccuugauggaccauuu

SEQ ID NO: 14128 - RNA, 19 nt, Artificial Sequence
  RNA Oligomer
ccaucguccucacagucuu

SEQ ID NO: 14129 - RNA, 19 nt, Artificial Sequence
  RNA Oligomer
ucucuuucauguucuccua

SEQ ID NO: 14130 - RNA, 19 nt, Artificial Sequence
  RNA Oligomer
cagccagcaucucuuucau

SEQ ID NO: 14131 - RNA, 19 nt, Artificial Sequence
  RNA Oligomer
cccucuguugcuucccuuu

SEQ ID NO: 14132 - RNA, 19 nt, Artificial Sequence
  RNA Oligomer
acccucuguugcuucccuu

SEQ ID NO: 14133 - RNA, 19 nt, Artificial Sequence
  RNA Oligomer
gcagcccaaugucuuuguc

SEQ ID NO: 14134 - RNA, 19 nt, Artificial Sequence
  RNA Oligomer
ccaccauuaugagaacuuc

SEQ ID NO: 14135 - RNA, 19 nt, Artificial Sequence
  RNA Oligomer
gccaaguguucuguaagaa

SEQ ID NO: 14136 - RNA, 19 nt, Artificial Sequence
  RNA Oligomer
ggcauaaguuugagguguc

SEQ ID NO: 14137 - RNA, 19 nt, Artificial Sequence
  RNA Oligomer
ggaguggcauaaguuugag

SEQ ID NO: 14138 - RNA, 19 nt, Artificial Sequence
  RNA Oligomer
ggccaucauguaugucuuu

SEQ ID NO: 14139 - RNA, 19 nt, Artificial Sequence
  RNA Oligomer
agaaguauuacuggugguu

SEQ ID NO: 14140 - RNA, 19 nt, Artificial Sequence
  RNA Oligomer
aaaccuuccucaaccgcua

SEQ ID NO: 14141 - RNA, 19 nt, Artificial Sequence
  RNA Oligomer
agcgagaggaccauguguu

SEQ ID NO: 14142 - RNA, 19 nt, Artificial Sequence
  RNA Oligomer
agguuuuaagcacguucuu

SEQ ID NO: 14143 - RNA, 19 nt, Artificial Sequence
  RNA Oligomer
ggucccagcaaucaucuau

SEQ ID NO: 14144 - RNA, 19 nt, Artificial Sequence
  RNA Oligomer
guaugucuuugccucccac

SEQ ID NO: 14145 - RNA, 19 nt, Artificial Sequence
  RNA Oligomer
cauuuugggacauucuaau

SEQ ID NO: 14146 - RNA, 19 nt, Artificial Sequence
  RNA Oligomer
gagagaaguuccaacgcag

SEQ ID NO: 14147 - RNA, 19 nt, Artificial Sequence
  RNA Oligomer
gcgacauugagacugaguu

SEQ ID NO: 14148 - RNA, 19 nt, Artificial Sequence
  RNA Oligomer
ggauaugaucugucccucu

SEQ ID NO: 14149 - RNA, 19 nt, Artificial Sequence
  RNA Oligomer
ccuucaucgagaucuccaa

SEQ ID NO: 14150 - RNA, 19 nt, Artificial Sequence
  RNA Oligomer
agagcaucgugucugagaa

SEQ ID NO: 14151 - RNA, 19 nt, Artificial Sequence
  RNA Oligomer
caaugucuuugucuggcau

SEQ ID NO: 14152 - RNA, 19 nt, Artificial Sequence
  RNA Oligomer
caucuaugguuccucgcau

SEQ ID NO: 14153 - RNA, 19 nt, Artificial Sequence
  RNA Oligomer
gguuuuaagcacguucuuu

SEQ ID NO: 14154 - RNA, 19 nt, Artificial Sequence
  RNA Oligomer
caagguuuuaagcacguuc

SEQ ID NO: 14155 - RNA, 19 nt, Artificial Sequence
  RNA Oligomer
caccucuguucuuccuauu

SEQ ID NO: 14156 - RNA, 19 nt, Artificial Sequence
  RNA Oligomer
ggagucuauucacaggccu

SEQ ID NO: 14157 - RNA, 19 nt, Artificial Sequence
  RNA Oligomer
ggcuuugaguacaagucag

SEQ ID NO: 14158 - RNA, 19 nt, Artificial Sequence
  RNA Oligomer
gccaucauguaugucuuug

SEQ ID NO: 14159 - RNA, 19 nt, Artificial Sequence
  RNA Oligomer
ccuacaucuugcucaccau

SEQ ID NO: 14160 - RNA, 19 nt, Artificial Sequence
  RNA Oligomer
agacggugcaacaguucaa

SEQ ID NO: 14161 - RNA, 19 nt, Artificial Sequence
  RNA Oligomer
acauguuuguggaguccau

SEQ ID NO: 14162 - RNA, 19 nt, Artificial Sequence
  RNA Oligomer
ggaugagaaauuucaagag

SEQ ID NO: 14163 - RNA, 19 nt, Artificial Sequence
  RNA Oligomer
gucuuugucuggcauaaag

SEQ ID NO: 14164 - RNA, 19 nt, Artificial Sequence
  RNA Oligomer
gcuacugguuugagaacac

SEQ ID NO: 14165 - RNA, 19 nt, Artificial Sequence
  RNA Oligomer
ggagcaaugacacuguacu

SEQ ID NO: 14166 - RNA, 19 nt, Artificial Sequence
  RNA Oligomer
ccuacaaagugcugaagau

SEQ ID NO: 14167 - RNA, 19 nt, Artificial Sequence
  RNA Oligomer
aucuaugguuccucgcauu

SEQ ID NO: 14168 - RNA, 19 nt, Artificial Sequence
  RNA Oligomer
ccauuaugagaacuucuag

SEQ ID NO: 14169 - RNA, 19 nt, Artificial Sequence
  RNA Oligomer
aggaguggcauaaguuuga

SEQ ID NO: 14170 - RNA, 19 nt, Artificial Sequence
  RNA Oligomer
ccaucauguaugucuuugc

SEQ ID NO: 14171 - RNA, 19 nt, Artificial Sequence
  RNA Oligomer
uggccaucauguaugucuu

SEQ ID NO: 14172 - RNA, 19 nt, Artificial Sequence
  RNA Oligomer
guccucucuugccucuuuc

SEQ ID NO: 14173 - RNA, 19 nt, Artificial Sequence
  RNA Oligomer
acaguucaagcgcuucauu

SEQ ID NO: 14174 - RNA, 19 nt, Artificial Sequence
  RNA Oligomer
accuggugcugcuguuuaa

SEQ ID NO: 14175 - RNA, 19 nt, Artificial Sequence
  RNA Oligomer
ggaagcuuuggaauggcaa

SEQ ID NO: 14176 - RNA, 19 nt, Artificial Sequence
  RNA Oligomer
ccggaugagaaauuucaag

SEQ ID NO: 14177 - RNA, 19 nt, Artificial Sequence
  RNA Oligomer
uguuguucgugacuauuuu

SEQ ID NO: 14178 - RNA, 19 nt, Artificial Sequence
  RNA Oligomer
cucuguuguucgugacuau

SEQ ID NO: 14179 - RNA, 19 nt, Artificial Sequence
  RNA Oligomer
ccucuguuguucgugacua

SEQ ID NO: 14180 - RNA, 19 nt, Artificial Sequence
  RNA Oligomer
agcccaaugucuuugucug

SEQ ID NO: 14181 - RNA, 19 nt, Artificial Sequence
  RNA Oligomer
gauugaagaaauccgaaau

SEQ ID NO: 14182 - RNA, 19 nt, Artificial Sequence
  RNA Oligomer
gaacaauuugugcggcuac

SEQ ID NO: 14183 - RNA, 19 nt, Artificial Sequence
  RNA Oligomer
ggcgucuacaugagaaaug

SEQ ID NO: 14184 - RNA, 19 nt, Artificial Sequence
  RNA Oligomer
ccuggcgucuacaugagaa

SEQ ID NO: 14185 - RNA, 19 nt, Artificial Sequence
  RNA Oligomer
gggucuucuuuggcuauca

SEQ ID NO: 14186 - RNA, 19 nt, Artificial Sequence
  RNA Oligomer
gucucccuuccaaauaaau

SEQ ID NO: 14187 - RNA, 19 nt, Artificial Sequence
  RNA Oligomer
accuauguaugcaaugcuc

SEQ ID NO: 14188 - RNA, 19 nt, Artificial Sequence
  RNA Oligomer
accucuguucuuccuauuu

SEQ ID NO: 14189 - RNA, 19 nt, Artificial Sequence
  RNA Oligomer
ggaggugcagcgauuugau

SEQ ID NO: 14190 - RNA, 19 nt, Artificial Sequence
  RNA Oligomer
uguucuguaagaagaucua

SEQ ID NO: 14191 - RNA, 19 nt, Artificial Sequence
  RNA Oligomer
gucccagcaaucaucuaug

SEQ ID NO: 14192 - RNA, 19 nt, Artificial Sequence
  RNA Oligomer
ccuauuauuuucaucaugg

SEQ ID NO: 14193 - RNA, 19 nt, Artificial Sequence
  RNA Oligomer
ucuuucauguucuccuaca

SEQ ID NO: 14194 - RNA, 19 nt, Artificial Sequence
  RNA Oligomer
caacaguucaagcgcuuca

SEQ ID NO: 14195 - RNA, 19 nt, Artificial Sequence
  RNA Oligomer
uaacgucauuccagcccuu

SEQ ID NO: 14196 - RNA, 19 nt, Artificial Sequence
  RNA Oligomer
uggugcugcuguuuaacuu

SEQ ID NO: 14197 - RNA, 19 nt, Artificial Sequence
  RNA Oligomer
ugagaaauuucaagaggcu

SEQ ID NO: 14198 - RNA, 19 nt, Artificial Sequence
  RNA Oligomer
cggaugagaaauuucaaga

SEQ ID NO: 14199 - RNA, 19 nt, Artificial Sequence
  RNA Oligomer
cuguuguucgugacuauuu

SEQ ID NO: 14200 - RNA, 19 nt, Artificial Sequence
  RNA Oligomer
cuggcgucuacaugagaaa

SEQ ID NO: 14201 - RNA, 19 nt, Artificial Sequence
  RNA Oligomer
caagccauuuacagaaacc

SEQ ID NO: 14202 - RNA, 19 nt, Artificial Sequence
  RNA Oligomer
gcuaugcagauggcgugua

SEQ ID NO: 14203 - RNA, 19 nt, Artificial Sequence
  RNA Oligomer
uccagacuucagaaacaaa

SEQ ID NO: 14204 - RNA, 19 nt, Artificial Sequence
  RNA Oligomer
uuccagacuucagaaacaa

SEQ ID NO: 14205 - RNA, 19 nt, Artificial Sequence
  RNA Oligomer
guguucuguaagaagaucu

SEQ ID NO: 14206 - RNA, 19 nt, Artificial Sequence
  RNA Oligomer
caaguguucuguaagaaga

SEQ ID NO: 14207 - RNA, 19 nt, Artificial Sequence
  RNA Oligomer
uggcauaaguuugaggugu

SEQ ID NO: 14208 - RNA, 19 nt, Artificial Sequence
  RNA Oligomer
gggcuuugaguacaaguca

SEQ ID NO: 14209 - RNA, 19 nt, Artificial Sequence
  RNA Oligomer
cuauuauuuucaucauggg

SEQ ID NO: 14210 - RNA, 19 nt, Artificial Sequence
  RNA Oligomer
ucauguaugucuuugccuc

SEQ ID NO: 14211 - RNA, 19 nt, Artificial Sequence
  RNA Oligomer
aacaguucaagcgcuucau

SEQ ID NO: 14212 - RNA, 19 nt, Artificial Sequence
  RNA Oligomer
guaacgucauuccagcccu

SEQ ID NO: 14213 - RNA, 19 nt, Artificial Sequence
  RNA Oligomer
ggcaagaagguaacgucau

SEQ ID NO: 14214 - RNA, 19 nt, Artificial Sequence
  RNA Oligomer
cgacuuugaugggaauggc

SEQ ID NO: 14215 - RNA, 19 nt, Artificial Sequence
  RNA Oligomer
aggaaaagucucgccuuau

SEQ ID NO: 14216 - RNA, 19 nt, Artificial Sequence
  RNA Oligomer
uggcugacaaggauggcaa

SEQ ID NO: 14217 - RNA, 19 nt, Artificial Sequence
  RNA Oligomer
uguuuguggaguccauguu

SEQ ID NO: 14218 - RNA, 19 nt, Artificial Sequence
  RNA Oligomer
gcuguuuaacuuggaggaa

SEQ ID NO: 14219 - RNA, 19 nt, Artificial Sequence
  RNA Oligomer
cgugacuauuuugagggca

SEQ ID NO: 14220 - RNA, 19 nt, Artificial Sequence
  RNA Oligomer
ugucuuugucuggcauaaa

SEQ ID NO: 14221 - RNA, 19 nt, Artificial Sequence
  RNA Oligomer
augucuuugucuggcauaa

SEQ ID NO: 14222 - RNA, 19 nt, Artificial Sequence
  RNA Oligomer
ugcagcccaaugucuuugu

SEQ ID NO: 14223 - RNA, 19 nt, Artificial Sequence
  RNA Oligomer
cugggccacugaaguuuuc

SEQ ID NO: 14224 - RNA, 19 nt, Artificial Sequence
  RNA Oligomer
ccugggccacugaaguuuu

SEQ ID NO: 14225 - RNA, 19 nt, Artificial Sequence
  RNA Oligomer
ggucuucuuuggcuaucac

SEQ ID NO: 14226 - RNA, 19 nt, Artificial Sequence
  RNA Oligomer
ccauuuacagaaacccacu

SEQ ID NO: 14227 - RNA, 19 nt, Artificial Sequence
  RNA Oligomer
acucacuucucccaccauu

SEQ ID NO: 14228 - RNA, 19 nt, Artificial Sequence
  RNA Oligomer
gcgauuugaugggugguac

SEQ ID NO: 14229 - RNA, 19 nt, Artificial Sequence
  RNA Oligomer
ccaaguguucuguaagaag

SEQ ID NO: 14230 - RNA, 19 nt, Artificial Sequence
  RNA Oligomer
cugcucaucauccauggua

SEQ ID NO: 14231 - RNA, 19 nt, Artificial Sequence
  RNA Oligomer
accucuacauccugcucua

SEQ ID NO: 14232 - RNA, 19 nt, Artificial Sequence
  RNA Oligomer
uccuacaucuugcucacca

SEQ ID NO: 14233 - RNA, 19 nt, Artificial Sequence
  RNA Oligomer
ccagcaucucuuucauguu

SEQ ID NO: 14234 - RNA, 19 nt, Artificial Sequence
  RNA Oligomer
ucaagcgcuucauugagaa

SEQ ID NO: 14235 - RNA, 19 nt, Artificial Sequence
  RNA Oligomer
gcaacaguucaagcgcuuc

SEQ ID NO: 14236 - RNA, 19 nt, Artificial Sequence
  RNA Oligomer
cgacauugagacugaguug

SEQ ID NO: 14237 - RNA, 19 nt, Artificial Sequence
  RNA Oligomer
ugacaugggaagauuuuca

SEQ ID NO: 14238 - RNA, 19 nt, Artificial Sequence
  RNA Oligomer
ucauuuccaaggaugaguu

SEQ ID NO: 14239 - RNA, 19 nt, Artificial Sequence
  RNA Oligomer
guggucuucaugaaaggcu

SEQ ID NO: 14240 - RNA, 19 nt, Artificial Sequence
  RNA Oligomer
cugguggucuucaugaaag

SEQ ID NO: 14241 - RNA, 19 nt, Artificial Sequence
  RNA Oligomer
cuguuuaacuuggaggaag

SEQ ID NO: 14242 - RNA, 19 nt, Artificial Sequence
  RNA Oligomer
uggaagcuuuggaauggca

SEQ ID NO: 14243 - RNA, 19 nt, Artificial Sequence
  RNA Oligomer
ugacuauuuugagggcagu

SEQ ID NO: 14244 - RNA, 19 nt, Artificial Sequence
  RNA Oligomer
gugacuauuuugagggcag

SEQ ID NO: 14245 - RNA, 19 nt, Artificial Sequence
  RNA Oligomer
cggagcaaugacacuguac

SEQ ID NO: 14246 - RNA, 19 nt, Artificial Sequence
  RNA Oligomer
gguugaagaugugcgggau

SEQ ID NO: 14247 - RNA, 19 nt, Artificial Sequence
  RNA Oligomer
ucgccaccuaccagaacau

SEQ ID NO: 14248 - RNA, 19 nt, Artificial Sequence
  RNA Oligomer
ugagaaaccgcacaguguu

SEQ ID NO: 14249 - RNA, 19 nt, Artificial Sequence
  RNA Oligomer
agguggccauagucaguca

SEQ ID NO: 14250 - RNA, 19 nt, Artificial Sequence
  RNA Oligomer
cucacuucucccaccauua

SEQ ID NO: 14251 - RNA, 19 nt, Artificial Sequence
  RNA Oligomer
gacucacuucucccaccau

SEQ ID NO: 14252 - RNA, 19 nt, Artificial Sequence
  RNA Oligomer
cgauuugaugggugguaca

SEQ ID NO: 14253 - RNA, 19 nt, Artificial Sequence
  RNA Oligomer
agcgauuugauggguggua

SEQ ID NO: 14254 - RNA, 19 nt, Artificial Sequence
  RNA Oligomer
aggaccacuaugcuguaca

SEQ ID NO: 14255 - RNA, 19 nt, Artificial Sequence
  RNA Oligomer
caggaccacuaugcuguac

SEQ ID NO: 14256 - RNA, 19 nt, Artificial Sequence
  RNA Oligomer
agcauggacacuucugguu

SEQ ID NO: 14257 - RNA, 19 nt, Artificial Sequence
  RNA Oligomer
ucaucauccaugguagcuu

SEQ ID NO: 14258 - RNA, 19 nt, Artificial Sequence
  RNA Oligomer
cguccucacagucuuacac

SEQ ID NO: 14259 - RNA, 19 nt, Artificial Sequence
  RNA Oligomer
caagaagguaacgucauuc

SEQ ID NO: 14260 - RNA, 19 nt, Artificial Sequence
  RNA Oligomer
caugggaagauuuucacuu

SEQ ID NO: 14261 - RNA, 19 nt, Artificial Sequence
  RNA Oligomer
gcauguacgacuuugaugg

SEQ ID NO: 14262 - RNA, 19 nt, Artificial Sequence
  RNA Oligomer
cgcauguacgacuuugaug

SEQ ID NO: 14263 - RNA, 19 nt, Artificial Sequence
  RNA Oligomer
uggucuucaugaaaggcuc

SEQ ID NO: 14264 - RNA, 19 nt, Artificial Sequence
  RNA Oligomer
uguucucucuggcugacaa

SEQ ID NO: 14265 - RNA, 19 nt, Artificial Sequence
  RNA Oligomer
ccaggacauguuuguggag

SEQ ID NO: 14266 - RNA, 19 nt, Artificial Sequence
  RNA Oligomer
aggcgcugguggaaaaucu

SEQ ID NO: 14267 - RNA, 19 nt, Artificial Sequence
  RNA Oligomer
ugcuguuuaacuuggagga

SEQ ID NO: 14268 - RNA, 19 nt, Artificial Sequence
  RNA Oligomer
gcugcuguuuaacuuggag

SEQ ID NO: 14269 - RNA, 19 nt, Artificial Sequence
  RNA Oligomer
ugcugcuguuuaacuugga

SEQ ID NO: 14270 - RNA, 19 nt, Artificial Sequence
  RNA Oligomer
acuucguccuguccagcaa

SEQ ID NO: 14271 - RNA, 19 nt, Artificial Sequence
  RNA Oligomer
uccggaugagaaauuucaa

SEQ ID NO: 14272 - RNA, 19 nt, Artificial Sequence
  RNA Oligomer
cccucuguuguucgugacu

SEQ ID NO: 14273 - RNA, 19 nt, Artificial Sequence
  RNA Oligomer
gaccucuguucagcaccau

SEQ ID NO: 14274 - RNA, 19 nt, Artificial Sequence
  RNA Oligomer
gcaaugacacuguacugga

SEQ ID NO: 14275 - RNA, 19 nt, Artificial Sequence
  RNA Oligomer
ccaguugagcagagguuug

SEQ ID NO: 14276 - RNA, 19 nt, Artificial Sequence
  RNA Oligomer
ccuucuucaacucccugca

SEQ ID NO: 14277 - RNA, 19 nt, Artificial Sequence
  RNA Oligomer
acaucuacaucacccagcu

SEQ ID NO: 14278 - RNA, 19 nt, Artificial Sequence
  RNA Oligomer
ugaggugucaguguuagug

SEQ ID NO: 14279 - RNA, 19 nt, Artificial Sequence
  RNA Oligomer
gaguacaagucagggcagu

SEQ ID NO: 14280 - RNA, 19 nt, Artificial Sequence
  RNA Oligomer
cuggccaucauguaugucu

SEQ ID NO: 14281 - RNA, 19 nt, Artificial Sequence
  RNA Oligomer
ggccucuuccaugaugaug

SEQ ID NO: 14282 - RNA, 19 nt, Artificial Sequence
  RNA Oligomer
ccauguggugaauguguac

SEQ ID NO: 14283 - RNA, 19 nt, Artificial Sequence
  RNA Oligomer
uccucacagucuuacacag

SEQ ID NO: 14284 - RNA, 19 nt, Artificial Sequence
  RNA Oligomer
gggaagauuuucacuucau

SEQ ID NO: 14285 - RNA, 19 nt, Artificial Sequence
  RNA Oligomer
gacaugggaagauuuucac

SEQ ID NO: 14286 - RNA, 19 nt, Artificial Sequence
  RNA Oligomer
ggaggaacugacaugggaa

SEQ ID NO: 14287 - RNA, 19 nt, Artificial Sequence
  RNA Oligomer
agaucuccaacaacugccu

SEQ ID NO: 14288 - RNA, 19 nt, Artificial Sequence
  RNA Oligomer
uguacgacuuugaugggaa

SEQ ID NO: 14289 - RNA, 19 nt, Artificial Sequence
  RNA Oligomer
caggacauguuuguggagu

SEQ ID NO: 14290 - RNA, 19 nt, Artificial Sequence
  RNA Oligomer
uguuuaacuuggaggaaga

SEQ ID NO: 14291 - RNA, 19 nt, Artificial Sequence
  RNA Oligomer
ugaccuggugcugcuguuu

SEQ ID NO: 14292 - RNA, 19 nt, Artificial Sequence
  RNA Oligomer
ucaacuucguccuguccag

SEQ ID NO: 14293 - RNA, 19 nt, Artificial Sequence
  RNA Oligomer
caaugacacuguacuggag

SEQ ID NO: 14294 - RNA, 19 nt, Artificial Sequence
  RNA Oligomer
agcccuucuucaacucccu

SEQ ID NO: 14295 - RNA, 19 nt, Artificial Sequence
  RNA Oligomer
gcauggacacuucugguug

SEQ ID NO: 14296 - RNA, 19 nt, Artificial Sequence
  RNA Oligomer
ccucuacauccugcucuau

SEQ ID NO: 14297 - RNA, 19 nt, Artificial Sequence
  RNA Oligomer
ugacccaccaccucuacau

SEQ ID NO: 14298 - RNA, 19 nt, Artificial Sequence
  RNA Oligomer
uccuggccaucauguaugu

SEQ ID NO: 14299 - RNA, 19 nt, Artificial Sequence
  RNA Oligomer
gcaaccucaucaccuuccu

SEQ ID NO: 14300 - RNA, 19 nt, Artificial Sequence
  RNA Oligomer
acaucuugcucaccaugug

SEQ ID NO: 14301 - RNA, 19 nt, Artificial Sequence
  RNA Oligomer
agguuuggcaagaagguaa

SEQ ID NO: 14302 - RNA, 19 nt, Artificial Sequence
  RNA Oligomer
gaaauuucaagaggcucca

SEQ ID NO: 14303 - RNA, 19 nt, Artificial Sequence
  RNA Oligomer
ucccucuguuguucgugac

SEQ ID NO: 14304 - RNA, 19 nt, Artificial Sequence
  RNA Oligomer
cucccucuguuguucguga

SEQ ID NO: 14305 - RNA, 19 nt, Artificial Sequence
  RNA Oligomer
ccaucguccuugaacaauu

SEQ ID NO: 14306 - RNA, 19 nt, Artificial Sequence
  RNA Oligomer
uggcgucuacaugagaaau

SEQ ID NO: 14307 - RNA, 19 nt, Artificial Sequence
  RNA Oligomer
caguugagcagagguuuga

SEQ ID NO: 14308 - RNA, 19 nt, Artificial Sequence
  RNA Oligomer
gcacaucuacaucacccag

SEQ ID NO: 14309 - RNA, 19 nt, Artificial Sequence
  RNA Oligomer
gucuucaagucauccguca

SEQ ID NO: 14310 - RNA, 19 nt, Artificial Sequence
  RNA Oligomer
ugcucaucauccaugguag

SEQ ID NO: 14311 - RNA, 19 nt, Artificial Sequence
  RNA Oligomer
guguaccuguucuccauca

SEQ ID NO: 14312 - RNA, 19 nt, Artificial Sequence
  RNA Oligomer
ugaauguguaccuguucuc

SEQ ID NO: 14313 - RNA, 19 nt, Artificial Sequence
  RNA Oligomer
gugaauguguaccuguucu

SEQ ID NO: 14314 - RNA, 19 nt, Artificial Sequence
  RNA Oligomer
agcaucucuuucauguucu

SEQ ID NO: 14315 - RNA, 19 nt, Artificial Sequence
  RNA Oligomer
gguuuggcaagaagguaac

SEQ ID NO: 14316 - RNA, 19 nt, Artificial Sequence
  RNA Oligomer
gacauugagacugaguuga

SEQ ID NO: 14317 - RNA, 19 nt, Artificial Sequence
  RNA Oligomer
cucagugccuggauuguug

SEQ ID NO: 14318 - RNA, 19 nt, Artificial Sequence
  RNA Oligomer
ugcucccucuguuguucgu

SEQ ID NO: 14319 - RNA, 19 nt, Artificial Sequence
  RNA Oligomer
ugguugaagaugugcggga

SEQ ID NO: 14320 - RNA, 19 nt, Artificial Sequence
  RNA Oligomer
cccagcuuccugcagaaaa

SEQ ID NO: 14321 - RNA, 19 nt, Artificial Sequence
  RNA Oligomer
ugcuuucagaccuggugag

SEQ ID NO: 14322 - RNA, 19 nt, Artificial Sequence
  RNA Oligomer
agccuucucugauuuccca

SEQ ID NO: 14323 - RNA, 19 nt, Artificial Sequence
  RNA Oligomer
gugcagcgauuugaugggu

SEQ ID NO: 14324 - RNA, 19 nt, Artificial Sequence
  RNA Oligomer
ugcacaucuacaucaccca

SEQ ID NO: 14325 - RNA, 19 nt, Artificial Sequence
  RNA Oligomer
uggucuucaagucauccgu

SEQ ID NO: 14326 - RNA, 19 nt, Artificial Sequence
  RNA Oligomer
ccuuuugccuccauccuca

SEQ ID NO: 14327 - RNA, 19 nt, Artificial Sequence
  RNA Oligomer
agaugugccagauacccaa

SEQ ID NO: 14328 - RNA, 19 nt, Artificial Sequence
  RNA Oligomer
ucuauguccugcucaucau

SEQ ID NO: 14329 - RNA, 19 nt, Artificial Sequence
  RNA Oligomer
caccucuacauccugcucu

SEQ ID NO: 14330 - RNA, 19 nt, Artificial Sequence
  RNA Oligomer
ggagguuuggcaagaaggu

SEQ ID NO: 14331 - RNA, 19 nt, Artificial Sequence
  RNA Oligomer
ggaacugacaugggaagau

SEQ ID NO: 14332 - RNA, 19 nt, Artificial Sequence
  RNA Oligomer
acaaggaggaacugacaug

SEQ ID NO: 14333 - RNA, 19 nt, Artificial Sequence
  RNA Oligomer
cuccuggagaccuuuuuca

SEQ ID NO: 14334 - RNA, 19 nt, Artificial Sequence
  RNA Oligomer
ggaccauguguugguugaa

SEQ ID NO: 14335 - RNA, 19 nt, Artificial Sequence
  RNA Oligomer
ucaagugucuccagagcuc

SEQ ID NO: 14336 - RNA, 19 nt, Artificial Sequence
  RNA Oligomer
acaaccucauggagcacag

SEQ ID NO: 14337 - RNA, 19 nt, Artificial Sequence
  RNA Oligomer
cucuguucuuccuauuucu

SEQ ID NO: 14338 - RNA, 19 nt, Artificial Sequence
  RNA Oligomer
ugcagcgauuugaugggug

SEQ ID NO: 14339 - RNA, 19 nt, Artificial Sequence
  RNA Oligomer
auguguaccuguucuccau

SEQ ID NO: 14340 - RNA, 19 nt, Artificial Sequence
  RNA Oligomer
gaggaacugacaugggaag

SEQ ID NO: 14341 - RNA, 19 nt, Artificial Sequence
  RNA Oligomer
aggaggaacugacauggga

SEQ ID NO: 14342 - RNA, 19 nt, Artificial Sequence
  RNA Oligomer
gugugcucccucuguuguu

SEQ ID NO: 14343 - RNA, 19 nt, Artificial Sequence
  RNA Oligomer
ucgcuguguaugaguggcu

SEQ ID NO: 14344 - RNA, 19 nt, Artificial Sequence
  RNA Oligomer
acaucgcuguguaugagug

SEQ ID NO: 14345 - RNA, 19 nt, Artificial Sequence
  RNA Oligomer
caauaccuauguaugcaau

SEQ ID NO: 14346 - RNA, 19 nt, Artificial Sequence
  RNA Oligomer
cuaauuucacccaagguuu

SEQ ID NO: 14347 - RNA, 19 nt, Artificial Sequence
  RNA Oligomer
guaagaagaucuacuucau

SEQ ID NO: 14348 - RNA, 19 nt, Artificial Sequence
  RNA Oligomer
cccuguacaaccaggacuu

SEQ ID NO: 14349 - RNA, 19 nt, Artificial Sequence
  RNA Oligomer
ccagcuuccugcagaaaac

SEQ ID NO: 14350 - RNA, 19 nt, Artificial Sequence
  RNA Oligomer
gcacguucuuucaucagac

SEQ ID NO: 14351 - RNA, 19 nt, Artificial Sequence
  RNA Oligomer
gccauuuacagaaacccac

SEQ ID NO: 14352 - RNA, 19 nt, Artificial Sequence
  RNA Oligomer
ccagggcuuugaguacaag

SEQ ID NO: 14353 - RNA, 19 nt, Artificial Sequence
  RNA Oligomer
guccugcucaucauccaug

SEQ ID NO: 14354 - RNA, 19 nt, Artificial Sequence
  RNA Oligomer
ugugggccauguggugaau

SEQ ID NO: 14355 - RNA, 19 nt, Artificial Sequence
  RNA Oligomer
cgagagaaguuccaacgca

SEQ ID NO: 14356 - RNA, 19 nt, Artificial Sequence
  RNA Oligomer
gcaauggcuaccuguccuu

SEQ ID NO: 14357 - RNA, 19 nt, Artificial Sequence
  RNA Oligomer
cggcuccggaugagaaauu

SEQ ID NO: 14358 - RNA, 19 nt, Artificial Sequence
  RNA Oligomer
cguccuugaacaauuugug

SEQ ID NO: 14359 - RNA, 19 nt, Artificial Sequence
  RNA Oligomer
gcuggcaucuuagaacccu

SEQ ID NO: 14360 - RNA, 19 nt, Artificial Sequence
  RNA Oligomer
cuagggacuagagugagaa

SEQ ID NO: 14361 - RNA, 19 nt, Artificial Sequence
  RNA Oligomer
gccucagccuucucugauu

SEQ ID NO: 14362 - RNA, 19 nt, Artificial Sequence
  RNA Oligomer
aggccugucagcucaucaa

SEQ ID NO: 14363 - RNA, 19 nt, Artificial Sequence
  RNA Oligomer
ugagauccuucaucgagau

SEQ ID NO: 14364 - RNA, 19 nt, Artificial Sequence
  RNA Oligomer
ggccucauuuccaaggaug

SEQ ID NO: 14365 - RNA, 19 nt, Artificial Sequence
  RNA Oligomer
uggccucauuuccaaggau

SEQ ID NO: 14366 - RNA, 19 nt, Artificial Sequence
  RNA Oligomer
ggcuccggaugagaaauuu

SEQ ID NO: 14367 - RNA, 19 nt, Artificial Sequence
  RNA Oligomer
aagaaggagauugaagaaa

SEQ ID NO: 14368 - RNA, 19 nt, Artificial Sequence
  RNA Oligomer
ucguccuugaacaauuugu

SEQ ID NO: 14369 - RNA, 19 nt, Artificial Sequence
  RNA Oligomer
ccauguguugguugaagau

SEQ ID NO: 14370 - RNA, 19 nt, Artificial Sequence
  RNA Oligomer
ugagcacccaagccuacaa

SEQ ID NO: 14371 - RNA, 19 nt, Artificial Sequence
  RNA Oligomer
cccaauaccuauguaugca

SEQ ID NO: 14372 - RNA, 19 nt, Artificial Sequence
  RNA Oligomer
acccauggcaagccauuua

SEQ ID NO: 14373 - RNA, 19 nt, Artificial Sequence
  RNA Oligomer
cuaugcagauggcguguac

SEQ ID NO: 14374 - RNA, 19 nt, Artificial Sequence
  RNA Oligomer
cuggcaucuuagaacccuc

SEQ ID NO: 14375 - RNA, 19 nt, Artificial Sequence
  RNA Oligomer
ggugguacaacaaccucau

SEQ ID NO: 14376 - RNA, 19 nt, Artificial Sequence
  RNA Oligomer
cccaccauuaugagaacuu

SEQ ID NO: 14377 - RNA, 19 nt, Artificial Sequence
  RNA Oligomer
aguuugaggugucaguguu

SEQ ID NO: 14378 - RNA, 19 nt, Artificial Sequence
  RNA Oligomer
ugauggaccauuuggagag

SEQ ID NO: 14379 - RNA, 19 nt, Artificial Sequence
  RNA Oligomer
agggcuuugaguacaaguc

SEQ ID NO: 14380 - RNA, 19 nt, Artificial Sequence
  RNA Oligomer
acagcagccagcaucucuu

SEQ ID NO: 14381 - RNA, 19 nt, Artificial Sequence
  RNA Oligomer
ccugguggucuucaugaaa

SEQ ID NO: 14382 - RNA, 19 nt, Artificial Sequence
  RNA Oligomer
cuccacagaaggucaacuu

SEQ ID NO: 14383 - RNA, 19 nt, Artificial Sequence
  RNA Oligomer
uggaauggcaaggccacaa

SEQ ID NO: 14384 - RNA, 19 nt, Artificial Sequence
  RNA Oligomer
ggucgcuguuaucaacauu

SEQ ID NO: 14385 - RNA, 19 nt, Artificial Sequence
  RNA Oligomer
ggagauugaagaaauccga

SEQ ID NO: 14386 - RNA, 19 nt, Artificial Sequence
  RNA Oligomer
ucagcaccaucguccuuga

SEQ ID NO: 14387 - RNA, 19 nt, Artificial Sequence
  RNA Oligomer
aggaccauguguugguuga

SEQ ID NO: 14388 - RNA, 19 nt, Artificial Sequence
  RNA Oligomer
ccagcaucuccucagaguu

SEQ ID NO: 14389 - RNA, 19 nt, Artificial Sequence
  RNA Oligomer
cuggcccaauaccuaugua

SEQ ID NO: 14390 - RNA, 19 nt, Artificial Sequence
  RNA Oligomer
gaccuuagcaacaccaucu

SEQ ID NO: 14391 - RNA, 19 nt, Artificial Sequence
  RNA Oligomer
acuaauuucacccaagguu

SEQ ID NO: 14392 - RNA, 19 nt, Artificial Sequence
  RNA Oligomer
cccauggcaagccauuuac

SEQ ID NO: 14393 - RNA, 19 nt, Artificial Sequence
  RNA Oligomer
ccucagccuucucugauuu

SEQ ID NO: 14394 - RNA, 19 nt, Artificial Sequence
  RNA Oligomer
cccguuuccacaucuucuu

SEQ ID NO: 14395 - RNA, 19 nt, Artificial Sequence
  RNA Oligomer
gcgagaaaccuuccucaac

SEQ ID NO: 14396 - RNA, 19 nt, Artificial Sequence
  RNA Oligomer
ggaagauuuucacuucaug

SEQ ID NO: 14397 - RNA, 19 nt, Artificial Sequence
  RNA Oligomer
ccaacaacugccuguccaa

SEQ ID NO: 14398 - RNA, 19 nt, Artificial Sequence
  RNA Oligomer
ccaaggaugaguucaucag

SEQ ID NO: 14399 - RNA, 19 nt, Artificial Sequence
  RNA Oligomer
acgugcuggucgcuguuau

SEQ ID NO: 14400 - RNA, 19 nt, Artificial Sequence
  RNA Oligomer
cuuagcaacaccaucucaa

SEQ ID NO: 14401 - RNA, 19 nt, Artificial Sequence
  RNA Oligomer
accuuagcaacaccaucuc

SEQ ID NO: 14402 - RNA, 19 nt, Artificial Sequence
  RNA Oligomer
agggacuagagugagaagu

SEQ ID NO: 14403 - RNA, 19 nt, Artificial Sequence
  RNA Oligomer
ucuguaagaagaucuacuu

SEQ ID NO: 14404 - RNA, 19 nt, Artificial Sequence
  RNA Oligomer
ccaggaguggcauaaguuu

SEQ ID NO: 14405 - RNA, 19 nt, Artificial Sequence
  RNA Oligomer
cggaagaagguggagauca

SEQ ID NO: 14406 - RNA, 19 nt, Artificial Sequence
  RNA Oligomer
gucuccauuuugggacauu

SEQ ID NO: 14407 - RNA, 19 nt, Artificial Sequence
  RNA Oligomer
cagcagccagcaucucuuu

SEQ ID NO: 14408 - RNA, 19 nt, Artificial Sequence
  RNA Oligomer
gccaggauaugaucugucc

SEQ ID NO: 14409 - RNA, 19 nt, Artificial Sequence
  RNA Oligomer
ggaugcugagauccuucau

SEQ ID NO: 14410 - RNA, 19 nt, Artificial Sequence
  RNA Oligomer
ggaauggccucauuuccaa

SEQ ID NO: 14411 - RNA, 19 nt, Artificial Sequence
  RNA Oligomer
ccaggacuuauccuggcua

SEQ ID NO: 14412 - RNA, 19 nt, Artificial Sequence
  RNA Oligomer
accauguguugguugaaga

SEQ ID NO: 14413 - RNA, 19 nt, Artificial Sequence
  RNA Oligomer
gaacucaagugucuccaga

SEQ ID NO: 14414 - RNA, 19 nt, Artificial Sequence
  RNA Oligomer
ucaaucggaacucaagugu

SEQ ID NO: 14415 - RNA, 19 nt, Artificial Sequence
  RNA Oligomer
agcacguucuuucaucaga

SEQ ID NO: 14416 - RNA, 19 nt, Artificial Sequence
  RNA Oligomer
acaacaaccucauggagca

SEQ ID NO: 14417 - RNA, 19 nt, Artificial Sequence
  RNA Oligomer
ucagaaacaaaucucagaa

SEQ ID NO: 14418 - RNA, 19 nt, Artificial Sequence
  RNA Oligomer
gggugguacaacaaccuca

SEQ ID NO: 14419 - RNA, 19 nt, Artificial Sequence
  RNA Oligomer
acaucugugagcggcacuu

SEQ ID NO: 14420 - RNA, 19 nt, Artificial Sequence
  RNA Oligomer
cgagaaaccuuccucaacc

SEQ ID NO: 14421 - RNA, 19 nt, Artificial Sequence
  RNA Oligomer
ugcgagaaaccuuccucaa

SEQ ID NO: 14422 - RNA, 19 nt, Artificial Sequence
  RNA Oligomer
ucaucaccuuccugcgaga

SEQ ID NO: 14423 - RNA, 19 nt, Artificial Sequence
  RNA Oligomer
ucauguucuccuacaucuu

SEQ ID NO: 14424 - RNA, 19 nt, Artificial Sequence
  RNA Oligomer
ggucuccauuuugggacau

SEQ ID NO: 14425 - RNA, 19 nt, Artificial Sequence
  RNA Oligomer
agcgcuucauugagaacua

SEQ ID NO: 14426 - RNA, 19 nt, Artificial Sequence
  RNA Oligomer
caaggaguaugaccuggug

SEQ ID NO: 14427 - RNA, 19 nt, Artificial Sequence
  RNA Oligomer
cacagaaggucaacuucgu

SEQ ID NO: 14428 - RNA, 19 nt, Artificial Sequence
  RNA Oligomer
aggcauggaagcuuuggaa

SEQ ID NO: 14429 - RNA, 19 nt, Artificial Sequence
  RNA Oligomer
gguuugagaacaccaggaa

SEQ ID NO: 14430 - RNA, 19 nt, Artificial Sequence
  RNA Oligomer
cgcuacugguuugagaaca

SEQ ID NO: 14431 - RNA, 19 nt, Artificial Sequence
  RNA Oligomer
accaucguccuugaacaau

SEQ ID NO: 14432 - RNA, 19 nt, Artificial Sequence
  RNA Oligomer
caccaucguccuugaacaa

SEQ ID NO: 14433 - RNA, 19 nt, Artificial Sequence
  RNA Oligomer
ccuguacaaccaggacuua

SEQ ID NO: 14434 - RNA, 19 nt, Artificial Sequence
  RNA Oligomer
cugggcuugucucccauua

SEQ ID NO: 14435 - RNA, 19 nt, Artificial Sequence
  RNA Oligomer
gaccauguguugguugaag

SEQ ID NO: 14436 - RNA, 19 nt, Artificial Sequence
  RNA Oligomer
agaggaccauguguugguu

SEQ ID NO: 14437 - RNA, 19 nt, Artificial Sequence
  RNA Oligomer
ugcugaagauguggaugca

SEQ ID NO: 14438 - RNA, 19 nt, Artificial Sequence
  RNA Oligomer
agaaaacacucccggagua

SEQ ID NO: 14439 - RNA, 19 nt, Artificial Sequence
  RNA Oligomer
ccuggcccaauaccuaugu

SEQ ID NO: 14440 - RNA, 19 nt, Artificial Sequence
  RNA Oligomer
agacuucagaaacaaaucu

SEQ ID NO: 14441 - RNA, 19 nt, Artificial Sequence
  RNA Oligomer
ccauagucagucaccaugu

SEQ ID NO: 14442 - RNA, 19 nt, Artificial Sequence
  RNA Oligomer
gccauagucagucaccaug

SEQ ID NO: 14443 - RNA, 19 nt, Artificial Sequence
  RNA Oligomer
ggccauagucagucaccau

SEQ ID NO: 14444 - RNA, 19 nt, Artificial Sequence
  RNA Oligomer
cccuuugagcccuucuuca

SEQ ID NO: 14445 - RNA, 19 nt, Artificial Sequence
  RNA Oligomer
cuaugcuguacaucuguga

SEQ ID NO: 14446 - RNA, 19 nt, Artificial Sequence
  RNA Oligomer
agcugccaaguguucugua

SEQ ID NO: 14447 - RNA, 19 nt, Artificial Sequence
  RNA Oligomer
cccagaaguauuacuggug

SEQ ID NO: 14448 - RNA, 19 nt, Artificial Sequence
  RNA Oligomer
ggacauucuaaucccugag

SEQ ID NO: 14449 - RNA, 19 nt, Artificial Sequence
  RNA Oligomer
uccauuuugggacauucua

SEQ ID NO: 14450 - RNA, 19 nt, Artificial Sequence
  RNA Oligomer
gccuacuacuacgccuuug

SEQ ID NO: 14451 - RNA, 19 nt, Artificial Sequence
  RNA Oligomer
ggccuacuacuacgccuuu

SEQ ID NO: 14452 - RNA, 19 nt, Artificial Sequence
  RNA Oligomer
agccaggauaugaucuguc

SEQ ID NO: 14453 - RNA, 19 nt, Artificial Sequence
  RNA Oligomer
ugccugaagucaucaagga

SEQ ID NO: 14454 - RNA, 19 nt, Artificial Sequence
  RNA Oligomer
cgccuuauguuccgcaugu

SEQ ID NO: 14455 - RNA, 19 nt, Artificial Sequence
  RNA Oligomer
ccaaggaguaugaccuggu

SEQ ID NO: 14456 - RNA, 19 nt, Artificial Sequence
  RNA Oligomer
agccuccacagaaggucaa

SEQ ID NO: 14457 - RNA, 19 nt, Artificial Sequence
  RNA Oligomer
gcucagugccuggauuguu

SEQ ID NO: 14458 - RNA, 19 nt, Artificial Sequence
  RNA Oligomer
gucgcuguuaucaacauug

SEQ ID NO: 14459 - RNA, 19 nt, Artificial Sequence
  RNA Oligomer
agauugaagaaauccgaaa

SEQ ID NO: 14460 - RNA, 19 nt, Artificial Sequence
  RNA Oligomer
gagcacccaagccuacaaa

SEQ ID NO: 14461 - RNA, 19 nt, Artificial Sequence
  RNA Oligomer
cggaacucaagugucucca

SEQ ID NO: 14462 - RNA, 19 nt, Artificial Sequence
  RNA Oligomer
accagaacaucgcugugua

SEQ ID NO: 14463 - RNA, 19 nt, Artificial Sequence
  RNA Oligomer
gcccaauaccuauguaugc

SEQ ID NO: 14464 - RNA, 19 nt, Artificial Sequence
  RNA Oligomer
cguucuuucaucagacccu

SEQ ID NO: 14465 - RNA, 19 nt, Artificial Sequence
  RNA Oligomer
caucuuagaacccucccua

SEQ ID NO: 14466 - RNA, 19 nt, Artificial Sequence
  RNA Oligomer
ccugucagcucaucaacag

SEQ ID NO: 14467 - RNA, 19 nt, Artificial Sequence
  RNA Oligomer
ugaccaagaauguggaaaa

SEQ ID NO: 14468 - RNA, 19 nt, Artificial Sequence
  RNA Oligomer
ucaaagaccuggucuucaa

SEQ ID NO: 14469 - RNA, 19 nt, Artificial Sequence
  RNA Oligomer
ggcucuagcauggacacuu

SEQ ID NO: 14470 - RNA, 19 nt, Artificial Sequence
  RNA Oligomer
gcuguaccuugauggacca

SEQ ID NO: 14471 - RNA, 19 nt, Artificial Sequence
  RNA Oligomer
gggacauucuaaucccuga

SEQ ID NO: 14472 - RNA, 19 nt, Artificial Sequence
  RNA Oligomer
cuuucauguucuccuacau

SEQ ID NO: 14473 - RNA, 19 nt, Artificial Sequence
  RNA Oligomer
gcgcuucauugagaacuac

SEQ ID NO: 14474 - RNA, 19 nt, Artificial Sequence
  RNA Oligomer
gggucuccauuuugggaca

SEQ ID NO: 14475 - RNA, 19 nt, Artificial Sequence
  RNA Oligomer
ugcaacaguucaagcgcuu

SEQ ID NO: 14476 - RNA, 19 nt, Artificial Sequence
  RNA Oligomer
caggauaugaucugucccu

SEQ ID NO: 14477 - RNA, 19 nt, Artificial Sequence
  RNA Oligomer
acaucagccaggauaugau

SEQ ID NO: 14478 - RNA, 19 nt, Artificial Sequence
  RNA Oligomer
acaauagcgagcuccgcuu

SEQ ID NO: 14479 - RNA, 19 nt, Artificial Sequence
  RNA Oligomer
ccgcauguacgacuuugau

SEQ ID NO: 14480 - RNA, 19 nt, Artificial Sequence
  RNA Oligomer
gaaaggcucuccugaggaa

SEQ ID NO: 14481 - RNA, 19 nt, Artificial Sequence
  RNA Oligomer
gcaucuccucagaguucgu

SEQ ID NO: 14482 - RNA, 19 nt, Artificial Sequence
  RNA Oligomer
ggaguauacaggauaccgg

SEQ ID NO: 14483 - RNA, 19 nt, Artificial Sequence
  RNA Oligomer
cccggaguauacaggauac

SEQ ID NO: 14484 - RNA, 19 nt, Artificial Sequence
  RNA Oligomer
ccaucuaugguuccucgca

SEQ ID NO: 14485 - RNA, 19 nt, Artificial Sequence
  RNA Oligomer
cgccgaguuccucaacauu

SEQ ID NO: 14486 - RNA, 19 nt, Artificial Sequence
  RNA Oligomer
agucucccuuccaaauaaa

SEQ ID NO: 14487 - RNA, 19 nt, Artificial Sequence
  RNA Oligomer
uggcccaauaccuauguau

SEQ ID NO: 14488 - RNA, 19 nt, Artificial Sequence
  RNA Oligomer
cacccaagguuuuaagcac

SEQ ID NO: 14489 - RNA, 19 nt, Artificial Sequence
  RNA Oligomer
uggcaagccauuuacagaa

SEQ ID NO: 14490 - RNA, 19 nt, Artificial Sequence
  RNA Oligomer
cagaaacaaaucucagaag

SEQ ID NO: 14491 - RNA, 19 nt, Artificial Sequence
  RNA Oligomer
aaccucugcuuccagacuu

SEQ ID NO: 14492 - RNA, 19 nt, Artificial Sequence
  RNA Oligomer
ucccaaccuuguuccaggu

SEQ ID NO: 14493 - RNA, 19 nt, Artificial Sequence
  RNA Oligomer
gccugucagcucaucaaca

SEQ ID NO: 14494 - RNA, 19 nt, Artificial Sequence
  RNA Oligomer
ggcacuuccagaagguucu

SEQ ID NO: 14495 - RNA, 19 nt, Artificial Sequence
  RNA Oligomer
uggugucugugcacaucua

SEQ ID NO: 14496 - RNA, 19 nt, Artificial Sequence
  RNA Oligomer
cccaaagcuguaccuugau

SEQ ID NO: 14497 - RNA, 19 nt, Artificial Sequence
  RNA Oligomer
acacgcuuagccugcacau

SEQ ID NO: 14498 - RNA, 19 nt, Artificial Sequence
  RNA Oligomer
augguagcuuugcccugau

SEQ ID NO: 14499 - RNA, 19 nt, Artificial Sequence
  RNA Oligomer
ccagaaguauuacuggugg

SEQ ID NO: 14500 - RNA, 19 nt, Artificial Sequence
  RNA Oligomer
ggccauguggugaaugugu

SEQ ID NO: 14501 - RNA, 19 nt, Artificial Sequence
  RNA Oligomer
ugggccauguggugaaugu

SEQ ID NO: 14502 - RNA, 19 nt, Artificial Sequence
  RNA Oligomer
uggacuuccaucgccucau

SEQ ID NO: 14503 - RNA, 19 nt, Artificial Sequence
  RNA Oligomer
accagacggugcaacaguu

SEQ ID NO: 14504 - RNA, 19 nt, Artificial Sequence
  RNA Oligomer
ugggaagauuuucacuuca

SEQ ID NO: 14505 - RNA, 19 nt, Artificial Sequence
  RNA Oligomer
ucaggaugcugagauccuu

SEQ ID NO: 14506 - RNA, 19 nt, Artificial Sequence
  RNA Oligomer
ggagaccuuuuucaggcac

SEQ ID NO: 14507 - RNA, 19 nt, Artificial Sequence
  RNA Oligomer
ugggaggcauggaagcuuu

SEQ ID NO: 14508 - RNA, 19 nt, Artificial Sequence
  RNA Oligomer
cccaaugucuuugucuggc

SEQ ID NO: 14509 - RNA, 19 nt, Artificial Sequence
  RNA Oligomer
uggucgcuguuaucaacau

SEQ ID NO: 14510 - RNA, 19 nt, Artificial Sequence
  RNA Oligomer
gaaggagauugaagaaauc

SEQ ID NO: 14511 - RNA, 19 nt, Artificial Sequence
  RNA Oligomer
ccgcuacugguuugagaac

SEQ ID NO: 14512 - RNA, 19 nt, Artificial Sequence
  RNA Oligomer
cagcaccaucguccuugaa

SEQ ID NO: 14513 - RNA, 19 nt, Artificial Sequence
  RNA Oligomer
cuguacaaccaggacuuau

SEQ ID NO: 14514 - RNA, 19 nt, Artificial Sequence
  RNA Oligomer
agauguggaugcacugcug

SEQ ID NO: 14515 - RNA, 19 nt, Artificial Sequence
  RNA Oligomer
cccaagccuacaaagugcu

SEQ ID NO: 14516 - RNA, 19 nt, Artificial Sequence
  RNA Oligomer
gcacccaagccuacaaagu

SEQ ID NO: 14517 - RNA, 19 nt, Artificial Sequence
  RNA Oligomer
ggaacucaagugucuccag

SEQ ID NO: 14518 - RNA, 19 nt, Artificial Sequence
  RNA Oligomer
ccgaguuccucaacauucg

SEQ ID NO: 14519 - RNA, 19 nt, Artificial Sequence
  RNA Oligomer
gagaccuuagcaacaccau

SEQ ID NO: 14520 - RNA, 19 nt, Artificial Sequence
  RNA Oligomer
accucauggagcacagaug

SEQ ID NO: 14521 - RNA, 19 nt, Artificial Sequence
  RNA Oligomer
gacuucagaaacaaaucuc

SEQ ID NO: 14522 - RNA, 19 nt, Artificial Sequence
  RNA Oligomer
accucugcuuccagacuuc

SEQ ID NO: 14523 - RNA, 19 nt, Artificial Sequence
  RNA Oligomer
cucccaccauuaugagaac

SEQ ID NO: 14524 - RNA, 19 nt, Artificial Sequence
  RNA Oligomer
gucagcucaucaacaggca

SEQ ID NO: 14525 - RNA, 19 nt, Artificial Sequence
  RNA Oligomer
gaaaaggccugucagcuca

SEQ ID NO: 14526 - RNA, 19 nt, Artificial Sequence
  RNA Oligomer
agaaugaccaccaggaccu

SEQ ID NO: 14527 - RNA, 19 nt, Artificial Sequence
  RNA Oligomer
gaccuggucuucaagucau

SEQ ID NO: 14528 - RNA, 19 nt, Artificial Sequence
  RNA Oligomer
ccuccauccucaaagaccu

SEQ ID NO: 14529 - RNA, 19 nt, Artificial Sequence
  RNA Oligomer
ccuugauggaccauuugga

SEQ ID NO: 14530 - RNA, 19 nt, Artificial Sequence
  RNA Oligomer
cagaaguauuacugguggu

SEQ ID NO: 14531 - RNA, 19 nt, Artificial Sequence
  RNA Oligomer
ucacagucuuacacagugu

SEQ ID NO: 14532 - RNA, 19 nt, Artificial Sequence
  RNA Oligomer
cuccauuuugggacauucu

SEQ ID NO: 14533 - RNA, 19 nt, Artificial Sequence
  RNA Oligomer
gaaguuccaacgcagcugu

SEQ ID NO: 14534 - RNA, 19 nt, Artificial Sequence
  RNA Oligomer
aggauaugaucugucccuc

SEQ ID NO: 14535 - RNA, 19 nt, Artificial Sequence
  RNA Oligomer
uguuccgcauguacgacuu

SEQ ID NO: 14536 - RNA, 19 nt, Artificial Sequence
  RNA Oligomer
ggcugacaaggauggcaau

SEQ ID NO: 14537 - RNA, 19 nt, Artificial Sequence
  RNA Oligomer
ggcauggaagcuuuggaau

SEQ ID NO: 14538 - RNA, 19 nt, Artificial Sequence
  RNA Oligomer
agacagcucagcacugaag

SEQ ID NO: 14539 - RNA, 19 nt, Artificial Sequence
  RNA Oligomer
ucgcuguuaucaacauuga

SEQ ID NO: 14540 - RNA, 19 nt, Artificial Sequence
  RNA Oligomer
ccacugaaguuuucccgca

SEQ ID NO: 14541 - RNA, 19 nt, Artificial Sequence
  RNA Oligomer
gagaggaccauguguuggu

SEQ ID NO: 14542 - RNA, 19 nt, Artificial Sequence
  RNA Oligomer
gucuacaugagaaaugcca

SEQ ID NO: 14543 - RNA, 19 nt, Artificial Sequence
  RNA Oligomer
gcuuccugcagaaaacacu

SEQ ID NO: 14544 - RNA, 19 nt, Artificial Sequence
  RNA Oligomer
ccagaacaucgcuguguau

SEQ ID NO: 14545 - RNA, 19 nt, Artificial Sequence
  RNA Oligomer
gccgaguuccucaacauuc

SEQ ID NO: 14546 - RNA, 19 nt, Artificial Sequence
  RNA Oligomer
caguagucucccuuccaaa

SEQ ID NO: 14547 - RNA, 19 nt, Artificial Sequence
  RNA Oligomer
ugcuccaguagucucccuu

SEQ ID NO: 14548 - RNA, 19 nt, Artificial Sequence
  RNA Oligomer
ggcccaauaccuauguaug

SEQ ID NO: 14549 - RNA, 19 nt, Artificial Sequence
  RNA Oligomer
acaaaucucagaagacaag

SEQ ID NO: 14550 - RNA, 19 nt, Artificial Sequence
  RNA Oligomer
ugcuuccagacuucagaaa

SEQ ID NO: 14551 - RNA, 19 nt, Artificial Sequence
  RNA Oligomer
gguacaacaaccucaugga

SEQ ID NO: 14552 - RNA, 19 nt, Artificial Sequence
  RNA Oligomer
gucucagccuggagaaaug

SEQ ID NO: 14553 - RNA, 19 nt, Artificial Sequence
  RNA Oligomer
uccucaaagaccuggucuu

SEQ ID NO: 14554 - RNA, 19 nt, Artificial Sequence
  RNA Oligomer
accaggaguggcauaaguu

SEQ ID NO: 14555 - RNA, 19 nt, Artificial Sequence
  RNA Oligomer
ggugacagaugugccagau

SEQ ID NO: 14556 - RNA, 19 nt, Artificial Sequence
  RNA Oligomer
ucaccuuccugcgagaaac

SEQ ID NO: 14557 - RNA, 19 nt, Artificial Sequence
  RNA Oligomer
gugcaacaguucaagcgcu

SEQ ID NO: 14558 - RNA, 19 nt, Artificial Sequence
  RNA Oligomer
aggugccugaagucaucaa

SEQ ID NO: 14559 - RNA, 19 nt, Artificial Sequence
  RNA Oligomer
cugagauccuucaucgaga

SEQ ID NO: 14560 - RNA, 19 nt, Artificial Sequence
  RNA Oligomer
aggaugcugagauccuuca

SEQ ID NO: 14561 - RNA, 19 nt, Artificial Sequence
  RNA Oligomer
gccucauuuccaaggauga

SEQ ID NO: 14562 - RNA, 19 nt, Artificial Sequence
  RNA Oligomer
ugaugggaauggccucauu

SEQ ID NO: 14563 - RNA, 19 nt, Artificial Sequence
  RNA Oligomer
cucgccuuauguuccgcau

SEQ ID NO: 14564 - RNA, 19 nt, Artificial Sequence
  RNA Oligomer
ugaggaaaagucucgccuu

SEQ ID NO: 14565 - RNA, 19 nt, Artificial Sequence
  RNA Oligomer
cccaggacauguuugugga

SEQ ID NO: 14566 - RNA, 19 nt, Artificial Sequence
  RNA Oligomer
ucaggcaccuuuucuccca

SEQ ID NO: 14567 - RNA, 19 nt, Artificial Sequence
  RNA Oligomer
gaggcauggaagcuuugga

SEQ ID NO: 14568 - RNA, 19 nt, Artificial Sequence
  RNA Oligomer
gcaucgugucugagaagcu

SEQ ID NO: 14569 - RNA, 19 nt, Artificial Sequence
  RNA Oligomer
ugguuugagaacaccagga

SEQ ID NO: 14570 - RNA, 19 nt, Artificial Sequence
  RNA Oligomer
accgcuacugguuugagaa

SEQ ID NO: 14571 - RNA, 19 nt, Artificial Sequence
  RNA Oligomer
acugaaguuuucccgcaca

SEQ ID NO: 14572 - RNA, 19 nt, Artificial Sequence
  RNA Oligomer
agcaguuccuguccaccau

SEQ ID NO: 14573 - RNA, 19 nt, Artificial Sequence
  RNA Oligomer
ccggaguauacaggauacc

SEQ ID NO: 14574 - RNA, 19 nt, Artificial Sequence
  RNA Oligomer
ucccggaguauacaggaua

SEQ ID NO: 14575 - RNA, 19 nt, Artificial Sequence
  RNA Oligomer
gaaaacacucccggaguau

SEQ ID NO: 14576 - RNA, 19 nt, Artificial Sequence
  RNA Oligomer
cuuuggcuaucacgugcuu

SEQ ID NO: 14577 - RNA, 19 nt, Artificial Sequence
  RNA Oligomer
gacaagcugaccugacaag

SEQ ID NO: 14578 - RNA, 19 nt, Artificial Sequence
  RNA Oligomer
ucccaccauuaugagaacu

SEQ ID NO: 14579 - RNA, 19 nt, Artificial Sequence
  RNA Oligomer
ucucccaccauuaugagaa

SEQ ID NO: 14580 - RNA, 19 nt, Artificial Sequence
  RNA Oligomer
ucaggaccacuaugcugua

SEQ ID NO: 14581 - RNA, 19 nt, Artificial Sequence
  RNA Oligomer
ucgaccucaggaccacuau

SEQ ID NO: 14582 - RNA, 19 nt, Artificial Sequence
  RNA Oligomer
accuggugucugugcacau

SEQ ID NO: 14583 - RNA, 19 nt, Artificial Sequence
  RNA Oligomer
agcgucaguuugaguggcu

SEQ ID NO: 14584 - RNA, 19 nt, Artificial Sequence
  RNA Oligomer
ucagccaggauaugaucug

SEQ ID NO: 14585 - RNA, 19 nt, Artificial Sequence
  RNA Oligomer
uccuacaucagccaggaua

SEQ ID NO: 14586 - RNA, 19 nt, Artificial Sequence
  RNA Oligomer
agucgggauuccaggacaa

SEQ ID NO: 14587 - RNA, 19 nt, Artificial Sequence
  RNA Oligomer
ucaucaggaugcugagauc

SEQ ID NO: 14588 - RNA, 19 nt, Artificial Sequence
  RNA Oligomer
uccgcauguacgacuuuga

SEQ ID NO: 14589 - RNA, 19 nt, Artificial Sequence
  RNA Oligomer
uggacauccugguggucuu

SEQ ID NO: 14590 - RNA, 19 nt, Artificial Sequence
  RNA Oligomer
ggacauguuuguggagucc

SEQ ID NO: 14591 - RNA, 19 nt, Artificial Sequence
  RNA Oligomer
cgcuguuaucaacauugac

SEQ ID NO: 14592 - RNA, 19 nt, Artificial Sequence
  RNA Oligomer
acaccaggaaugggcuguu

SEQ ID NO: 14593 - RNA, 19 nt, Artificial Sequence
  RNA Oligomer
caggacuuauccuggcuag

SEQ ID NO: 14594 - RNA, 19 nt, Artificial Sequence
  RNA Oligomer
aggacaucaacccugcacu

SEQ ID NO: 14595 - RNA, 19 nt, Artificial Sequence
  RNA Oligomer
auacaggauaccggccauu

SEQ ID NO: 14596 - RNA, 19 nt, Artificial Sequence
  RNA Oligomer
guauacaggauaccggcca

SEQ ID NO: 14597 - RNA, 19 nt, Artificial Sequence
  RNA Oligomer
cuuccagacuucagaaaca

SEQ ID NO: 14598 - RNA, 19 nt, Artificial Sequence
  RNA Oligomer
uggccauagucagucacca

SEQ ID NO: 14599 - RNA, 19 nt, Artificial Sequence
  RNA Oligomer
cccaguugagcagagguuu

SEQ ID NO: 14600 - RNA, 19 nt, Artificial Sequence
  RNA Oligomer
gaccaagaauguggaaaag

SEQ ID NO: 14601 - RNA, 19 nt, Artificial Sequence
  RNA Oligomer
agaagguucugaaccggag

SEQ ID NO: 14602 - RNA, 19 nt, Artificial Sequence
  RNA Oligomer
agaucuacuucaucugggu

SEQ ID NO: 14603 - RNA, 19 nt, Artificial Sequence
  RNA Oligomer
uguaccuugauggaccauu

SEQ ID NO: 14604 - RNA, 19 nt, Artificial Sequence
  RNA Oligomer
ugguagcuuugcccugauc

SEQ ID NO: 14605 - RNA, 19 nt, Artificial Sequence
  RNA Oligomer
ccaugaugaugggucugag

SEQ ID NO: 14606 - RNA, 19 nt, Artificial Sequence
  RNA Oligomer
gccucuuccaugaugaugg

SEQ ID NO: 14607 - RNA, 19 nt, Artificial Sequence
  RNA Oligomer
uggccucuuccaugaugau

SEQ ID NO: 14608 - RNA, 19 nt, Artificial Sequence
  RNA Oligomer
cuggccucuuccaugauga

SEQ ID NO: 14609 - RNA, 19 nt, Artificial Sequence
  RNA Oligomer
agauccccaaggaguauga

SEQ ID NO: 14610 - RNA, 19 nt, Artificial Sequence
  RNA Oligomer
uugccuccauccucaaaga

SEQ ID NO: 14611 - RNA, 19 nt, Artificial Sequence
  RNA Oligomer
accgagagaaguuccaacg

SEQ ID NO: 14612 - RNA, 19 nt, Artificial Sequence
  RNA Oligomer
uugggugaaauuaguugug

SEQ ID NO: 14613 - RNA, 19 nt, Artificial Sequence
  RNA Oligomer
cuugggugaaauuaguugu

SEQ ID NO: 14614 - RNA, 19 nt, Artificial Sequence
  RNA Oligomer
aacgugcuuaaaaccuugg

SEQ ID NO: 14615 - RNA, 19 nt, Artificial Sequence
  RNA Oligomer
auuuguuucugaagucugg

SEQ ID NO: 14616 - RNA, 19 nt, Artificial Sequence
  RNA Oligomer
gagaacaugaaagagaugc

SEQ ID NO: 14617 - RNA, 19 nt, Artificial Sequence
  RNA Oligomer
uuagaaugucccaaaaugg

SEQ ID NO: 14618 - RNA, 19 nt, Artificial Sequence
  RNA Oligomer
gaguuccgauugaugaccc

SEQ ID NO: 14619 - RNA, 19 nt, Artificial Sequence
  RNA Oligomer
agggaggguucuaagaugc

SEQ ID NO: 14620 - RNA, 19 nt, Artificial Sequence
  RNA Oligomer
caugaugaaaauaauaggg

SEQ ID NO: 14621 - RNA, 19 nt, Artificial Sequence
  RNA Oligomer
uagccgcacaaauuguuca

SEQ ID NO: 14622 - RNA, 19 nt, Artificial Sequence
  RNA Oligomer
acgugcuuaaaaccuuggg

SEQ ID NO: 14623 - RNA, 19 nt, Artificial Sequence
  RNA Oligomer
ccuugggugaaauuaguug

SEQ ID NO: 14624 - RNA, 19 nt, Artificial Sequence
  RNA Oligomer
uuggaacuucucucggugc

SEQ ID NO: 14625 - RNA, 19 nt, Artificial Sequence
  RNA Oligomer
uacaugcggaacauaaggc

SEQ ID NO: 14626 - RNA, 19 nt, Artificial Sequence
  RNA Oligomer
ugccagacaaagacauugg

SEQ ID NO: 14627 - RNA, 19 nt, Artificial Sequence
  RNA Oligomer
uugaguuccgauugaugac

SEQ ID NO: 14628 - RNA, 19 nt, Artificial Sequence
  RNA Oligomer
ugguguugcuaaggucucg

SEQ ID NO: 14629 - RNA, 19 nt, Artificial Sequence
  RNA Oligomer
uagaaguucucauaauggu

SEQ ID NO: 14630 - RNA, 19 nt, Artificial Sequence
  RNA Oligomer
aaaugguccaucaagguac

SEQ ID NO: 14631 - RNA, 19 nt, Artificial Sequence
  RNA Oligomer
aagacugugaggacgaugg

SEQ ID NO: 14632 - RNA, 19 nt, Artificial Sequence
  RNA Oligomer
uaggagaacaugaaagaga

SEQ ID NO: 14633 - RNA, 19 nt, Artificial Sequence
  RNA Oligomer
augaaagagaugcuggcug

SEQ ID NO: 14634 - RNA, 19 nt, Artificial Sequence
  RNA Oligomer
aaagggaagcaacagaggg

SEQ ID NO: 14635 - RNA, 19 nt, Artificial Sequence
  RNA Oligomer
aagggaagcaacagagggu

SEQ ID NO: 14636 - RNA, 19 nt, Artificial Sequence
  RNA Oligomer
gacaaagacauugggcugc

SEQ ID NO: 14637 - RNA, 19 nt, Artificial Sequence
  RNA Oligomer
gaaguucucauaauggugg

SEQ ID NO: 14638 - RNA, 19 nt, Artificial Sequence
  RNA Oligomer
uucuuacagaacacuuggc

SEQ ID NO: 14639 - RNA, 19 nt, Artificial Sequence
  RNA Oligomer
gacaccucaaacuuaugcc

SEQ ID NO: 14640 - RNA, 19 nt, Artificial Sequence
  RNA Oligomer
cucaaacuuaugccacucc

SEQ ID NO: 14641 - RNA, 19 nt, Artificial Sequence
  RNA Oligomer
aaagacauacaugauggcc

SEQ ID NO: 14642 - RNA, 19 nt, Artificial Sequence
  RNA Oligomer
aaccaccaguaauacuucu

SEQ ID NO: 14643 - RNA, 19 nt, Artificial Sequence
  RNA Oligomer
uagcgguugaggaagguuu

SEQ ID NO: 14644 - RNA, 19 nt, Artificial Sequence
  RNA Oligomer
aacacaugguccucucgcu

SEQ ID NO: 14645 - RNA, 19 nt, Artificial Sequence
  RNA Oligomer
aagaacgugcuuaaaaccu

SEQ ID NO: 14646 - RNA, 19 nt, Artificial Sequence
  RNA Oligomer
auagaugauugcugggacc

SEQ ID NO: 14647 - RNA, 19 nt, Artificial Sequence
  RNA Oligomer
gugggaggcaaagacauac

SEQ ID NO: 14648 - RNA, 19 nt, Artificial Sequence
  RNA Oligomer
auuagaaugucccaaaaug

SEQ ID NO: 14649 - RNA, 19 nt, Artificial Sequence
  RNA Oligomer
cugcguuggaacuucucuc

SEQ ID NO: 14650 - RNA, 19 nt, Artificial Sequence
  RNA Oligomer
aacucagucucaaugucgc

SEQ ID NO: 14651 - RNA, 19 nt, Artificial Sequence
  RNA Oligomer
agagggacagaucauaucc

SEQ ID NO: 14652 - RNA, 19 nt, Artificial Sequence
  RNA Oligomer
uuggagaucucgaugaagg

SEQ ID NO: 14653 - RNA, 19 nt, Artificial Sequence
  RNA Oligomer
uucucagacacgaugcucu

SEQ ID NO: 14654 - RNA, 19 nt, Artificial Sequence
  RNA Oligomer
augccagacaaagacauug

SEQ ID NO: 14655 - RNA, 19 nt, Artificial Sequence
  RNA Oligomer
augcgaggaaccauagaug

SEQ ID NO: 14656 - RNA, 19 nt, Artificial Sequence
  RNA Oligomer
aaagaacgugcuuaaaacc

SEQ ID NO: 14657 - RNA, 19 nt, Artificial Sequence
  RNA Oligomer
gaacgugcuuaaaaccuug

SEQ ID NO: 14658 - RNA, 19 nt, Artificial Sequence
  RNA Oligomer
aauaggaagaacagaggug

SEQ ID NO: 14659 - RNA, 19 nt, Artificial Sequence
  RNA Oligomer
aggccugugaauagacucc

SEQ ID NO: 14660 - RNA, 19 nt, Artificial Sequence
  RNA Oligomer
cugacuuguacucaaagcc

SEQ ID NO: 14661 - RNA, 19 nt, Artificial Sequence
  RNA Oligomer
caaagacauacaugauggc

SEQ ID NO: 14662 - RNA, 19 nt, Artificial Sequence
  RNA Oligomer
auggugagcaagauguagg

SEQ ID NO: 14663 - RNA, 19 nt, Artificial Sequence
  RNA Oligomer
uugaacuguugcaccgucu

SEQ ID NO: 14664 - RNA, 19 nt, Artificial Sequence
  RNA Oligomer
auggacuccacaaacaugu

SEQ ID NO: 14665 - RNA, 19 nt, Artificial Sequence
  RNA Oligomer
cucuugaaauuucucaucc

SEQ ID NO: 14666 - RNA, 19 nt, Artificial Sequence
  RNA Oligomer
cuuuaugccagacaaagac

SEQ ID NO: 14667 - RNA, 19 nt, Artificial Sequence
  RNA Oligomer
guguucucaaaccaguagc

SEQ ID NO: 14668 - RNA, 19 nt, Artificial Sequence
  RNA Oligomer
aguacagugucauugcucc

SEQ ID NO: 14669 - RNA, 19 nt, Artificial Sequence
  RNA Oligomer
aucuucagcacuuuguagg

SEQ ID NO: 14670 - RNA, 19 nt, Artificial Sequence
  RNA Oligomer
aaugcgaggaaccauagau

SEQ ID NO: 14671 - RNA, 19 nt, Artificial Sequence
  RNA Oligomer
cuagaaguucucauaaugg

SEQ ID NO: 14672 - RNA, 19 nt, Artificial Sequence
  RNA Oligomer
ucaaacuuaugccacuccu

SEQ ID NO: 14673 - RNA, 19 nt, Artificial Sequence
  RNA Oligomer
gcaaagacauacaugaugg

SEQ ID NO: 14674 - RNA, 19 nt, Artificial Sequence
  RNA Oligomer
aagacauacaugauggcca

SEQ ID NO: 14675 - RNA, 19 nt, Artificial Sequence
  RNA Oligomer
gaaagaggcaagagaggac

SEQ ID NO: 14676 - RNA, 19 nt, Artificial Sequence
  RNA Oligomer
aaugaagcgcuugaacugu

SEQ ID NO: 14677 - RNA, 19 nt, Artificial Sequence
  RNA Oligomer
uuaaacagcagcaccaggu

SEQ ID NO: 14678 - RNA, 19 nt, Artificial Sequence
  RNA Oligomer
uugccauuccaaagcuucc

SEQ ID NO: 14679 - RNA, 19 nt, Artificial Sequence
  RNA Oligomer
cuugaaauuucucauccgg

SEQ ID NO: 14680 - RNA, 19 nt, Artificial Sequence
  RNA Oligomer
aaaauagucacgaacaaca

SEQ ID NO: 14681 - RNA, 19 nt, Artificial Sequence
  RNA Oligomer
auagucacgaacaacagag

SEQ ID NO: 14682 - RNA, 19 nt, Artificial Sequence
  RNA Oligomer
uagucacgaacaacagagg

SEQ ID NO: 14683 - RNA, 19 nt, Artificial Sequence
  RNA Oligomer
cagacaaagacauugggcu

SEQ ID NO: 14684 - RNA, 19 nt, Artificial Sequence
  RNA Oligomer
auuucggauuucuucaauc

SEQ ID NO: 14685 - RNA, 19 nt, Artificial Sequence
  RNA Oligomer
guagccgcacaaauuguuc

SEQ ID NO: 14686 - RNA, 19 nt, Artificial Sequence
  RNA Oligomer
cauuucucauguagacgcc

SEQ ID NO: 14687 - RNA, 19 nt, Artificial Sequence
  RNA Oligomer
uucucauguagacgccagg

SEQ ID NO: 14688 - RNA, 19 nt, Artificial Sequence
  RNA Oligomer
ugauagccaaagaagaccc

SEQ ID NO: 14689 - RNA, 19 nt, Artificial Sequence
  RNA Oligomer
auuuauuuggaagggagac

SEQ ID NO: 14690 - RNA, 19 nt, Artificial Sequence
  RNA Oligomer
gagcauugcauacauaggu

SEQ ID NO: 14691 - RNA, 19 nt, Artificial Sequence
  RNA Oligomer
aaauaggaagaacagaggu

SEQ ID NO: 14692 - RNA, 19 nt, Artificial Sequence
  RNA Oligomer
aucaaaucgcugcaccucc

SEQ ID NO: 14693 - RNA, 19 nt, Artificial Sequence
  RNA Oligomer
uagaucuucuuacagaaca

SEQ ID NO: 14694 - RNA, 19 nt, Artificial Sequence
  RNA Oligomer
cauagaugauugcugggac

SEQ ID NO: 14695 - RNA, 19 nt, Artificial Sequence
  RNA Oligomer
ccaugaugaaaauaauagg

SEQ ID NO: 14696 - RNA, 19 nt, Artificial Sequence
  RNA Oligomer
uguaggagaacaugaaaga

SEQ ID NO: 14697 - RNA, 19 nt, Artificial Sequence
  RNA Oligomer
ugaagcgcuugaacuguug

SEQ ID NO: 14698 - RNA, 19 nt, Artificial Sequence
  RNA Oligomer
aagggcuggaaugacguua

SEQ ID NO: 14699 - RNA, 19 nt, Artificial Sequence
  RNA Oligomer
aaguuaaacagcagcacca

SEQ ID NO: 14700 - RNA, 19 nt, Artificial Sequence
  RNA Oligomer
agccucuugaaauuucuca

SEQ ID NO: 14701 - RNA, 19 nt, Artificial Sequence
  RNA Oligomer
ucuugaaauuucucauccg

SEQ ID NO: 14702 - RNA, 19 nt, Artificial Sequence
  RNA Oligomer
aaauagucacgaacaacag

SEQ ID NO: 14703 - RNA, 19 nt, Artificial Sequence
  RNA Oligomer
uuucucauguagacgccag

SEQ ID NO: 14704 - RNA, 19 nt, Artificial Sequence
  RNA Oligomer
gguuucuguaaauggcuug

SEQ ID NO: 14705 - RNA, 19 nt, Artificial Sequence
  RNA Oligomer
uacacgccaucugcauagc

SEQ ID NO: 14706 - RNA, 19 nt, Artificial Sequence
  RNA Oligomer
uuuguuucugaagucugga

SEQ ID NO: 14707 - RNA, 19 nt, Artificial Sequence
  RNA Oligomer
uuguuucugaagucuggaa

SEQ ID NO: 14708 - RNA, 19 nt, Artificial Sequence
  RNA Oligomer
agaucuucuuacagaacac

SEQ ID NO: 14709 - RNA, 19 nt, Artificial Sequence
  RNA Oligomer
ucuucuuacagaacacuug

SEQ ID NO: 14710 - RNA, 19 nt, Artificial Sequence
  RNA Oligomer
acaccucaaacuuaugcca

SEQ ID NO: 14711 - RNA, 19 nt, Artificial Sequence
  RNA Oligomer
ugacuuguacucaaagccc

SEQ ID NO: 14712 - RNA, 19 nt, Artificial Sequence
  RNA Oligomer
cccaugaugaaaauaauag

SEQ ID NO: 14713 - RNA, 19 nt, Artificial Sequence
  RNA Oligomer
gaggcaaagacauacauga

SEQ ID NO: 14714 - RNA, 19 nt, Artificial Sequence
  RNA Oligomer
augaagcgcuugaacuguu

SEQ ID NO: 14715 - RNA, 19 nt, Artificial Sequence
  RNA Oligomer
agggcuggaaugacguuac

SEQ ID NO: 14716 - RNA, 19 nt, Artificial Sequence
  RNA Oligomer
augacguuaccuucuugcc

SEQ ID NO: 14717 - RNA, 19 nt, Artificial Sequence
  RNA Oligomer
gccauucccaucaaagucg

SEQ ID NO: 14718 - RNA, 19 nt, Artificial Sequence
  RNA Oligomer
auaaggcgagacuuuuccu

SEQ ID NO: 14719 - RNA, 19 nt, Artificial Sequence
  RNA Oligomer
uugccauccuugucagcca

SEQ ID NO: 14720 - RNA, 19 nt, Artificial Sequence
  RNA Oligomer
aacauggacuccacaaaca

SEQ ID NO: 14721 - RNA, 19 nt, Artificial Sequence
  RNA Oligomer
uuccuccaaguuaaacagc

SEQ ID NO: 14722 - RNA, 19 nt, Artificial Sequence
  RNA Oligomer
ugcccucaaaauagucacg

SEQ ID NO: 14723 - RNA, 19 nt, Artificial Sequence
  RNA Oligomer
uuuaugccagacaaagaca

SEQ ID NO: 14724 - RNA, 19 nt, Artificial Sequence
  RNA Oligomer
uuaugccagacaaagacau

SEQ ID NO: 14725 - RNA, 19 nt, Artificial Sequence
  RNA Oligomer
acaaagacauugggcugca

SEQ ID NO: 14726 - RNA, 19 nt, Artificial Sequence
  RNA Oligomer
gaaaacuucaguggcccag

SEQ ID NO: 14727 - RNA, 19 nt, Artificial Sequence
  RNA Oligomer
aaaacuucaguggcccagg

SEQ ID NO: 14728 - RNA, 19 nt, Artificial Sequence
  RNA Oligomer
gugauagccaaagaagacc

SEQ ID NO: 14729 - RNA, 19 nt, Artificial Sequence
  RNA Oligomer
aguggguuucuguaaaugg

SEQ ID NO: 14730 - RNA, 19 nt, Artificial Sequence
  RNA Oligomer
aauggugggagaagugagu

SEQ ID NO: 14731 - RNA, 19 nt, Artificial Sequence
  RNA Oligomer
guaccacccaucaaaucgc

SEQ ID NO: 14732 - RNA, 19 nt, Artificial Sequence
  RNA Oligomer
cuucuuacagaacacuugg

SEQ ID NO: 14733 - RNA, 19 nt, Artificial Sequence
  RNA Oligomer
uaccauggaugaugagcag

SEQ ID NO: 14734 - RNA, 19 nt, Artificial Sequence
  RNA Oligomer
uagagcaggauguagaggu

SEQ ID NO: 14735 - RNA, 19 nt, Artificial Sequence
  RNA Oligomer
uggugagcaagauguagga

SEQ ID NO: 14736 - RNA, 19 nt, Artificial Sequence
  RNA Oligomer
aacaugaaagagaugcugg

SEQ ID NO: 14737 - RNA, 19 nt, Artificial Sequence
  RNA Oligomer
uucucaaugaagcgcuuga

SEQ ID NO: 14738 - RNA, 19 nt, Artificial Sequence
  RNA Oligomer
gaagcgcuugaacuguugc

SEQ ID NO: 14739 - RNA, 19 nt, Artificial Sequence
  RNA Oligomer
caacucagucucaaugucg

SEQ ID NO: 14740 - RNA, 19 nt, Artificial Sequence
  RNA Oligomer
ugaaaaucuucccauguca

SEQ ID NO: 14741 - RNA, 19 nt, Artificial Sequence
  RNA Oligomer
aacucauccuuggaaauga

SEQ ID NO: 14742 - RNA, 19 nt, Artificial Sequence
  RNA Oligomer
agccuuucaugaagaccac

SEQ ID NO: 14743 - RNA, 19 nt, Artificial Sequence
  RNA Oligomer
cuuucaugaagaccaccag

SEQ ID NO: 14744 - RNA, 19 nt, Artificial Sequence
  RNA Oligomer
cuuccuccaaguuaaacag

SEQ ID NO: 14745 - RNA, 19 nt, Artificial Sequence
  RNA Oligomer
ugccauuccaaagcuucca

SEQ ID NO: 14746 - RNA, 19 nt, Artificial Sequence
  RNA Oligomer
acugcccucaaaauaguca

SEQ ID NO: 14747 - RNA, 19 nt, Artificial Sequence
  RNA Oligomer
cugcccucaaaauagucac

SEQ ID NO: 14748 - RNA, 19 nt, Artificial Sequence
  RNA Oligomer
guacagugucauugcuccg

SEQ ID NO: 14749 - RNA, 19 nt, Artificial Sequence
  RNA Oligomer
aucccgcacaucuucaacc

SEQ ID NO: 14750 - RNA, 19 nt, Artificial Sequence
  RNA Oligomer
auguucugguagguggcga

SEQ ID NO: 14751 - RNA, 19 nt, Artificial Sequence
  RNA Oligomer
aacacugugcgguuucuca

SEQ ID NO: 14752 - RNA, 19 nt, Artificial Sequence
  RNA Oligomer
ugacugacuauggccaccu

SEQ ID NO: 14753 - RNA, 19 nt, Artificial Sequence
  RNA Oligomer
uaauggugggagaagugag

SEQ ID NO: 14754 - RNA, 19 nt, Artificial Sequence
  RNA Oligomer
auggugggagaagugaguc

SEQ ID NO: 14755 - RNA, 19 nt, Artificial Sequence
  RNA Oligomer
uguaccacccaucaaaucg

SEQ ID NO: 14756 - RNA, 19 nt, Artificial Sequence
  RNA Oligomer
uaccacccaucaaaucgcu

SEQ ID NO: 14757 - RNA, 19 nt, Artificial Sequence
  RNA Oligomer
uguacagcauagugguccu

SEQ ID NO: 14758 - RNA, 19 nt, Artificial Sequence
  RNA Oligomer
guacagcauagugguccug

SEQ ID NO: 14759 - RNA, 19 nt, Artificial Sequence
  RNA Oligomer
aaccagaaguguccaugcu

SEQ ID NO: 14760 - RNA, 19 nt, Artificial Sequence
  RNA Oligomer
aagcuaccauggaugauga

SEQ ID NO: 14761 - RNA, 19 nt, Artificial Sequence
  RNA Oligomer
guguaagacugugaggacg

SEQ ID NO: 14762 - RNA, 19 nt, Artificial Sequence
  RNA Oligomer
gaaugacguuaccuucuug

SEQ ID NO: 14763 - RNA, 19 nt, Artificial Sequence
  RNA Oligomer
aagugaaaaucuucccaug

SEQ ID NO: 14764 - RNA, 19 nt, Artificial Sequence
  RNA Oligomer
ccaucaaagucguacaugc

SEQ ID NO: 14765 - RNA, 19 nt, Artificial Sequence
  RNA Oligomer
caucaaagucguacaugcg

SEQ ID NO: 14766 - RNA, 19 nt, Artificial Sequence
  RNA Oligomer
gagccuuucaugaagacca

SEQ ID NO: 14767 - RNA, 19 nt, Artificial Sequence
  RNA Oligomer
uugucagccagagagaaca

SEQ ID NO: 14768 - RNA, 19 nt, Artificial Sequence
  RNA Oligomer
cuccacaaacauguccugg

SEQ ID NO: 14769 - RNA, 19 nt, Artificial Sequence
  RNA Oligomer
agauuuuccaccagcgccu

SEQ ID NO: 14770 - RNA, 19 nt, Artificial Sequence
  RNA Oligomer
uccuccaaguuaaacagca

SEQ ID NO: 14771 - RNA, 19 nt, Artificial Sequence
  RNA Oligomer
cuccaaguuaaacagcagc

SEQ ID NO: 14772 - RNA, 19 nt, Artificial Sequence
  RNA Oligomer
uccaaguuaaacagcagca

SEQ ID NO: 14773 - RNA, 19 nt, Artificial Sequence
  RNA Oligomer
uugcuggacaggacgaagu

SEQ ID NO: 14774 - RNA, 19 nt, Artificial Sequence
  RNA Oligomer
uugaaauuucucauccgga

SEQ ID NO: 14775 - RNA, 19 nt, Artificial Sequence
  RNA Oligomer
agucacgaacaacagaggg

SEQ ID NO: 14776 - RNA, 19 nt, Artificial Sequence
  RNA Oligomer
auggugcugaacagagguc

SEQ ID NO: 14777 - RNA, 19 nt, Artificial Sequence
  RNA Oligomer
uccaguacagugucauugc

SEQ ID NO: 14778 - RNA, 19 nt, Artificial Sequence
  RNA Oligomer
caaaccucugcucaacugg

SEQ ID NO: 14779 - RNA, 19 nt, Artificial Sequence
  RNA Oligomer
ugcagggaguugaagaagg

SEQ ID NO: 14780 - RNA, 19 nt, Artificial Sequence
  RNA Oligomer
agcugggugauguagaugu

SEQ ID NO: 14781 - RNA, 19 nt, Artificial Sequence
  RNA Oligomer
cacuaacacugacaccuca

SEQ ID NO: 14782 - RNA, 19 nt, Artificial Sequence
  RNA Oligomer
acugcccugacuuguacuc

SEQ ID NO: 14783 - RNA, 19 nt, Artificial Sequence
  RNA Oligomer
agacauacaugauggccag

SEQ ID NO: 14784 - RNA, 19 nt, Artificial Sequence
  RNA Oligomer
caucaucauggaagaggcc

SEQ ID NO: 14785 - RNA, 19 nt, Artificial Sequence
  RNA Oligomer
guacacauucaccacaugg

SEQ ID NO: 14786 - RNA, 19 nt, Artificial Sequence
  RNA Oligomer
cuguguaagacugugagga

SEQ ID NO: 14787 - RNA, 19 nt, Artificial Sequence
  RNA Oligomer
augaagugaaaaucuuccc

SEQ ID NO: 14788 - RNA, 19 nt, Artificial Sequence
  RNA Oligomer
gugaaaaucuucccauguc

SEQ ID NO: 14789 - RNA, 19 nt, Artificial Sequence
  RNA Oligomer
uucccaugucaguuccucc

SEQ ID NO: 14790 - RNA, 19 nt, Artificial Sequence
  RNA Oligomer
aggcaguuguuggagaucu

SEQ ID NO: 14791 - RNA, 19 nt, Artificial Sequence
  RNA Oligomer
uucccaucaaagucguaca

SEQ ID NO: 14792 - RNA, 19 nt, Artificial Sequence
  RNA Oligomer
acuccacaaacauguccug

SEQ ID NO: 14793 - RNA, 19 nt, Artificial Sequence
  RNA Oligomer
ucuuccuccaaguuaaaca

SEQ ID NO: 14794 - RNA, 19 nt, Artificial Sequence
  RNA Oligomer
aaacagcagcaccagguca

SEQ ID NO: 14795 - RNA, 19 nt, Artificial Sequence
  RNA Oligomer
cuggacaggacgaaguuga

SEQ ID NO: 14796 - RNA, 19 nt, Artificial Sequence
  RNA Oligomer
cuccaguacagugucauug

SEQ ID NO: 14797 - RNA, 19 nt, Artificial Sequence
  RNA Oligomer
agggaguugaagaagggcu

SEQ ID NO: 14798 - RNA, 19 nt, Artificial Sequence
  RNA Oligomer
caaccagaaguguccaugc

SEQ ID NO: 14799 - RNA, 19 nt, Artificial Sequence
  RNA Oligomer
auagagcaggauguagagg

SEQ ID NO: 14800 - RNA, 19 nt, Artificial Sequence
  RNA Oligomer
auguagaggugguggguca

SEQ ID NO: 14801 - RNA, 19 nt, Artificial Sequence
  RNA Oligomer
acauacaugauggccagga

SEQ ID NO: 14802 - RNA, 19 nt, Artificial Sequence
  RNA Oligomer
aggaaggugaugagguugc

SEQ ID NO: 14803 - RNA, 19 nt, Artificial Sequence
  RNA Oligomer
cacauggugagcaagaugu

SEQ ID NO: 14804 - RNA, 19 nt, Artificial Sequence
  RNA Oligomer
uuaccuucuugccaaaccu

SEQ ID NO: 14805 - RNA, 19 nt, Artificial Sequence
  RNA Oligomer
uggagccucuugaaauuuc

SEQ ID NO: 14806 - RNA, 19 nt, Artificial Sequence
  RNA Oligomer
gucacgaacaacagaggga

SEQ ID NO: 14807 - RNA, 19 nt, Artificial Sequence
  RNA Oligomer
ucacgaacaacagagggag

SEQ ID NO: 14808 - RNA, 19 nt, Artificial Sequence
  RNA Oligomer
aauuguucaaggacgaugg

SEQ ID NO: 14809 - RNA, 19 nt, Artificial Sequence
  RNA Oligomer
auuucucauguagacgcca

SEQ ID NO: 14810 - RNA, 19 nt, Artificial Sequence
  RNA Oligomer
ucaaaccucugcucaacug

SEQ ID NO: 14811 - RNA, 19 nt, Artificial Sequence
  RNA Oligomer
cugggugauguagaugugc

SEQ ID NO: 14812 - RNA, 19 nt, Artificial Sequence
  RNA Oligomer
ugacggaugacuugaagac

SEQ ID NO: 14813 - RNA, 19 nt, Artificial Sequence
  RNA Oligomer
cuaccauggaugaugagca

SEQ ID NO: 14814 - RNA, 19 nt, Artificial Sequence
  RNA Oligomer
ugauggagaacagguacac

SEQ ID NO: 14815 - RNA, 19 nt, Artificial Sequence
  RNA Oligomer
gagaacagguacacauuca

SEQ ID NO: 14816 - RNA, 19 nt, Artificial Sequence
  RNA Oligomer
agaacagguacacauucac

SEQ ID NO: 14817 - RNA, 19 nt, Artificial Sequence
  RNA Oligomer
agaacaugaaagagaugcu

SEQ ID NO: 14818 - RNA, 19 nt, Artificial Sequence
  RNA Oligomer
guuaccuucuugccaaacc

SEQ ID NO: 14819 - RNA, 19 nt, Artificial Sequence
  RNA Oligomer
ucaacucagucucaauguc

SEQ ID NO: 14820 - RNA, 19 nt, Artificial Sequence
  RNA Oligomer
caacaauccaggcacugag

SEQ ID NO: 14821 - RNA, 19 nt, Artificial Sequence
  RNA Oligomer
acgaacaacagagggagca

SEQ ID NO: 14822 - RNA, 19 nt, Artificial Sequence
  RNA Oligomer
ucccgcacaucuucaacca

SEQ ID NO: 14823 - RNA, 19 nt, Artificial Sequence
  RNA Oligomer
uuuucugcaggaagcuggg

SEQ ID NO: 14824 - RNA, 19 nt, Artificial Sequence
  RNA Oligomer
cucaccaggucugaaagca

SEQ ID NO: 14825 - RNA, 19 nt, Artificial Sequence
  RNA Oligomer
ugggaaaucagagaaggcu

SEQ ID NO: 14826 - RNA, 19 nt, Artificial Sequence
  RNA Oligomer
acccaucaaaucgcugcac

SEQ ID NO: 14827 - RNA, 19 nt, Artificial Sequence
  RNA Oligomer
ugggugauguagaugugca

SEQ ID NO: 14828 - RNA, 19 nt, Artificial Sequence
  RNA Oligomer
acggaugacuugaagacca

SEQ ID NO: 14829 - RNA, 19 nt, Artificial Sequence
  RNA Oligomer
ugaggauggaggcaaaagg

SEQ ID NO: 14830 - RNA, 19 nt, Artificial Sequence
  RNA Oligomer
uuggguaucuggcacaucu

SEQ ID NO: 14831 - RNA, 19 nt, Artificial Sequence
  RNA Oligomer
augaugagcaggacauaga

SEQ ID NO: 14832 - RNA, 19 nt, Artificial Sequence
  RNA Oligomer
agagcaggauguagaggug

SEQ ID NO: 14833 - RNA, 19 nt, Artificial Sequence
  RNA Oligomer
accuucuugccaaaccucc

SEQ ID NO: 14834 - RNA, 19 nt, Artificial Sequence
  RNA Oligomer
aucuucccaugucaguucc

SEQ ID NO: 14835 - RNA, 19 nt, Artificial Sequence
  RNA Oligomer
caugucaguuccuccuugu

SEQ ID NO: 14836 - RNA, 19 nt, Artificial Sequence
  RNA Oligomer
ugaaaaaggucuccaggag

SEQ ID NO: 14837 - RNA, 19 nt, Artificial Sequence
  RNA Oligomer
uucaaccaacacauggucc

SEQ ID NO: 14838 - RNA, 19 nt, Artificial Sequence
  RNA Oligomer
gagcucuggagacacuuga

SEQ ID NO: 14839 - RNA, 19 nt, Artificial Sequence
  RNA Oligomer
cugugcuccaugagguugu

SEQ ID NO: 14840 - RNA, 19 nt, Artificial Sequence
  RNA Oligomer
agaaauaggaagaacagag

SEQ ID NO: 14841 - RNA, 19 nt, Artificial Sequence
  RNA Oligomer
cacccaucaaaucgcugca

SEQ ID NO: 14842 - RNA, 19 nt, Artificial Sequence
  RNA Oligomer
auggagaacagguacacau

SEQ ID NO: 14843 - RNA, 19 nt, Artificial Sequence
  RNA Oligomer
cuucccaugucaguuccuc

SEQ ID NO: 14844 - RNA, 19 nt, Artificial Sequence
  RNA Oligomer
ucccaugucaguuccuccu

SEQ ID NO: 14845 - RNA, 19 nt, Artificial Sequence
  RNA Oligomer
aacaacagagggagcacac

SEQ ID NO: 14846 - RNA, 19 nt, Artificial Sequence
  RNA Oligomer
agccacucauacacagcga

SEQ ID NO: 14847 - RNA, 19 nt, Artificial Sequence
  RNA Oligomer
cacucauacacagcgaugu

SEQ ID NO: 14848 - RNA, 19 nt, Artificial Sequence
  RNA Oligomer
auugcauacauagguauug

SEQ ID NO: 14849 - RNA, 19 nt, Artificial Sequence
  RNA Oligomer
aaaccuugggugaaauuag

SEQ ID NO: 14850 - RNA, 19 nt, Artificial Sequence
  RNA Oligomer
augaaguagaucuucuuac

SEQ ID NO: 14851 - RNA, 19 nt, Artificial Sequence
  RNA Oligomer
aaguccugguuguacaggg

SEQ ID NO: 14852 - RNA, 19 nt, Artificial Sequence
  RNA Oligomer
guuuucugcaggaagcugg

SEQ ID NO: 14853 - RNA, 19 nt, Artificial Sequence
  RNA Oligomer
gucugaugaaagaacgugc

SEQ ID NO: 14854 - RNA, 19 nt, Artificial Sequence
  RNA Oligomer
guggguuucuguaaauggc

SEQ ID NO: 14855 - RNA, 19 nt, Artificial Sequence
  RNA Oligomer
cuuguacucaaagcccugg

SEQ ID NO: 14856 - RNA, 19 nt, Artificial Sequence
  RNA Oligomer
cauggaugaugagcaggac

SEQ ID NO: 14857 - RNA, 19 nt, Artificial Sequence
  RNA Oligomer
auucaccacauggcccaca

SEQ ID NO: 14858 - RNA, 19 nt, Artificial Sequence
  RNA Oligomer
ugcguuggaacuucucucg

SEQ ID NO: 14859 - RNA, 19 nt, Artificial Sequence
  RNA Oligomer
aaggacagguagccauugc

SEQ ID NO: 14860 - RNA, 19 nt, Artificial Sequence
  RNA Oligomer
aauuucucauccggagccg

SEQ ID NO: 14861 - RNA, 19 nt, Artificial Sequence
  RNA Oligomer
cacaaauuguucaaggacg

SEQ ID NO: 14862 - RNA, 19 nt, Artificial Sequence
  RNA Oligomer
aggguucuaagaugccagc

SEQ ID NO: 14863 - RNA, 19 nt, Artificial Sequence
  RNA Oligomer
uucucacucuagucccuag

SEQ ID NO: 14864 - RNA, 19 nt, Artificial Sequence
  RNA Oligomer
aaucagagaaggcugaggc

SEQ ID NO: 14865 - RNA, 19 nt, Artificial Sequence
  RNA Oligomer
uugaugagcugacaggccu

SEQ ID NO: 14866 - RNA, 19 nt, Artificial Sequence
  RNA Oligomer
aucucgaugaaggaucuca

SEQ ID NO: 14867 - RNA, 19 nt, Artificial Sequence
  RNA Oligomer
cauccuuggaaaugaggcc

SEQ ID NO: 14868 - RNA, 19 nt, Artificial Sequence
  RNA Oligomer
auccuuggaaaugaggcca

SEQ ID NO: 14869 - RNA, 19 nt, Artificial Sequence
  RNA Oligomer
aaauuucucauccggagcc

SEQ ID NO: 14870 - RNA, 19 nt, Artificial Sequence
  RNA Oligomer
uuucuucaaucuccuucuu

SEQ ID NO: 14871 - RNA, 19 nt, Artificial Sequence
  RNA Oligomer
acaaauuguucaaggacga

SEQ ID NO: 14872 - RNA, 19 nt, Artificial Sequence
  RNA Oligomer
aucuucaaccaacacaugg

SEQ ID NO: 14873 - RNA, 19 nt, Artificial Sequence
  RNA Oligomer
uuguaggcuugggugcuca

SEQ ID NO: 14874 - RNA, 19 nt, Artificial Sequence
  RNA Oligomer
ugcauacauagguauuggg

SEQ ID NO: 14875 - RNA, 19 nt, Artificial Sequence
  RNA Oligomer
uaaauggcuugccaugggu

SEQ ID NO: 14876 - RNA, 19 nt, Artificial Sequence
  RNA Oligomer
guacacgccaucugcauag

SEQ ID NO: 14877 - RNA, 19 nt, Artificial Sequence
  RNA Oligomer
gaggguucuaagaugccag

SEQ ID NO: 14878 - RNA, 19 nt, Artificial Sequence
  RNA Oligomer
augagguuguuguaccacc

SEQ ID NO: 14879 - RNA, 19 nt, Artificial Sequence
  RNA Oligomer
aaguucucauaaugguggg

SEQ ID NO: 14880 - RNA, 19 nt, Artificial Sequence
  RNA Oligomer
aacacugacaccucaaacu

SEQ ID NO: 14881 - RNA, 19 nt, Artificial Sequence
  RNA Oligomer
cucuccaaaugguccauca

SEQ ID NO: 14882 - RNA, 19 nt, Artificial Sequence
  RNA Oligomer
gacuuguacucaaagcccu

SEQ ID NO: 14883 - RNA, 19 nt, Artificial Sequence
  RNA Oligomer
aagagaugcuggcugcugu

SEQ ID NO: 14884 - RNA, 19 nt, Artificial Sequence
  RNA Oligomer
uuucaugaagaccaccagg

SEQ ID NO: 14885 - RNA, 19 nt, Artificial Sequence
  RNA Oligomer
aaguugaccuucuguggag

SEQ ID NO: 14886 - RNA, 19 nt, Artificial Sequence
  RNA Oligomer
uuguggccuugccauucca

SEQ ID NO: 14887 - RNA, 19 nt, Artificial Sequence
  RNA Oligomer
aauguugauaacagcgacc

SEQ ID NO: 14888 - RNA, 19 nt, Artificial Sequence
  RNA Oligomer
ucggauuucuucaaucucc

SEQ ID NO: 14889 - RNA, 19 nt, Artificial Sequence
  RNA Oligomer
ucaaggacgauggugcuga

SEQ ID NO: 14890 - RNA, 19 nt, Artificial Sequence
  RNA Oligomer
ucaaccaacacaugguccu

SEQ ID NO: 14891 - RNA, 19 nt, Artificial Sequence
  RNA Oligomer
aacucugaggagaugcugg

SEQ ID NO: 14892 - RNA, 19 nt, Artificial Sequence
  RNA Oligomer
uacauagguauugggccag

SEQ ID NO: 14893 - RNA, 19 nt, Artificial Sequence
  RNA Oligomer
agaugguguugcuaagguc

SEQ ID NO: 14894 - RNA, 19 nt, Artificial Sequence
  RNA Oligomer
aaccuugggugaaauuagu

SEQ ID NO: 14895 - RNA, 19 nt, Artificial Sequence
  RNA Oligomer
guaaauggcuugccauggg

SEQ ID NO: 14896 - RNA, 19 nt, Artificial Sequence
  RNA Oligomer
aaaucagagaaggcugagg

SEQ ID NO: 14897 - RNA, 19 nt, Artificial Sequence
  RNA Oligomer
aagaagauguggaaacggg

SEQ ID NO: 14898 - RNA, 19 nt, Artificial Sequence
  RNA Oligomer
guugaggaagguuucucgc

SEQ ID NO: 14899 - RNA, 19 nt, Artificial Sequence
  RNA Oligomer
caugaagugaaaaucuucc

SEQ ID NO: 14900 - RNA, 19 nt, Artificial Sequence
  RNA Oligomer
uuggacaggcaguuguugg

SEQ ID NO: 14901 - RNA, 19 nt, Artificial Sequence
  RNA Oligomer
cugaugaacucauccuugg

SEQ ID NO: 14902 - RNA, 19 nt, Artificial Sequence
  RNA Oligomer
auaacagcgaccagcacgu

SEQ ID NO: 14903 - RNA, 19 nt, Artificial Sequence
  RNA Oligomer
uugagaugguguugcuaag

SEQ ID NO: 14904 - RNA, 19 nt, Artificial Sequence
  RNA Oligomer
gagaugguguugcuaaggu

SEQ ID NO: 14905 - RNA, 19 nt, Artificial Sequence
  RNA Oligomer
acuucucacucuagucccu

SEQ ID NO: 14906 - RNA, 19 nt, Artificial Sequence
  RNA Oligomer
aaguagaucuucuuacaga

SEQ ID NO: 14907 - RNA, 19 nt, Artificial Sequence
  RNA Oligomer
aaacuuaugccacuccugg

SEQ ID NO: 14908 - RNA, 19 nt, Artificial Sequence
  RNA Oligomer
ugaucuccaccuucuuccg

SEQ ID NO: 14909 - RNA, 19 nt, Artificial Sequence
  RNA Oligomer
aaugucccaaaauggagac

SEQ ID NO: 14910 - RNA, 19 nt, Artificial Sequence
  RNA Oligomer
aaagagaugcuggcugcug

SEQ ID NO: 14911 - RNA, 19 nt, Artificial Sequence
  RNA Oligomer
ggacagaucauauccuggc

SEQ ID NO: 14912 - RNA, 19 nt, Artificial Sequence
  RNA Oligomer
augaaggaucucagcaucc

SEQ ID NO: 14913 - RNA, 19 nt, Artificial Sequence
  RNA Oligomer
uuggaaaugaggccauucc

SEQ ID NO: 14914 - RNA, 19 nt, Artificial Sequence
  RNA Oligomer
uagccaggauaaguccugg

SEQ ID NO: 14915 - RNA, 19 nt, Artificial Sequence
  RNA Oligomer
ucuucaaccaacacauggu

SEQ ID NO: 14916 - RNA, 19 nt, Artificial Sequence
  RNA Oligomer
ucuggagacacuugaguuc

SEQ ID NO: 14917 - RNA, 19 nt, Artificial Sequence
  RNA Oligomer
acacuugaguuccgauuga

SEQ ID NO: 14918 - RNA, 19 nt, Artificial Sequence
  RNA Oligomer
ucugaugaaagaacgugcu

SEQ ID NO: 14919 - RNA, 19 nt, Artificial Sequence
  RNA Oligomer
ugcuccaugagguuguugu

SEQ ID NO: 14920 - RNA, 19 nt, Artificial Sequence
  RNA Oligomer
uucugagauuuguuucuga

SEQ ID NO: 14921 - RNA, 19 nt, Artificial Sequence
  RNA Oligomer
ugagguuguuguaccaccc

SEQ ID NO: 14922 - RNA, 19 nt, Artificial Sequence
  RNA Oligomer
aagugccgcucacagaugu

SEQ ID NO: 14923 - RNA, 19 nt, Artificial Sequence
  RNA Oligomer
gguugaggaagguuucucg

SEQ ID NO: 14924 - RNA, 19 nt, Artificial Sequence
  RNA Oligomer
uugaggaagguuucucgca

SEQ ID NO: 14925 - RNA, 19 nt, Artificial Sequence
  RNA Oligomer
ucucgcaggaaggugauga

SEQ ID NO: 14926 - RNA, 19 nt, Artificial Sequence
  RNA Oligomer
aagauguaggagaacauga

SEQ ID NO: 14927 - RNA, 19 nt, Artificial Sequence
  RNA Oligomer
augucccaaaauggagacc

SEQ ID NO: 14928 - RNA, 19 nt, Artificial Sequence
  RNA Oligomer
uaguucucaaugaagcgcu

SEQ ID NO: 14929 - RNA, 19 nt, Artificial Sequence
  RNA Oligomer
caccaggucauacuccuug

SEQ ID NO: 14930 - RNA, 19 nt, Artificial Sequence
  RNA Oligomer
acgaaguugaccuucugug

SEQ ID NO: 14931 - RNA, 19 nt, Artificial Sequence
  RNA Oligomer
uuccaaagcuuccaugccu

SEQ ID NO: 14932 - RNA, 19 nt, Artificial Sequence
  RNA Oligomer
uuccugguguucucaaacc

SEQ ID NO: 14933 - RNA, 19 nt, Artificial Sequence
  RNA Oligomer
uguucucaaaccaguagcg

SEQ ID NO: 14934 - RNA, 19 nt, Artificial Sequence
  RNA Oligomer
auuguucaaggacgauggu

SEQ ID NO: 14935 - RNA, 19 nt, Artificial Sequence
  RNA Oligomer
uuguucaaggacgauggug

SEQ ID NO: 14936 - RNA, 19 nt, Artificial Sequence
  RNA Oligomer
uaaguccugguuguacagg

SEQ ID NO: 14937 - RNA, 19 nt, Artificial Sequence
  RNA Oligomer
uaaugggagacaagcccag

SEQ ID NO: 14938 - RNA, 19 nt, Artificial Sequence
  RNA Oligomer
cuucaaccaacacaugguc

SEQ ID NO: 14939 - RNA, 19 nt, Artificial Sequence
  RNA Oligomer
aaccaacacaugguccucu

SEQ ID NO: 14940 - RNA, 19 nt, Artificial Sequence
  RNA Oligomer
ugcauccacaucuucagca

SEQ ID NO: 14941 - RNA, 19 nt, Artificial Sequence
  RNA Oligomer
uacuccgggaguguuuucu

SEQ ID NO: 14942 - RNA, 19 nt, Artificial Sequence
  RNA Oligomer
acauagguauugggccagg

SEQ ID NO: 14943 - RNA, 19 nt, Artificial Sequence
  RNA Oligomer
agauuuguuucugaagucu

SEQ ID NO: 14944 - RNA, 19 nt, Artificial Sequence
  RNA Oligomer
acauggugacugacuaugg

SEQ ID NO: 14945 - RNA, 19 nt, Artificial Sequence
  RNA Oligomer
cauggugacugacuauggc

SEQ ID NO: 14946 - RNA, 19 nt, Artificial Sequence
  RNA Oligomer
auggugacugacuauggcc

SEQ ID NO: 14947 - RNA, 19 nt, Artificial Sequence
  RNA Oligomer
ugaagaagggcucaaaggg

SEQ ID NO: 14948 - RNA, 19 nt, Artificial Sequence
  RNA Oligomer
ucacagauguacagcauag

SEQ ID NO: 14949 - RNA, 19 nt, Artificial Sequence
  RNA Oligomer
uacagaacacuuggcagcu

SEQ ID NO: 14950 - RNA, 19 nt, Artificial Sequence
  RNA Oligomer
caccaguaauacuucuggg

SEQ ID NO: 14951 - RNA, 19 nt, Artificial Sequence
  RNA Oligomer
cucagggauuagaaugucc

SEQ ID NO: 14952 - RNA, 19 nt, Artificial Sequence
  RNA Oligomer
uagaaugucccaaaaugga

SEQ ID NO: 14953 - RNA, 19 nt, Artificial Sequence
  RNA Oligomer
caaaggcguaguaguaggc

SEQ ID NO: 14954 - RNA, 19 nt, Artificial Sequence
  RNA Oligomer
aaaggcguaguaguaggcc

SEQ ID NO: 14955 - RNA, 19 nt, Artificial Sequence
  RNA Oligomer
gacagaucauauccuggcu

SEQ ID NO: 14956 - RNA, 19 nt, Artificial Sequence
  RNA Oligomer
uccuugaugacuucaggca

SEQ ID NO: 14957 - RNA, 19 nt, Artificial Sequence
  RNA Oligomer
acaugcggaacauaaggcg

SEQ ID NO: 14958 - RNA, 19 nt, Artificial Sequence
  RNA Oligomer
accaggucauacuccuugg

SEQ ID NO: 14959 - RNA, 19 nt, Artificial Sequence
  RNA Oligomer
uugaccuucuguggaggcu

SEQ ID NO: 14960 - RNA, 19 nt, Artificial Sequence
  RNA Oligomer
aacaauccaggcacugagc

SEQ ID NO: 14961 - RNA, 19 nt, Artificial Sequence
  RNA Oligomer
caauguugauaacagcgac

SEQ ID NO: 14962 - RNA, 19 nt, Artificial Sequence
  RNA Oligomer
uuucggauuucuucaaucu

SEQ ID NO: 14963 - RNA, 19 nt, Artificial Sequence
  RNA Oligomer
uuuguaggcuugggugcuc

SEQ ID NO: 14964 - RNA, 19 nt, Artificial Sequence
  RNA Oligomer
uggagacacuugaguuccg

SEQ ID NO: 14965 - RNA, 19 nt, Artificial Sequence
  RNA Oligomer
uacacagcgauguucuggu

SEQ ID NO: 14966 - RNA, 19 nt, Artificial Sequence
  RNA Oligomer
gcauacauagguauugggc

SEQ ID NO: 14967 - RNA, 19 nt, Artificial Sequence
  RNA Oligomer
agggucugaugaaagaacg

SEQ ID NO: 14968 - RNA, 19 nt, Artificial Sequence
  RNA Oligomer
uagggaggguucuaagaug

SEQ ID NO: 14969 - RNA, 19 nt, Artificial Sequence
  RNA Oligomer
cuguugaugagcugacagg

SEQ ID NO: 14970 - RNA, 19 nt, Artificial Sequence
  RNA Oligomer
uuuuccacauucuugguca

SEQ ID NO: 14971 - RNA, 19 nt, Artificial Sequence
  RNA Oligomer
uugaagaccaggucuuuga

SEQ ID NO: 14972 - RNA, 19 nt, Artificial Sequence
  RNA Oligomer
aaguguccaugcuagagcc

SEQ ID NO: 14973 - RNA, 19 nt, Artificial Sequence
  RNA Oligomer
ugguccaucaagguacagc

SEQ ID NO: 14974 - RNA, 19 nt, Artificial Sequence
  RNA Oligomer
ucagggauuagaauguccc

SEQ ID NO: 14975 - RNA, 19 nt, Artificial Sequence
  RNA Oligomer
auguaggagaacaugaaag

SEQ ID NO: 14976 - RNA, 19 nt, Artificial Sequence
  RNA Oligomer
guaguucucaaugaagcgc

SEQ ID NO: 14977 - RNA, 19 nt, Artificial Sequence
  RNA Oligomer
ugucccaaaauggagaccc

SEQ ID NO: 14978 - RNA, 19 nt, Artificial Sequence
  RNA Oligomer
aagcgcuugaacuguugca

SEQ ID NO: 14979 - RNA, 19 nt, Artificial Sequence
  RNA Oligomer
agggacagaucauauccug

SEQ ID NO: 14980 - RNA, 19 nt, Artificial Sequence
  RNA Oligomer
aucauauccuggcugaugu

SEQ ID NO: 14981 - RNA, 19 nt, Artificial Sequence
  RNA Oligomer
aagcggagcucgcuauugu

SEQ ID NO: 14982 - RNA, 19 nt, Artificial Sequence
  RNA Oligomer
aucaaagucguacaugcgg

SEQ ID NO: 14983 - RNA, 19 nt, Artificial Sequence
  RNA Oligomer
uuccucaggagagccuuuc

SEQ ID NO: 14984 - RNA, 19 nt, Artificial Sequence
  RNA Oligomer
acgaacucugaggagaugc

SEQ ID NO: 14985 - RNA, 19 nt, Artificial Sequence
  RNA Oligomer
ccgguauccuguauacucc

SEQ ID NO: 14986 - RNA, 19 nt, Artificial Sequence
  RNA Oligomer
guauccuguauacuccggg

SEQ ID NO: 14987 - RNA, 19 nt, Artificial Sequence
  RNA Oligomer
ugcgaggaaccauagaugg

SEQ ID NO: 14988 - RNA, 19 nt, Artificial Sequence
  RNA Oligomer
aauguugaggaacucggcg

SEQ ID NO: 14989 - RNA, 19 nt, Artificial Sequence
  RNA Oligomer
uuuauuuggaagggagacu

SEQ ID NO: 14990 - RNA, 19 nt, Artificial Sequence
  RNA Oligomer
auacauagguauugggcca

SEQ ID NO: 14991 - RNA, 19 nt, Artificial Sequence
  RNA Oligomer
gugcuuaaaaccuugggug

SEQ ID NO: 14992 - RNA, 19 nt, Artificial Sequence
  RNA Oligomer
uucuguaaauggcuugcca

SEQ ID NO: 14993 - RNA, 19 nt, Artificial Sequence
  RNA Oligomer
cuucugagauuuguuucug

SEQ ID NO: 14994 - RNA, 19 nt, Artificial Sequence
  RNA Oligomer
aagucuggaagcagagguu

SEQ ID NO: 14995 - RNA, 19 nt, Artificial Sequence
  RNA Oligomer
accuggaacaagguuggga

SEQ ID NO: 14996 - RNA, 19 nt, Artificial Sequence
  RNA Oligomer
uguugaugagcugacaggc

SEQ ID NO: 14997 - RNA, 19 nt, Artificial Sequence
  RNA Oligomer
agaaccuucuggaagugcc

SEQ ID NO: 14998 - RNA, 19 nt, Artificial Sequence
  RNA Oligomer
uagaugugcacagacacca

SEQ ID NO: 14999 - RNA, 19 nt, Artificial Sequence
  RNA Oligomer
aucaagguacagcuuuggg

SEQ ID NO: 15000 - RNA, 19 nt, Artificial Sequence
  RNA Oligomer
augugcaggcuaagcgugu

SEQ ID NO: 15001 - RNA, 19 nt, Artificial Sequence
  RNA Oligomer
aucagggcaaagcuaccau

SEQ ID NO: 15002 - RNA, 19 nt, Artificial Sequence
  RNA Oligomer
ccaccaguaauacuucugg

SEQ ID NO: 15003 - RNA, 19 nt, Artificial Sequence
  RNA Oligomer
acacauucaccacauggcc

SEQ ID NO: 15004 - RNA, 19 nt, Artificial Sequence
  RNA Oligomer
acauucaccacauggccca

SEQ ID NO: 15005 - RNA, 19 nt, Artificial Sequence
  RNA Oligomer
augaggcgauggaagucca

SEQ ID NO: 15006 - RNA, 19 nt, Artificial Sequence
  RNA Oligomer
aacuguugcaccgucuggu

SEQ ID NO: 15007 - RNA, 19 nt, Artificial Sequence
  RNA Oligomer
ugaagugaaaaucuuccca

SEQ ID NO: 15008 - RNA, 19 nt, Artificial Sequence
  RNA Oligomer
aaggaucucagcauccuga

SEQ ID NO: 15009 - RNA, 19 nt, Artificial Sequence
  RNA Oligomer
gugccugaaaaaggucucc

SEQ ID NO: 15010 - RNA, 19 nt, Artificial Sequence
  RNA Oligomer
aaagcuuccaugccuccca

SEQ ID NO: 15011 - RNA, 19 nt, Artificial Sequence
  RNA Oligomer
gccagacaaagacauuggg

SEQ ID NO: 15012 - RNA, 19 nt, Artificial Sequence
  RNA Oligomer
auguugauaacagcgacca

SEQ ID NO: 15013 - RNA, 19 nt, Artificial Sequence
  RNA Oligomer
gauuucuucaaucuccuuc

SEQ ID NO: 15014 - RNA, 19 nt, Artificial Sequence
  RNA Oligomer
guucucaaaccaguagcgg

SEQ ID NO: 15015 - RNA, 19 nt, Artificial Sequence
  RNA Oligomer
uucaaggacgauggugcug

SEQ ID NO: 15016 - RNA, 19 nt, Artificial Sequence
  RNA Oligomer
auaaguccugguuguacag

SEQ ID NO: 15017 - RNA, 19 nt, Artificial Sequence
  RNA Oligomer
cagcagugcauccacaucu

SEQ ID NO: 15018 - RNA, 19 nt, Artificial Sequence
  RNA Oligomer
agcacuuuguaggcuuggg

SEQ ID NO: 15019 - RNA, 19 nt, Artificial Sequence
  RNA Oligomer
acuuuguaggcuugggugc

SEQ ID NO: 15020 - RNA, 19 nt, Artificial Sequence
  RNA Oligomer
cuggagacacuugaguucc

SEQ ID NO: 15021 - RNA, 19 nt, Artificial Sequence
  RNA Oligomer
cgaauguugaggaacucgg

SEQ ID NO: 15022 - RNA, 19 nt, Artificial Sequence
  RNA Oligomer
augguguugcuaaggucuc

SEQ ID NO: 15023 - RNA, 19 nt, Artificial Sequence
  RNA Oligomer
caucugugcuccaugaggu

SEQ ID NO: 15024 - RNA, 19 nt, Artificial Sequence
  RNA Oligomer
gagauuuguuucugaaguc

SEQ ID NO: 15025 - RNA, 19 nt, Artificial Sequence
  RNA Oligomer
gaagucuggaagcagaggu

SEQ ID NO: 15026 - RNA, 19 nt, Artificial Sequence
  RNA Oligomer
guucucauaauggugggag

SEQ ID NO: 15027 - RNA, 19 nt, Artificial Sequence
  RNA Oligomer
ugccuguugaugagcugac

SEQ ID NO: 15028 - RNA, 19 nt, Artificial Sequence
  RNA Oligomer
ugagcugacaggccuuuuc

SEQ ID NO: 15029 - RNA, 19 nt, Artificial Sequence
  RNA Oligomer
agguccugguggucauucu

SEQ ID NO: 15030 - RNA, 19 nt, Artificial Sequence
  RNA Oligomer
augacuugaagaccagguc

SEQ ID NO: 15031 - RNA, 19 nt, Artificial Sequence
  RNA Oligomer
aggucuuugaggauggagg

SEQ ID NO: 15032 - RNA, 19 nt, Artificial Sequence
  RNA Oligomer
uccaaaugguccaucaagg

SEQ ID NO: 15033 - RNA, 19 nt, Artificial Sequence
  RNA Oligomer
accaccaguaauacuucug

SEQ ID NO: 15034 - RNA, 19 nt, Artificial Sequence
  RNA Oligomer
acacuguguaagacuguga

SEQ ID NO: 15035 - RNA, 19 nt, Artificial Sequence
  RNA Oligomer
agaaugucccaaaauggag

SEQ ID NO: 15036 - RNA, 19 nt, Artificial Sequence
  RNA Oligomer
acagcugcguuggaacuuc

SEQ ID NO: 15037 - RNA, 19 nt, Artificial Sequence
  RNA Oligomer
gagggacagaucauauccu

SEQ ID NO: 15038 - RNA, 19 nt, Artificial Sequence
  RNA Oligomer
aagucguacaugcggaaca

SEQ ID NO: 15039 - RNA, 19 nt, Artificial Sequence
  RNA Oligomer
auugccauccuugucagcc

SEQ ID NO: 15040 - RNA, 19 nt, Artificial Sequence
  RNA Oligomer
auuccaaagcuuccaugcc

SEQ ID NO: 15041 - RNA, 19 nt, Artificial Sequence
  RNA Oligomer
cuucagugcugagcugucu

SEQ ID NO: 15042 - RNA, 19 nt, Artificial Sequence
  RNA Oligomer
ucaauguugauaacagcga

SEQ ID NO: 15043 - RNA, 19 nt, Artificial Sequence
  RNA Oligomer
ugcgggaaaacuucagugg

SEQ ID NO: 15044 - RNA, 19 nt, Artificial Sequence
  RNA Oligomer
accaacacaugguccucuc

SEQ ID NO: 15045 - RNA, 19 nt, Artificial Sequence
  RNA Oligomer
uggcauuucucauguagac

SEQ ID NO: 15046 - RNA, 19 nt, Artificial Sequence
  RNA Oligomer
aguguuuucugcaggaagc

SEQ ID NO: 15047 - RNA, 19 nt, Artificial Sequence
  RNA Oligomer
auacacagcgauguucugg

SEQ ID NO: 15048 - RNA, 19 nt, Artificial Sequence
  RNA Oligomer
gaauguugaggaacucggc

SEQ ID NO: 15049 - RNA, 19 nt, Artificial Sequence
  RNA Oligomer
uuuggaagggagacuacug

SEQ ID NO: 15050 - RNA, 19 nt, Artificial Sequence
  RNA Oligomer
aagggagacuacuggagca

SEQ ID NO: 15051 - RNA, 19 nt, Artificial Sequence
  RNA Oligomer
cauacauagguauugggcc

SEQ ID NO: 15052 - RNA, 19 nt, Artificial Sequence
  RNA Oligomer
cuugucuucugagauuugu

SEQ ID NO: 15053 - RNA, 19 nt, Artificial Sequence
  RNA Oligomer
uuucugaagucuggaagca

SEQ ID NO: 15054 - RNA, 19 nt, Artificial Sequence
  RNA Oligomer
uccaugagguuguuguacc

SEQ ID NO: 15055 - RNA, 19 nt, Artificial Sequence
  RNA Oligomer
cauuucuccaggcugagac

SEQ ID NO: 15056 - RNA, 19 nt, Artificial Sequence
  RNA Oligomer
aagaccaggucuuugagga

SEQ ID NO: 15057 - RNA, 19 nt, Artificial Sequence
  RNA Oligomer
aacuuaugccacuccuggu

SEQ ID NO: 15058 - RNA, 19 nt, Artificial Sequence
  RNA Oligomer
aucuggcacaucugucacc

SEQ ID NO: 15059 - RNA, 19 nt, Artificial Sequence
  RNA Oligomer
guuucucgcaggaagguga

SEQ ID NO: 15060 - RNA, 19 nt, Artificial Sequence
  RNA Oligomer
agcgcuugaacuguugcac

SEQ ID NO: 15061 - RNA, 19 nt, Artificial Sequence
  RNA Oligomer
uugaugacuucaggcaccu

SEQ ID NO: 15062 - RNA, 19 nt, Artificial Sequence
  RNA Oligomer
ucucgaugaaggaucucag

SEQ ID NO: 15063 - RNA, 19 nt, Artificial Sequence
  RNA Oligomer
ugaaggaucucagcauccu

SEQ ID NO: 15064 - RNA, 19 nt, Artificial Sequence
  RNA Oligomer
ucauccuuggaaaugaggc

SEQ ID NO: 15065 - RNA, 19 nt, Artificial Sequence
  RNA Oligomer
aaugaggccauucccauca

SEQ ID NO: 15066 - RNA, 19 nt, Artificial Sequence
  RNA Oligomer
augcggaacauaaggcgag

SEQ ID NO: 15067 - RNA, 19 nt, Artificial Sequence
  RNA Oligomer
aaggcgagacuuuuccuca

SEQ ID NO: 15068 - RNA, 19 nt, Artificial Sequence
  RNA Oligomer
uccacaaacauguccuggg

SEQ ID NO: 15069 - RNA, 19 nt, Artificial Sequence
  RNA Oligomer
ugggagaaaaggugccuga

SEQ ID NO: 15070 - RNA, 19 nt, Artificial Sequence
  RNA Oligomer
uccaaagcuuccaugccuc

SEQ ID NO: 15071 - RNA, 19 nt, Artificial Sequence
  RNA Oligomer
agcuucucagacacgaugc

SEQ ID NO: 15072 - RNA, 19 nt, Artificial Sequence
  RNA Oligomer
uccugguguucucaaacca

SEQ ID NO: 15073 - RNA, 19 nt, Artificial Sequence
  RNA Oligomer
uucucaaaccaguagcggu

SEQ ID NO: 15074 - RNA, 19 nt, Artificial Sequence
  RNA Oligomer
ugugcgggaaaacuucagu

SEQ ID NO: 15075 - RNA, 19 nt, Artificial Sequence
  RNA Oligomer
augguggacaggaacugcu

SEQ ID NO: 15076 - RNA, 19 nt, Artificial Sequence
  RNA Oligomer
gguauccuguauacuccgg

SEQ ID NO: 15077 - RNA, 19 nt, Artificial Sequence
  RNA Oligomer
uauccuguauacuccggga

SEQ ID NO: 15078 - RNA, 19 nt, Artificial Sequence
  RNA Oligomer
auacuccgggaguguuuuc

SEQ ID NO: 15079 - RNA, 19 nt, Artificial Sequence
  RNA Oligomer
aagcacgugauagccaaag

SEQ ID NO: 15080 - RNA, 19 nt, Artificial Sequence
  RNA Oligomer
cuugucaggucagcuuguc

SEQ ID NO: 15081 - RNA, 19 nt, Artificial Sequence
  RNA Oligomer
aguucucauaaugguggga

SEQ ID NO: 15082 - RNA, 19 nt, Artificial Sequence
  RNA Oligomer
uucucauaauggugggaga

SEQ ID NO: 15083 - RNA, 19 nt, Artificial Sequence
  RNA Oligomer
uacagcauagugguccuga

SEQ ID NO: 15084 - RNA, 19 nt, Artificial Sequence
  RNA Oligomer
auagugguccugaggucga

SEQ ID NO: 15085 - RNA, 19 nt, Artificial Sequence
  RNA Oligomer
augugcacagacaccaggu

SEQ ID NO: 15086 - RNA, 19 nt, Artificial Sequence
  RNA Oligomer
agccacucaaacugacgcu

SEQ ID NO: 15087 - RNA, 19 nt, Artificial Sequence
  RNA Oligomer
cagaucauauccuggcuga

SEQ ID NO: 15088 - RNA, 19 nt, Artificial Sequence
  RNA Oligomer
uauccuggcugauguagga

SEQ ID NO: 15089 - RNA, 19 nt, Artificial Sequence
  RNA Oligomer
uuguccuggaaucccgacu

SEQ ID NO: 15090 - RNA, 19 nt, Artificial Sequence
  RNA Oligomer
gaucucagcauccugauga

SEQ ID NO: 15091 - RNA, 19 nt, Artificial Sequence
  RNA Oligomer
ucaaagucguacaugcgga

SEQ ID NO: 15092 - RNA, 19 nt, Artificial Sequence
  RNA Oligomer
aagaccaccaggaugucca

SEQ ID NO: 15093 - RNA, 19 nt, Artificial Sequence
  RNA Oligomer
ggacuccacaaacaugucc

SEQ ID NO: 15094 - RNA, 19 nt, Artificial Sequence
  RNA Oligomer
gucaauguugauaacagcg

SEQ ID NO: 15095 - RNA, 19 nt, Artificial Sequence
  RNA Oligomer
aacagcccauuccuggugu

SEQ ID NO: 15096 - RNA, 19 nt, Artificial Sequence
  RNA Oligomer
cuagccaggauaaguccug

SEQ ID NO: 15097 - RNA, 19 nt, Artificial Sequence
  RNA Oligomer
agugcaggguugauguccu

SEQ ID NO: 15098 - RNA, 19 nt, Artificial Sequence
  RNA Oligomer
aauggccgguauccuguau

SEQ ID NO: 15099 - RNA, 19 nt, Artificial Sequence
  RNA Oligomer
uggccgguauccuguauac

SEQ ID NO: 15100 - RNA, 19 nt, Artificial Sequence
  RNA Oligomer
uguuucugaagucuggaag

SEQ ID NO: 15101 - RNA, 19 nt, Artificial Sequence
  RNA Oligomer
uggugacugacuauggcca

SEQ ID NO: 15102 - RNA, 19 nt, Artificial Sequence
  RNA Oligomer
aaaccucugcucaacuggg

SEQ ID NO: 15103 - RNA, 19 nt, Artificial Sequence
  RNA Oligomer
cuuuuccacauucuugguc

SEQ ID NO: 15104 - RNA, 19 nt, Artificial Sequence
  RNA Oligomer
cuccgguucagaaccuucu

SEQ ID NO: 15105 - RNA, 19 nt, Artificial Sequence
  RNA Oligomer
acccagaugaaguagaucu

SEQ ID NO: 15106 - RNA, 19 nt, Artificial Sequence
  RNA Oligomer
aaugguccaucaagguaca

SEQ ID NO: 15107 - RNA, 19 nt, Artificial Sequence
  RNA Oligomer
gaucagggcaaagcuacca

SEQ ID NO: 15108 - RNA, 19 nt, Artificial Sequence
  RNA Oligomer
cucagacccaucaucaugg

SEQ ID NO: 15109 - RNA, 19 nt, Artificial Sequence
  RNA Oligomer
ccaucaucauggaagaggc

SEQ ID NO: 15110 - RNA, 19 nt, Artificial Sequence
  RNA Oligomer
aucaucauggaagaggcca

SEQ ID NO: 15111 - RNA, 19 nt, Artificial Sequence
  RNA Oligomer
ucaucauggaagaggccag

SEQ ID NO: 15112 - RNA, 19 nt, Artificial Sequence
  RNA Oligomer
ucauacuccuuggggaucu

SEQ ID NO: 15113 - RNA, 19 nt, Artificial Sequence
  RNA Oligomer
ucuuugaggauggaggcaa

SEQ ID NO: 15114 - RNA, 19 nt, Artificial Sequence
  RNA Oligomer
cguuggaacuucucucggu

SEQ ID NO: 15115 - RNA, 21 nt, Artificial Sequence
  RNA Oligomer
ccaagaauuaaaccaagacaa

SEQ ID NO: 15116 - RNA, 21 nt, Artificial Sequence
  RNA Oligomer
cccaagaauuaaaccaagaca

SEQ ID NO: 15117 - RNA, 21 nt, Artificial Sequence
  RNA Oligomer
ggauugaagaauucaccauua

SEQ ID NO: 15118 - RNA, 21 nt, Artificial Sequence
  RNA Oligomer
ggacuguacccaagaauuaaa

SEQ ID NO: 15119 - RNA, 21 nt, Artificial Sequence
  RNA Oligomer
ccacacagaauuuuagucaau

SEQ ID NO: 15120 - RNA, 21 nt, Artificial Sequence
  RNA Oligomer
cguccaaguguguaaguuuuu

SEQ ID NO: 15121 - RNA, 21 nt, Artificial Sequence
  RNA Oligomer
cccaacuaaauuacugccuuu

SEQ ID NO: 15122 - RNA, 21 nt, Artificial Sequence
  RNA Oligomer
cgaagaaaggagaacgguguu

SEQ ID NO: 15123 - RNA, 21 nt, Artificial Sequence
  RNA Oligomer
cgguaccaguaauuagaugua

SEQ ID NO: 15124 - RNA, 21 nt, Artificial Sequence
  RNA Oligomer
gccucauguaacaacguccaa

SEQ ID NO: 15125 - RNA, 21 nt, Artificial Sequence
  RNA Oligomer
agaaaggagaacgguguuaau

SEQ ID NO: 15126 - RNA, 21 nt, Artificial Sequence
  RNA Oligomer
uguacccaagaauuaaaccaa

SEQ ID NO: 15127 - RNA, 21 nt, Artificial Sequence
  RNA Oligomer
ccacacagaaaucguuaaguu

SEQ ID NO: 15128 - RNA, 21 nt, Artificial Sequence
  RNA Oligomer
gcccaacuaaauuacugccuu

SEQ ID NO: 15129 - RNA, 21 nt, Artificial Sequence
  RNA Oligomer
acaccuuacuuccacccuuca

SEQ ID NO: 15130 - RNA, 21 nt, Artificial Sequence
  RNA Oligomer
acagagggaguguuugaauaa

SEQ ID NO: 15131 - RNA, 21 nt, Artificial Sequence
  RNA Oligomer
guaccaguaauuagauguaga

SEQ ID NO: 15132 - RNA, 21 nt, Artificial Sequence
  RNA Oligomer
gaccuuguacagagaauuauu

SEQ ID NO: 15133 - RNA, 21 nt, Artificial Sequence
  RNA Oligomer
cgcguugaccaagacucauac

SEQ ID NO: 15134 - RNA, 21 nt, Artificial Sequence
  RNA Oligomer
ggaguguuugaauaagcguaa

SEQ ID NO: 15135 - RNA, 21 nt, Artificial Sequence
  RNA Oligomer
gcugcagcuaagaaacaaauu

SEQ ID NO: 15136 - RNA, 21 nt, Artificial Sequence
  RNA Oligomer
ugaauaucgaagaaaggagaa

SEQ ID NO: 15137 - RNA, 21 nt, Artificial Sequence
  RNA Oligomer
agauaaguauacagcgacaau

SEQ ID NO: 15138 - RNA, 21 nt, Artificial Sequence
  RNA Oligomer
gacuguacccaagaauuaaac

SEQ ID NO: 15139 - RNA, 21 nt, Artificial Sequence
  RNA Oligomer
ggagaauuugaccuuguacag

SEQ ID NO: 15140 - RNA, 21 nt, Artificial Sequence
  RNA Oligomer
gucccaucauacccauccaag

SEQ ID NO: 15141 - RNA, 21 nt, Artificial Sequence
  RNA Oligomer
ugucccaucauacccauccaa

SEQ ID NO: 15142 - RNA, 21 nt, Artificial Sequence
  RNA Oligomer
ccaacuaaauuacugccuuuc

SEQ ID NO: 15143 - RNA, 21 nt, Artificial Sequence
  RNA Oligomer
gcgcguugaccaagacucaua

SEQ ID NO: 15144 - RNA, 21 nt, Artificial Sequence
  RNA Oligomer
gacaccuuacuuccacccuuc

SEQ ID NO: 15145 - RNA, 21 nt, Artificial Sequence
  RNA Oligomer
ccuuccaaagacaccuuacuu

SEQ ID NO: 15146 - RNA, 21 nt, Artificial Sequence
  RNA Oligomer
acauuaagccagacggaaguu

SEQ ID NO: 15147 - RNA, 21 nt, Artificial Sequence
  RNA Oligomer
ccaguuacuccagaaacaaua

SEQ ID NO: 15148 - RNA, 21 nt, Artificial Sequence
  RNA Oligomer
acaaauugaaucaagagcaga

SEQ ID NO: 15149 - RNA, 21 nt, Artificial Sequence
  RNA Oligomer
gcgcuuaaaguuuuugaaaca

SEQ ID NO: 15150 - RNA, 21 nt, Artificial Sequence
  RNA Oligomer
ggaacagcgcuuaaaguuuuu

SEQ ID NO: 15151 - RNA, 21 nt, Artificial Sequence
  RNA Oligomer
ccaguaauuagauguagaauc

SEQ ID NO: 15152 - RNA, 21 nt, Artificial Sequence
  RNA Oligomer
agagaaugaaggauugaagaa

SEQ ID NO: 15153 - RNA, 21 nt, Artificial Sequence
  RNA Oligomer
gaagagaaugaaggauugaag

SEQ ID NO: 15154 - RNA, 21 nt, Artificial Sequence
  RNA Oligomer
gcauaaugaauaaaggaguca

SEQ ID NO: 15155 - RNA, 21 nt, Artificial Sequence
  RNA Oligomer
ggccacacagaaaucguuaag

SEQ ID NO: 15156 - RNA, 21 nt, Artificial Sequence
  RNA Oligomer
ggaaugagggugaaauucaac

SEQ ID NO: 15157 - RNA, 21 nt, Artificial Sequence
  RNA Oligomer
cugucccaucauacccaucca

SEQ ID NO: 15158 - RNA, 21 nt, Artificial Sequence
  RNA Oligomer
gaaccaugaaaacgaaagaau

SEQ ID NO: 15159 - RNA, 21 nt, Artificial Sequence
  RNA Oligomer
guccuucaaaugcagaucuuu

SEQ ID NO: 15160 - RNA, 21 nt, Artificial Sequence
  RNA Oligomer
caacagagggaguguuugaau

SEQ ID NO: 15161 - RNA, 21 nt, Artificial Sequence
  RNA Oligomer
caaauugaaucaagagcagaa

SEQ ID NO: 15162 - RNA, 21 nt, Artificial Sequence
  RNA Oligomer
gcugugucaaaaguagaagaa

SEQ ID NO: 15163 - RNA, 21 nt, Artificial Sequence
  RNA Oligomer
caggaagcuaagcuaaaaaaa

SEQ ID NO: 15164 - RNA, 21 nt, Artificial Sequence
  RNA Oligomer
ucaggaagcuaagcuaaaaaa

SEQ ID NO: 15165 - RNA, 21 nt, Artificial Sequence
  RNA Oligomer
cuacgguaccaguaauuagau

SEQ ID NO: 15166 - RNA, 21 nt, Artificial Sequence
  RNA Oligomer
gaaugaaggauugaagaauuc

SEQ ID NO: 15167 - RNA, 21 nt, Artificial Sequence
  RNA Oligomer
ggcauaaugaauaaaggaguc

SEQ ID NO: 15168 - RNA, 21 nt, Artificial Sequence
  RNA Oligomer
gggcauaaugaauaaaggagu

SEQ ID NO: 15169 - RNA, 21 nt, Artificial Sequence
  RNA Oligomer
cgcuucuuccuucgucaugaa

SEQ ID NO: 15170 - RNA, 21 nt, Artificial Sequence
  RNA Oligomer
ggacuccauuacauugugcug

SEQ ID NO: 15171 - RNA, 21 nt, Artificial Sequence
  RNA Oligomer
guaaauguaaaugcugcugau

SEQ ID NO: 15172 - RNA, 21 nt, Artificial Sequence
  RNA Oligomer
gaaaucguuaaguuccuggua

SEQ ID NO: 15173 - RNA, 21 nt, Artificial Sequence
  RNA Oligomer
gagggagaauuugaccuugua

SEQ ID NO: 15174 - RNA, 21 nt, Artificial Sequence
  RNA Oligomer
ggagggagaauuugaccuugu

SEQ ID NO: 15175 - RNA, 21 nt, Artificial Sequence
  RNA Oligomer
gcggauaaugagcgaauguuu

SEQ ID NO: 15176 - RNA, 21 nt, Artificial Sequence
  RNA Oligomer
gaacauuuauuccaauagcca

SEQ ID NO: 15177 - RNA, 21 nt, Artificial Sequence
  RNA Oligomer
cagcacccagagaacauuuau

SEQ ID NO: 15178 - RNA, 21 nt, Artificial Sequence
  RNA Oligomer
ccagagggccacacuuuucaa

SEQ ID NO: 15179 - RNA, 21 nt, Artificial Sequence
  RNA Oligomer
gcguugaccaagacucauacc

SEQ ID NO: 15180 - RNA, 21 nt, Artificial Sequence
  RNA Oligomer
agacaccuuacuuccacccuu

SEQ ID NO: 15181 - RNA, 21 nt, Artificial Sequence
  RNA Oligomer
gugguggaucugugcaaagaa

SEQ ID NO: 15182 - RNA, 21 nt, Artificial Sequence
  RNA Oligomer
caguuacuccagaaacaauau

SEQ ID NO: 15183 - RNA, 21 nt, Artificial Sequence
  RNA Oligomer
uggaagaagaaggcagcucua

SEQ ID NO: 15184 - RNA, 21 nt, Artificial Sequence
  RNA Oligomer
ggaacagaagagacuaagcaa

SEQ ID NO: 15185 - RNA, 21 nt, Artificial Sequence
  RNA Oligomer
ggagaaacuuaaaaggcuaaa

SEQ ID NO: 15186 - RNA, 21 nt, Artificial Sequence
  RNA Oligomer
gaaaggagaacgguguuaaua

SEQ ID NO: 15187 - RNA, 21 nt, Artificial Sequence
  RNA Oligomer
gguaccaguaauuagauguag

SEQ ID NO: 15188 - RNA, 21 nt, Artificial Sequence
  RNA Oligomer
gaaacuaagcuacgguaccag

SEQ ID NO: 15189 - RNA, 21 nt, Artificial Sequence
  RNA Oligomer
cagauaaguauacagcgacaa

SEQ ID NO: 15190 - RNA, 21 nt, Artificial Sequence
  RNA Oligomer
gaagaugggcauaaugaauaa

SEQ ID NO: 15191 - RNA, 21 nt, Artificial Sequence
  RNA Oligomer
guguaaguuuuugguggaguc

SEQ ID NO: 15192 - RNA, 21 nt, Artificial Sequence
  RNA Oligomer
ucauguaacaacguccaagug

SEQ ID NO: 15193 - RNA, 21 nt, Artificial Sequence
  RNA Oligomer
gaauuugaccuuguacagaga

SEQ ID NO: 15194 - RNA, 21 nt, Artificial Sequence
  RNA Oligomer
ucauggaaugagggugaaauu

SEQ ID NO: 15195 - RNA, 21 nt, Artificial Sequence
  RNA Oligomer
ggacaaacuugcguaaaacug

SEQ ID NO: 15196 - RNA, 21 nt, Artificial Sequence
  RNA Oligomer
aggacaaacuugcguaaaacu

SEQ ID NO: 15197 - RNA, 21 nt, Artificial Sequence
  RNA Oligomer
gaggcuccacaugugcuugau

SEQ ID NO: 15198 - RNA, 21 nt, Artificial Sequence
  RNA Oligomer
caacuaaauuacugccuuucu

SEQ ID NO: 15199 - RNA, 21 nt, Artificial Sequence
  RNA Oligomer
gccuuauuuuggacaaacuaa

SEQ ID NO: 15200 - RNA, 21 nt, Artificial Sequence
  RNA Oligomer
ccuacaaaaccaaaacagauu

SEQ ID NO: 15201 - RNA, 21 nt, Artificial Sequence
  RNA Oligomer
cagguugcaaauaaaaaugug

SEQ ID NO: 15202 - RNA, 21 nt, Artificial Sequence
  RNA Oligomer
ccagagcagugaagauaucuu

SEQ ID NO: 15203 - RNA, 21 nt, Artificial Sequence
  RNA Oligomer
gggaaugcucuggaucaaguu

SEQ ID NO: 15204 - RNA, 21 nt, Artificial Sequence
  RNA Oligomer
ggaguccuucaaaugcagauc

SEQ ID NO: 15205 - RNA, 21 nt, Artificial Sequence
  RNA Oligomer
ccagaaacaauaugcagagac

SEQ ID NO: 15206 - RNA, 21 nt, Artificial Sequence
  RNA Oligomer
gaauaagcguaauucagaagu

SEQ ID NO: 15207 - RNA, 21 nt, Artificial Sequence
  RNA Oligomer
gaguguuugaauaagcguaau

SEQ ID NO: 15208 - RNA, 21 nt, Artificial Sequence
  RNA Oligomer
gcagcuaagaaacaaauugaa

SEQ ID NO: 15209 - RNA, 21 nt, Artificial Sequence
  RNA Oligomer
caaaaguagaagaacugacca

SEQ ID NO: 15210 - RNA, 21 nt, Artificial Sequence
  RNA Oligomer
gugucaaaaguagaagaacug

SEQ ID NO: 15211 - RNA, 21 nt, Artificial Sequence
  RNA Oligomer
ggcugugucaaaaguagaaga

SEQ ID NO: 15212 - RNA, 21 nt, Artificial Sequence
  RNA Oligomer
gaggaaauugaacagaugaau

SEQ ID NO: 15213 - RNA, 21 nt, Artificial Sequence
  RNA Oligomer
ggaggaaauugaacagaugaa

SEQ ID NO: 15214 - RNA, 21 nt, Artificial Sequence
  RNA Oligomer
caacaagaucagcgacaacag

SEQ ID NO: 15215 - RNA, 21 nt, Artificial Sequence
  RNA Oligomer
caacagauugaagcccagcaa

SEQ ID NO: 15216 - RNA, 21 nt, Artificial Sequence
  RNA Oligomer
gaucugacucuugcugaacuu

SEQ ID NO: 15217 - RNA, 21 nt, Artificial Sequence
  RNA Oligomer
cgguguuaauaguccuaggau

SEQ ID NO: 15218 - RNA, 21 nt, Artificial Sequence
  RNA Oligomer
aagaaaggagaacgguguuaa

SEQ ID NO: 15219 - RNA, 21 nt, Artificial Sequence
  RNA Oligomer
gaagaaaggagaacgguguua

SEQ ID NO: 15220 - RNA, 21 nt, Artificial Sequence
  RNA Oligomer
acgguaccaguaauuagaugu

SEQ ID NO: 15221 - RNA, 21 nt, Artificial Sequence
  RNA Oligomer
gaaauaaagcaucuacgucag

SEQ ID NO: 15222 - RNA, 21 nt, Artificial Sequence
  RNA Oligomer
ggacauuuagcgugaugaaau

SEQ ID NO: 15223 - RNA, 21 nt, Artificial Sequence
  RNA Oligomer
gagaaugaaggauugaagaau

SEQ ID NO: 15224 - RNA, 21 nt, Artificial Sequence
  RNA Oligomer
agaagagaaugaaggauugaa

SEQ ID NO: 15225 - RNA, 21 nt, Artificial Sequence
  RNA Oligomer
cuagaagagaaugaaggauug

SEQ ID NO: 15226 - RNA, 21 nt, Artificial Sequence
  RNA Oligomer
acaaaggagcuuggccugaaa

SEQ ID NO: 15227 - RNA, 21 nt, Artificial Sequence
  RNA Oligomer
caaguguguaaguuuuuggug

SEQ ID NO: 15228 - RNA, 21 nt, Artificial Sequence
  RNA Oligomer
acguccaaguguguaaguuuu

SEQ ID NO: 15229 - RNA, 21 nt, Artificial Sequence
  RNA Oligomer
aacguccaaguguguaaguuu

SEQ ID NO: 15230 - RNA, 21 nt, Artificial Sequence
  RNA Oligomer
cucauguaacaacguccaagu

SEQ ID NO: 15231 - RNA, 21 nt, Artificial Sequence
  RNA Oligomer
gccacacagaaaucguuaagu

SEQ ID NO: 15232 - RNA, 21 nt, Artificial Sequence
  RNA Oligomer
ugaccuuguacagagaauuau

SEQ ID NO: 15233 - RNA, 21 nt, Artificial Sequence
  RNA Oligomer
cuuacgaaagaaacugucuaa

SEQ ID NO: 15234 - RNA, 21 nt, Artificial Sequence
  RNA Oligomer
gccuuucuuaucuaauccuua

SEQ ID NO: 15235 - RNA, 21 nt, Artificial Sequence
  RNA Oligomer
agaaccaugaaaacgaaagaa

SEQ ID NO: 15236 - RNA, 21 nt, Artificial Sequence
  RNA Oligomer
gcucagguugcaaauaaaaau

SEQ ID NO: 15237 - RNA, 21 nt, Artificial Sequence
  RNA Oligomer
gaaccagagcagugaagauau

SEQ ID NO: 15238 - RNA, 21 nt, Artificial Sequence
  RNA Oligomer
agagaagaaagugcguccguu

SEQ ID NO: 15239 - RNA, 21 nt, Artificial Sequence
  RNA Oligomer
gacgugguggaucugugcaaa

SEQ ID NO: 15240 - RNA, 21 nt, Artificial Sequence
  RNA Oligomer
cucuacagcaaaaagaaaauc

SEQ ID NO: 15241 - RNA, 21 nt, Artificial Sequence
  RNA Oligomer
gucauggauaagcguguuaau

SEQ ID NO: 15242 - RNA, 21 nt, Artificial Sequence
  RNA Oligomer
gcagucauggauaagcguguu

SEQ ID NO: 15243 - RNA, 21 nt, Artificial Sequence
  RNA Oligomer
cuacaacaacagagggagugu

SEQ ID NO: 15244 - RNA, 21 nt, Artificial Sequence
  RNA Oligomer
gaagcuaagcuaaaaaaagug

SEQ ID NO: 15245 - RNA, 21 nt, Artificial Sequence
  RNA Oligomer
ggaagcuaagcuaaaaaaagu

SEQ ID NO: 15246 - RNA, 21 nt, Artificial Sequence
  RNA Oligomer
aaacaacaagaucagcgacaa

SEQ ID NO: 15247 - RNA, 21 nt, Artificial Sequence
  RNA Oligomer
aggagaacgguguuaauaguc

SEQ ID NO: 15248 - RNA, 21 nt, Artificial Sequence
  RNA Oligomer
gaacuguuaguugguugucag

SEQ ID NO: 15249 - RNA, 21 nt, Artificial Sequence
  RNA Oligomer
gugaauaucgaagaaaggaga

SEQ ID NO: 15250 - RNA, 21 nt, Artificial Sequence
  RNA Oligomer
gguguaaaaguuccuggugaa

SEQ ID NO: 15251 - RNA, 21 nt, Artificial Sequence
  RNA Oligomer
cacacagaauuuuagucaaug

SEQ ID NO: 15252 - RNA, 21 nt, Artificial Sequence
  RNA Oligomer
uccacacagaauuuuagucaa

SEQ ID NO: 15253 - RNA, 21 nt, Artificial Sequence
  RNA Oligomer
cguaacuugcugggacuguac

SEQ ID NO: 15254 - RNA, 21 nt, Artificial Sequence
  RNA Oligomer
ccacagggaagacgaagauga

SEQ ID NO: 15255 - RNA, 21 nt, Artificial Sequence
  RNA Oligomer
ggagucauuuaugcgcuuugg

SEQ ID NO: 15256 - RNA, 21 nt, Artificial Sequence
  RNA Oligomer
aaaggagucauuuaugcgcuu

SEQ ID NO: 15257 - RNA, 21 nt, Artificial Sequence
  RNA Oligomer
guguguaaguuuuugguggag

SEQ ID NO: 15258 - RNA, 21 nt, Artificial Sequence
  RNA Oligomer
ugccucauguaacaacgucca

SEQ ID NO: 15259 - RNA, 21 nt, Artificial Sequence
  RNA Oligomer
uugaccuuguacagagaauua

SEQ ID NO: 15260 - RNA, 21 nt, Artificial Sequence
  RNA Oligomer
agggagaauuugaccuuguac

SEQ ID NO: 15261 - RNA, 21 nt, Artificial Sequence
  RNA Oligomer
ucgucuuuggagggagaauuu

SEQ ID NO: 15262 - RNA, 21 nt, Artificial Sequence
  RNA Oligomer
ucucugucccaucauacccau

SEQ ID NO: 15263 - RNA, 21 nt, Artificial Sequence
  RNA Oligomer
gagcgaauguuugauguucuu

SEQ ID NO: 15264 - RNA, 21 nt, Artificial Sequence
  RNA Oligomer
ccuuaccgaaaccagagugau

SEQ ID NO: 15265 - RNA, 21 nt, Artificial Sequence
  RNA Oligomer
gcaggcgccaggaaaaaacuu

SEQ ID NO: 15266 - RNA, 21 nt, Artificial Sequence
  RNA Oligomer
gcaaguucaauauauuccaug

SEQ ID NO: 15267 - RNA, 21 nt, Artificial Sequence
  RNA Oligomer
uggcagcaaguucaauauauu

SEQ ID NO: 15268 - RNA, 21 nt, Artificial Sequence
  RNA Oligomer
ccguggcagcaaguucaauau

SEQ ID NO: 15269 - RNA, 21 nt, Artificial Sequence
  RNA Oligomer
uccuacaaaaccaaaacagau

SEQ ID NO: 15270 - RNA, 21 nt, Artificial Sequence
  RNA Oligomer
ccuuugguacucugaggaaga

SEQ ID NO: 15271 - RNA, 21 nt, Artificial Sequence
  RNA Oligomer
gcucugcuucuguaccucaaa

SEQ ID NO: 15272 - RNA, 21 nt, Artificial Sequence
  RNA Oligomer
caaaugcagaucuuuucccaa

SEQ ID NO: 15273 - RNA, 21 nt, Artificial Sequence
  RNA Oligomer
cuaaaggcucuaaaauccauc

SEQ ID NO: 15274 - RNA, 21 nt, Artificial Sequence
  RNA Oligomer
gccgaugaaaauacagacacu

SEQ ID NO: 15275 - RNA, 21 nt, Artificial Sequence
  RNA Oligomer
ggaagaagaaggcagcucuac

SEQ ID NO: 15276 - RNA, 21 nt, Artificial Sequence
  RNA Oligomer
guagaagaacugaccaggcag

SEQ ID NO: 15277 - RNA, 21 nt, Artificial Sequence
  RNA Oligomer
gcuaagcuaaaaaaagugaga

SEQ ID NO: 15278 - RNA, 21 nt, Artificial Sequence
  RNA Oligomer
cguguaucucaguaacaauga

SEQ ID NO: 15279 - RNA, 21 nt, Artificial Sequence
  RNA Oligomer
ggaucugacucuugcugaacu

SEQ ID NO: 15280 - RNA, 21 nt, Artificial Sequence
  RNA Oligomer
ccuaggauggaucugacucuu

SEQ ID NO: 15281 - RNA, 21 nt, Artificial Sequence
  RNA Oligomer
gaaucuuguuuguaggcugaa

SEQ ID NO: 15282 - RNA, 21 nt, Artificial Sequence
  RNA Oligomer
uguuaguugguugucagugaa

SEQ ID NO: 15283 - RNA, 21 nt, Artificial Sequence
  RNA Oligomer
ggcacugcacacuuguauauu

SEQ ID NO: 15284 - RNA, 21 nt, Artificial Sequence
  RNA Oligomer
ccuggugaauaucgaagaaag

SEQ ID NO: 15285 - RNA, 21 nt, Artificial Sequence
  RNA Oligomer
uccuggugaauaucgaagaaa

SEQ ID NO: 15286 - RNA, 21 nt, Artificial Sequence
  RNA Oligomer
ggaucauuuauugggcaguug

SEQ ID NO: 15287 - RNA, 21 nt, Artificial Sequence
  RNA Oligomer
ucagauaaguauacagcgaca

SEQ ID NO: 15288 - RNA, 21 nt, Artificial Sequence
  RNA Oligomer
gauugaagaauucaccauuag

SEQ ID NO: 15289 - RNA, 21 nt, Artificial Sequence
  RNA Oligomer
aggagucauuuaugcgcuuug

SEQ ID NO: 15290 - RNA, 21 nt, Artificial Sequence
  RNA Oligomer
aaggagucauuuaugcgcuuu

SEQ ID NO: 15291 - RNA, 21 nt, Artificial Sequence
  RNA Oligomer
ggagaagaugggcauaaugaa

SEQ ID NO: 15292 - RNA, 21 nt, Artificial Sequence
  RNA Oligomer
ucaggagaagaugggcauaau

SEQ ID NO: 15293 - RNA, 21 nt, Artificial Sequence
  RNA Oligomer
cgaggaaauggaggaaggcua

SEQ ID NO: 15294 - RNA, 21 nt, Artificial Sequence
  RNA Oligomer
aguguguaaguuuuuggugga

SEQ ID NO: 15295 - RNA, 21 nt, Artificial Sequence
  RNA Oligomer
caacguccaaguguguaaguu

SEQ ID NO: 15296 - RNA, 21 nt, Artificial Sequence
  RNA Oligomer
aggccacacagaaaucguuaa

SEQ ID NO: 15297 - RNA, 21 nt, Artificial Sequence
  RNA Oligomer
uggaaugagggugaaauucaa

SEQ ID NO: 15298 - RNA, 21 nt, Artificial Sequence
  RNA Oligomer
aaggacaaacuugcguaaaac

SEQ ID NO: 15299 - RNA, 21 nt, Artificial Sequence
  RNA Oligomer
aggcuccacaugugcuugaug

SEQ ID NO: 15300 - RNA, 21 nt, Artificial Sequence
  RNA Oligomer
acagcccaaaucuccagaaua

SEQ ID NO: 15301 - RNA, 21 nt, Artificial Sequence
  RNA Oligomer
gccaaauauucagaagcuuuu

SEQ ID NO: 15302 - RNA, 21 nt, Artificial Sequence
  RNA Oligomer
agaaacguaguucuauuacag

SEQ ID NO: 15303 - RNA, 21 nt, Artificial Sequence
  RNA Oligomer
ccuuacgaaagaaacugucua

SEQ ID NO: 15304 - RNA, 21 nt, Artificial Sequence
  RNA Oligomer
guauaugguaagccuguaauu

SEQ ID NO: 15305 - RNA, 21 nt, Artificial Sequence
  RNA Oligomer
cucagguugcaaauaaaaaug

SEQ ID NO: 15306 - RNA, 21 nt, Artificial Sequence
  RNA Oligomer
caaguugaugauggagagguu

SEQ ID NO: 15307 - RNA, 21 nt, Artificial Sequence
  RNA Oligomer
agacgugguggaucugugcaa

SEQ ID NO: 15308 - RNA, 21 nt, Artificial Sequence
  RNA Oligomer
uccuucaaaugcagaucuuuu

SEQ ID NO: 15309 - RNA, 21 nt, Artificial Sequence
  RNA Oligomer
cugauuggaguccuucaaaug

SEQ ID NO: 15310 - RNA, 21 nt, Artificial Sequence
  RNA Oligomer
guuucaucugauggaaaucuu

SEQ ID NO: 15311 - RNA, 21 nt, Artificial Sequence
  RNA Oligomer
caguuucaucugauggaaauc

SEQ ID NO: 15312 - RNA, 21 nt, Artificial Sequence
  RNA Oligomer
guggaagaagaaggcagcucu

SEQ ID NO: 15313 - RNA, 21 nt, Artificial Sequence
  RNA Oligomer
ggauaagcguguuaaugagcu

SEQ ID NO: 15314 - RNA, 21 nt, Artificial Sequence
  RNA Oligomer
gggaguguuugaauaagcgua

SEQ ID NO: 15315 - RNA, 21 nt, Artificial Sequence
  RNA Oligomer
acaacagagggaguguuugaa

SEQ ID NO: 15316 - RNA, 21 nt, Artificial Sequence
  RNA Oligomer
agcuacaacaacagagggagu

SEQ ID NO: 15317 - RNA, 21 nt, Artificial Sequence
  RNA Oligomer
ucacagaaguuccaguuacuc

SEQ ID NO: 15318 - RNA, 21 nt, Artificial Sequence
  RNA Oligomer
cacguggaacagaagagacua

SEQ ID NO: 15319 - RNA, 21 nt, Artificial Sequence
  RNA Oligomer
agcuaagcuaaaaaaagugag

SEQ ID NO: 15320 - RNA, 21 nt, Artificial Sequence
  RNA Oligomer
aucaggaagcuaagcuaaaaa

SEQ ID NO: 15321 - RNA, 21 nt, Artificial Sequence
  RNA Oligomer
caggagaaacuuaaaaggcua

SEQ ID NO: 15322 - RNA, 21 nt, Artificial Sequence
  RNA Oligomer
gcugagcaggagaaacuuaaa

SEQ ID NO: 15323 - RNA, 21 nt, Artificial Sequence
  RNA Oligomer
cagcgcuuaaaguuuuugaaa

SEQ ID NO: 15324 - RNA, 21 nt, Artificial Sequence
  RNA Oligomer
acagcgcuuaaaguuuuugaa

SEQ ID NO: 15325 - RNA, 21 nt, Artificial Sequence
  RNA Oligomer
uggaucugacucuugcugaac

SEQ ID NO: 15326 - RNA, 21 nt, Artificial Sequence
  RNA Oligomer
gaguuuuuguagcaucuuaag

SEQ ID NO: 15327 - RNA, 21 nt, Artificial Sequence
  RNA Oligomer
gcacacuuguauauugucagu

SEQ ID NO: 15328 - RNA, 21 nt, Artificial Sequence
  RNA Oligomer
gcgacaauccuguuuucuaca

SEQ ID NO: 15329 - RNA, 21 nt, Artificial Sequence
  RNA Oligomer
guguaaaaguuccuggugaau

SEQ ID NO: 15330 - RNA, 21 nt, Artificial Sequence
  RNA Oligomer
ucuagaagagaaugaaggauu

SEQ ID NO: 15331 - RNA, 21 nt, Artificial Sequence
  RNA Oligomer
ggauuaugaaccucagaauga

SEQ ID NO: 15332 - RNA, 21 nt, Artificial Sequence
  RNA Oligomer
agaugggcauaaugaauaaag

SEQ ID NO: 15333 - RNA, 21 nt, Artificial Sequence
  RNA Oligomer
acauugugaguggaccaagau

SEQ ID NO: 15334 - RNA, 21 nt, Artificial Sequence
  RNA Oligomer
gaaauggaggaaggcuacacu

SEQ ID NO: 15335 - RNA, 21 nt, Artificial Sequence
  RNA Oligomer
acaacguccaaguguguaagu

SEQ ID NO: 15336 - RNA, 21 nt, Artificial Sequence
  RNA Oligomer
uggacuccauuacauugugcu

SEQ ID NO: 15337 - RNA, 21 nt, Artificial Sequence
  RNA Oligomer
gguguaaauguaaaugcugcu

SEQ ID NO: 15338 - RNA, 21 nt, Artificial Sequence
  RNA Oligomer
cacacagaaaucguuaaguuc

SEQ ID NO: 15339 - RNA, 21 nt, Artificial Sequence
  RNA Oligomer
gggagaauuugaccuuguaca

SEQ ID NO: 15340 - RNA, 21 nt, Artificial Sequence
  RNA Oligomer
ggcuccacaugugcuugaugu

SEQ ID NO: 15341 - RNA, 21 nt, Artificial Sequence
  RNA Oligomer
cucagaaagcccaguagaaau

SEQ ID NO: 15342 - RNA, 21 nt, Artificial Sequence
  RNA Oligomer
accaucucugucccaucauac

SEQ ID NO: 15343 - RNA, 21 nt, Artificial Sequence
  RNA Oligomer
cuaaugggccaaauauucaga

SEQ ID NO: 15344 - RNA, 21 nt, Artificial Sequence
  RNA Oligomer
cucuaaagaaacguaguucua

SEQ ID NO: 15345 - RNA, 21 nt, Artificial Sequence
  RNA Oligomer
cuagaagccuuacgaaagaaa

SEQ ID NO: 15346 - RNA, 21 nt, Artificial Sequence
  RNA Oligomer
ccuagaagccuuacgaaagaa

SEQ ID NO: 15347 - RNA, 21 nt, Artificial Sequence
  RNA Oligomer
gagaaccaugaaaacgaaaga

SEQ ID NO: 15348 - RNA, 21 nt, Artificial Sequence
  RNA Oligomer
agcacccagagaacauuuauu

SEQ ID NO: 15349 - RNA, 21 nt, Artificial Sequence
  RNA Oligomer
guguauaugguaagccuguaa

SEQ ID NO: 15350 - RNA, 21 nt, Artificial Sequence
  RNA Oligomer
ggcagcaaguucaauauauuc

SEQ ID NO: 15351 - RNA, 21 nt, Artificial Sequence
  RNA Oligomer
agacggaaguucucagcaguu

SEQ ID NO: 15352 - RNA, 21 nt, Artificial Sequence
  RNA Oligomer
accagagcagugaagauaucu

SEQ ID NO: 15353 - RNA, 21 nt, Artificial Sequence
  RNA Oligomer
gcguccguucucaauguuuga

SEQ ID NO: 15354 - RNA, 21 nt, Artificial Sequence
  RNA Oligomer
gugcguccguucucaauguuu

SEQ ID NO: 15355 - RNA, 21 nt, Artificial Sequence
  RNA Oligomer
gcugagggagaaagagaagaa

SEQ ID NO: 15356 - RNA, 21 nt, Artificial Sequence
  RNA Oligomer
gaguccuucaaaugcagaucu

SEQ ID NO: 15357 - RNA, 21 nt, Artificial Sequence
  RNA Oligomer
gucgucuacuaugccucggau

SEQ ID NO: 15358 - RNA, 21 nt, Artificial Sequence
  RNA Oligomer
gcguguuaaugagcugaggga

SEQ ID NO: 15359 - RNA, 21 nt, Artificial Sequence
  RNA Oligomer
cagucauggauaagcguguua

SEQ ID NO: 15360 - RNA, 21 nt, Artificial Sequence
  RNA Oligomer
cagaaguggcagucauggaua

SEQ ID NO: 15361 - RNA, 21 nt, Artificial Sequence
  RNA Oligomer
guaauucagaaguggcaguca

SEQ ID NO: 15362 - RNA, 21 nt, Artificial Sequence
  RNA Oligomer
agagggaguguuugaauaagc

SEQ ID NO: 15363 - RNA, 21 nt, Artificial Sequence
  RNA Oligomer
cugugucaaaaguagaagaac

SEQ ID NO: 15364 - RNA, 21 nt, Artificial Sequence
  RNA Oligomer
gaagagacuaagcaaugggaa

SEQ ID NO: 15365 - RNA, 21 nt, Artificial Sequence
  RNA Oligomer
cuaagcuaaaaaaagugagag

SEQ ID NO: 15366 - RNA, 21 nt, Artificial Sequence
  RNA Oligomer
agaaucaggaagcuaagcuaa

SEQ ID NO: 15367 - RNA, 21 nt, Artificial Sequence
  RNA Oligomer
aggagaaacuuaaaaggcuaa

SEQ ID NO: 15368 - RNA, 21 nt, Artificial Sequence
  RNA Oligomer
guccaagaugaugccgauguu

SEQ ID NO: 15369 - RNA, 21 nt, Artificial Sequence
  RNA Oligomer
ugaaacaacaagaucagcgac

SEQ ID NO: 15370 - RNA, 21 nt, Artificial Sequence
  RNA Oligomer
gcaacagauugaagcccagca

SEQ ID NO: 15371 - RNA, 21 nt, Artificial Sequence
  RNA Oligomer
gaacuucaggaaauggcaucu

SEQ ID NO: 15372 - RNA, 21 nt, Artificial Sequence
  RNA Oligomer
aggauggaucugacucuugcu

SEQ ID NO: 15373 - RNA, 21 nt, Artificial Sequence
  RNA Oligomer
cuaggauggaucugacucuug

SEQ ID NO: 15374 - RNA, 21 nt, Artificial Sequence
  RNA Oligomer
agaaucuuguuuguaggcuga

SEQ ID NO: 15375 - RNA, 21 nt, Artificial Sequence
  RNA Oligomer
gaagaacuguuaguugguugu

SEQ ID NO: 15376 - RNA, 21 nt, Artificial Sequence
  RNA Oligomer
aggaucauuuauugggcaguu

SEQ ID NO: 15377 - RNA, 21 nt, Artificial Sequence
  RNA Oligomer
cucagauaaguauacagcgac

SEQ ID NO: 15378 - RNA, 21 nt, Artificial Sequence
  RNA Oligomer
guaaaaguuccuggugaauau

SEQ ID NO: 15379 - RNA, 21 nt, Artificial Sequence
  RNA Oligomer
gacauuuagcgugaugaaaua

SEQ ID NO: 15380 - RNA, 21 nt, Artificial Sequence
  RNA Oligomer
gaggacauuuagcgugaugaa

SEQ ID NO: 15381 - RNA, 21 nt, Artificial Sequence
  RNA Oligomer
acguaacuugcugggacugua

SEQ ID NO: 15382 - RNA, 21 nt, Artificial Sequence
  RNA Oligomer
caauuucuuuauggaguucag

SEQ ID NO: 15383 - RNA, 21 nt, Artificial Sequence
  RNA Oligomer
cagugcucccaauuucuuuau

SEQ ID NO: 15384 - RNA, 21 nt, Artificial Sequence
  RNA Oligomer
ggaaauggaggaaggcuacac

SEQ ID NO: 15385 - RNA, 21 nt, Artificial Sequence
  RNA Oligomer
gugcuugauguguaccuggag

SEQ ID NO: 15386 - RNA, 21 nt, Artificial Sequence
  RNA Oligomer
acgauuuggaagucagaggaa

SEQ ID NO: 15387 - RNA, 21 nt, Artificial Sequence
  RNA Oligomer
ccaaaucuccagaauaaccca

SEQ ID NO: 15388 - RNA, 21 nt, Artificial Sequence
  RNA Oligomer
ggaaugccaguacagagaaca

SEQ ID NO: 15389 - RNA, 21 nt, Artificial Sequence
  RNA Oligomer
gaaacguaguucuauuacaga

SEQ ID NO: 15390 - RNA, 21 nt, Artificial Sequence
  RNA Oligomer
gaaacugucuaacgcaccaag

SEQ ID NO: 15391 - RNA, 21 nt, Artificial Sequence
  RNA Oligomer
agagugaugcugaccuagaag

SEQ ID NO: 15392 - RNA, 21 nt, Artificial Sequence
  RNA Oligomer
cagagugaugcugaccuagaa

SEQ ID NO: 15393 - RNA, 21 nt, Artificial Sequence
  RNA Oligomer
ucuuaucuaauccuuaccgaa

SEQ ID NO: 15394 - RNA, 21 nt, Artificial Sequence
  RNA Oligomer
ggagaaccaugaaaacgaaag

SEQ ID NO: 15395 - RNA, 21 nt, Artificial Sequence
  RNA Oligomer
cagaaucaacagcagcaccca

SEQ ID NO: 15396 - RNA, 21 nt, Artificial Sequence
  RNA Oligomer
guaauugcugcugcccagaau

SEQ ID NO: 15397 - RNA, 21 nt, Artificial Sequence
  RNA Oligomer
cguggcagcaaguucaauaua

SEQ ID NO: 15398 - RNA, 21 nt, Artificial Sequence
  RNA Oligomer
gacaaacuaaucagccaccuu

SEQ ID NO: 15399 - RNA, 21 nt, Artificial Sequence
  RNA Oligomer
ucaauguuugaugcaguagac

SEQ ID NO: 15400 - RNA, 21 nt, Artificial Sequence
  RNA Oligomer
ccguucucaauguuugaugca

SEQ ID NO: 15401 - RNA, 21 nt, Artificial Sequence
  RNA Oligomer
agugcguccguucucaauguu

SEQ ID NO: 15402 - RNA, 21 nt, Artificial Sequence
  RNA Oligomer
acgugguggaucugugcaaag

SEQ ID NO: 15403 - RNA, 21 nt, Artificial Sequence
  RNA Oligomer
ucaaaugcagaucuuuuccca

SEQ ID NO: 15404 - RNA, 21 nt, Artificial Sequence
  RNA Oligomer
ccgaugaaaauacagacacug

SEQ ID NO: 15405 - RNA, 21 nt, Artificial Sequence
  RNA Oligomer
ggccgaugaaaauacagacac

SEQ ID NO: 15406 - RNA, 21 nt, Artificial Sequence
  RNA Oligomer
gggccgaugaaaauacagaca

SEQ ID NO: 15407 - RNA, 21 nt, Artificial Sequence
  RNA Oligomer
aggcagcucuacagcaaaaag

SEQ ID NO: 15408 - RNA, 21 nt, Artificial Sequence
  RNA Oligomer
aaggcagcucuacagcaaaaa

SEQ ID NO: 15409 - RNA, 21 nt, Artificial Sequence
  RNA Oligomer
cguguuaaugagcugagggac

SEQ ID NO: 15410 - RNA, 21 nt, Artificial Sequence
  RNA Oligomer
gaaguggcagucauggauaag

SEQ ID NO: 15411 - RNA, 21 nt, Artificial Sequence
  RNA Oligomer
cguaauucagaaguggcaguc

SEQ ID NO: 15412 - RNA, 21 nt, Artificial Sequence
  RNA Oligomer
gcguaauucagaaguggcagu

SEQ ID NO: 15413 - RNA, 21 nt, Artificial Sequence
  RNA Oligomer
agcguaauucagaaguggcag

SEQ ID NO: 15414 - RNA, 21 nt, Artificial Sequence
  RNA Oligomer
agggaguguuugaauaagcgu

SEQ ID NO: 15415 - RNA, 21 nt, Artificial Sequence
  RNA Oligomer
uggcugugucaaaaguagaag

SEQ ID NO: 15416 - RNA, 21 nt, Artificial Sequence
  RNA Oligomer
ccuggcugugucaaaaguaga

SEQ ID NO: 15417 - RNA, 21 nt, Artificial Sequence
  RNA Oligomer
gagaaucaggaagcuaagcua

SEQ ID NO: 15418 - RNA, 21 nt, Artificial Sequence
  RNA Oligomer
ccguguaucucaguaacaaug

SEQ ID NO: 15419 - RNA, 21 nt, Artificial Sequence
  RNA Oligomer
acgguguuaauaguccuagga

SEQ ID NO: 15420 - RNA, 21 nt, Artificial Sequence
  RNA Oligomer
agaaacuugcuacagacuuac

SEQ ID NO: 15421 - RNA, 21 nt, Artificial Sequence
  RNA Oligomer
cucagaaauuagaaacuugcu

SEQ ID NO: 15422 - RNA, 21 nt, Artificial Sequence
  RNA Oligomer
ugaagaacuguuaguugguug

SEQ ID NO: 15423 - RNA, 21 nt, Artificial Sequence
  RNA Oligomer
cuggugaauaucgaagaaagg

SEQ ID NO: 15424 - RNA, 21 nt, Artificial Sequence
  RNA Oligomer
cugucuaguaaauaggaucau

SEQ ID NO: 15425 - RNA, 21 nt, Artificial Sequence
  RNA Oligomer
uagcgugaugaaauaaagcau

SEQ ID NO: 15426 - RNA, 21 nt, Artificial Sequence
  RNA Oligomer
ccauuagaggacauuuagcgu

SEQ ID NO: 15427 - RNA, 21 nt, Artificial Sequence
  RNA Oligomer
ggacauugugaguggaccaag

SEQ ID NO: 15428 - RNA, 21 nt, Artificial Sequence
  RNA Oligomer
cagcccaaaucuccagaauaa

SEQ ID NO: 15429 - RNA, 21 nt, Artificial Sequence
  RNA Oligomer
caacagcccaaaucuccagaa

SEQ ID NO: 15430 - RNA, 21 nt, Artificial Sequence
  RNA Oligomer
ugagcgaauguuugauguucu

SEQ ID NO: 15431 - RNA, 21 nt, Artificial Sequence
  RNA Oligomer
ugccuuucuuaucuaauccuu

SEQ ID NO: 15432 - RNA, 21 nt, Artificial Sequence
  RNA Oligomer
ggauaaugagcgaauguuuga

SEQ ID NO: 15433 - RNA, 21 nt, Artificial Sequence
  RNA Oligomer
cagagcagugaagauaucuug

SEQ ID NO: 15434 - RNA, 21 nt, Artificial Sequence
  RNA Oligomer
ccuucaaaugcagaucuuuuc

SEQ ID NO: 15435 - RNA, 21 nt, Artificial Sequence
  RNA Oligomer
agaaacaauaugcagagacgu

SEQ ID NO: 15436 - RNA, 21 nt, Artificial Sequence
  RNA Oligomer
uccagaaacaauaugcagaga

SEQ ID NO: 15437 - RNA, 21 nt, Artificial Sequence
  RNA Oligomer
ucgucuacuaugccucggaug

SEQ ID NO: 15438 - RNA, 21 nt, Artificial Sequence
  RNA Oligomer
gcagcucuacagcaaaaagaa

SEQ ID NO: 15439 - RNA, 21 nt, Artificial Sequence
  RNA Oligomer
agaaguggcagucauggauaa

SEQ ID NO: 15440 - RNA, 21 nt, Artificial Sequence
  RNA Oligomer
ucagaaguggcagucauggau

SEQ ID NO: 15441 - RNA, 21 nt, Artificial Sequence
  RNA Oligomer
uucacagaaguuccaguuacu

SEQ ID NO: 15442 - RNA, 21 nt, Artificial Sequence
  RNA Oligomer
cuggcugugucaaaaguagaa

SEQ ID NO: 15443 - RNA, 21 nt, Artificial Sequence
  RNA Oligomer
gaugaauaauuuguuccagca

SEQ ID NO: 15444 - RNA, 21 nt, Artificial Sequence
  RNA Oligomer
uggaggaaauugaacagauga

SEQ ID NO: 15445 - RNA, 21 nt, Artificial Sequence
  RNA Oligomer
guggaggaaauugaacagaug

SEQ ID NO: 15446 - RNA, 21 nt, Artificial Sequence
  RNA Oligomer
uccaagaugaugccgauguuu

SEQ ID NO: 15447 - RNA, 21 nt, Artificial Sequence
  RNA Oligomer
cguggaacagaagagacuaag

SEQ ID NO: 15448 - RNA, 21 nt, Artificial Sequence
  RNA Oligomer
acguggaacagaagagacuaa

SEQ ID NO: 15449 - RNA, 21 nt, Artificial Sequence
  RNA Oligomer
ccacguggaacagaagagacu

SEQ ID NO: 15450 - RNA, 21 nt, Artificial Sequence
  RNA Oligomer
gaaucaggaagcuaagcuaaa

SEQ ID NO: 15451 - RNA, 21 nt, Artificial Sequence
  RNA Oligomer
aggaacagcgcuuaaaguuuu

SEQ ID NO: 15452 - RNA, 21 nt, Artificial Sequence
  RNA Oligomer
ggauggaucugacucuugcug

SEQ ID NO: 15453 - RNA, 21 nt, Artificial Sequence
  RNA Oligomer
cccguaauauuugucaagauc

SEQ ID NO: 15454 - RNA, 21 nt, Artificial Sequence
  RNA Oligomer
cuuacccguaauauuugucaa

SEQ ID NO: 15455 - RNA, 21 nt, Artificial Sequence
  RNA Oligomer
ucuuguuuguaggcugaauuu

SEQ ID NO: 15456 - RNA, 21 nt, Artificial Sequence
  RNA Oligomer
aucuuguuuguaggcugaauu

SEQ ID NO: 15457 - RNA, 21 nt, Artificial Sequence
  RNA Oligomer
cgaaggcacugcacacuugua

SEQ ID NO: 15458 - RNA, 21 nt, Artificial Sequence
  RNA Oligomer
agaaaugguguaaaaguuccu

SEQ ID NO: 15459 - RNA, 21 nt, Artificial Sequence
  RNA Oligomer
ucaggauccaaguuuaaaaag

SEQ ID NO: 15460 - RNA, 21 nt, Artificial Sequence
  RNA Oligomer
ugaaccucagaaugaugauga

SEQ ID NO: 15461 - RNA, 21 nt, Artificial Sequence
  RNA Oligomer
agaagaugggcauaaugaaua

SEQ ID NO: 15462 - RNA, 21 nt, Artificial Sequence
  RNA Oligomer
caggagaagaugggcauaaug

SEQ ID NO: 15463 - RNA, 21 nt, Artificial Sequence
  RNA Oligomer
gaggaaauggaggaaggcuac

SEQ ID NO: 15464 - RNA, 21 nt, Artificial Sequence
  RNA Oligomer
agauucgucuuuggagggaga

SEQ ID NO: 15465 - RNA, 21 nt, Artificial Sequence
  RNA Oligomer
ccaaauccagaggcuccacau

SEQ ID NO: 15466 - RNA, 21 nt, Artificial Sequence
  RNA Oligomer
cgauuuggaagucagaggaac

SEQ ID NO: 15467 - RNA, 21 nt, Artificial Sequence
  RNA Oligomer
gcgaauguuugauguucuuca

SEQ ID NO: 15468 - RNA, 21 nt, Artificial Sequence
  RNA Oligomer
agcgaauguuugauguucuuc

SEQ ID NO: 15469 - RNA, 21 nt, Artificial Sequence
  RNA Oligomer
cagcaaguucaauauauucca

SEQ ID NO: 15470 - RNA, 21 nt, Artificial Sequence
  RNA Oligomer
caaacuaaucagccaccuuca

SEQ ID NO: 15471 - RNA, 21 nt, Artificial Sequence
  RNA Oligomer
gcgagagugauugccauuugg

SEQ ID NO: 15472 - RNA, 21 nt, Artificial Sequence
  RNA Oligomer
agaaccagagcagugaagaua

SEQ ID NO: 15473 - RNA, 21 nt, Artificial Sequence
  RNA Oligomer
gaagaaccagagcagugaaga

SEQ ID NO: 15474 - RNA, 21 nt, Artificial Sequence
  RNA Oligomer
gaaagugcguccguucucaau

SEQ ID NO: 15475 - RNA, 21 nt, Artificial Sequence
  RNA Oligomer
ggagaaagagaagaaagugcg

SEQ ID NO: 15476 - RNA, 21 nt, Artificial Sequence
  RNA Oligomer
cugagggagaaagagaagaaa

SEQ ID NO: 15477 - RNA, 21 nt, Artificial Sequence
  RNA Oligomer
agucauggauaagcguguuaa

SEQ ID NO: 15478 - RNA, 21 nt, Artificial Sequence
  RNA Oligomer
cagaugaauaauuuguuccag

SEQ ID NO: 15479 - RNA, 21 nt, Artificial Sequence
  RNA Oligomer
gaacagaagagacuaagcaau

SEQ ID NO: 15480 - RNA, 21 nt, Artificial Sequence
  RNA Oligomer
gcaggagaaacuuaaaaggcu

SEQ ID NO: 15481 - RNA, 21 nt, Artificial Sequence
  RNA Oligomer
ugagcaggagaaacuuaaaag

SEQ ID NO: 15482 - RNA, 21 nt, Artificial Sequence
  RNA Oligomer
gaacagcgcuuaaaguuuuug

SEQ ID NO: 15483 - RNA, 21 nt, Artificial Sequence
  RNA Oligomer
acccguaauauuugucaagau

SEQ ID NO: 15484 - RNA, 21 nt, Artificial Sequence
  RNA Oligomer
gacuuacccguaauauuuguc

SEQ ID NO: 15485 - RNA, 21 nt, Artificial Sequence
  RNA Oligomer
gaaauuagaaacuugcuacag

SEQ ID NO: 15486 - RNA, 21 nt, Artificial Sequence
  RNA Oligomer
cagaaauuagaaacuugcuac

SEQ ID NO: 15487 - RNA, 21 nt, Artificial Sequence
  RNA Oligomer
ggcaguugggaaaucagcucu

SEQ ID NO: 15488 - RNA, 21 nt, Artificial Sequence
  RNA Oligomer
gaaagcgaugaagaaugucuc

SEQ ID NO: 15489 - RNA, 21 nt, Artificial Sequence
  RNA Oligomer
cuugaaagcgaugaagaaugu

SEQ ID NO: 15490 - RNA, 21 nt, Artificial Sequence
  RNA Oligomer
caaaggagcuuggccugaaac

SEQ ID NO: 15491 - RNA, 21 nt, Artificial Sequence
  RNA Oligomer
cacagggaagacgaagaugaa

SEQ ID NO: 15492 - RNA, 21 nt, Artificial Sequence
  RNA Oligomer
ucauuuaugcgcuuugggauu

SEQ ID NO: 15493 - RNA, 21 nt, Artificial Sequence
  RNA Oligomer
gucauuuaugcgcuuugggau

SEQ ID NO: 15494 - RNA, 21 nt, Artificial Sequence
  RNA Oligomer
gagaagaugggcauaaugaau

SEQ ID NO: 15495 - RNA, 21 nt, Artificial Sequence
  RNA Oligomer
gcuucuuccuucgucaugaac

SEQ ID NO: 15496 - RNA, 21 nt, Artificial Sequence
  RNA Oligomer
guguaaauguaaaugcugcug

SEQ ID NO: 15497 - RNA, 21 nt, Artificial Sequence
  RNA Oligomer
gauucgucuuuggagggagaa

SEQ ID NO: 15498 - RNA, 21 nt, Artificial Sequence
  RNA Oligomer
gccuugauuaugagccugagg

SEQ ID NO: 15499 - RNA, 21 nt, Artificial Sequence
  RNA Oligomer
gccaguacagagaacagugac

SEQ ID NO: 15500 - RNA, 21 nt, Artificial Sequence
  RNA Oligomer
gucucucugguuccugaauca

SEQ ID NO: 15501 - RNA, 21 nt, Artificial Sequence
  RNA Oligomer
ccucuaaagaaacguaguucu

SEQ ID NO: 15502 - RNA, 21 nt, Artificial Sequence
  RNA Oligomer
cggauaaugagcgaauguuug

SEQ ID NO: 15503 - RNA, 21 nt, Artificial Sequence
  RNA Oligomer
uguauaugguaagccuguaau

SEQ ID NO: 15504 - RNA, 21 nt, Artificial Sequence
  RNA Oligomer
ggaaguucucagcaguuguca

SEQ ID NO: 15505 - RNA, 21 nt, Artificial Sequence
  RNA Oligomer
acggaaguucucagcaguugu

SEQ ID NO: 15506 - RNA, 21 nt, Artificial Sequence
  RNA Oligomer
cagacggaaguucucagcagu

SEQ ID NO: 15507 - RNA, 21 nt, Artificial Sequence
  RNA Oligomer
ggaagaaccagagcagugaag

SEQ ID NO: 15508 - RNA, 21 nt, Artificial Sequence
  RNA Oligomer
uucucaauguuugaugcagua

SEQ ID NO: 15509 - RNA, 21 nt, Artificial Sequence
  RNA Oligomer
agggagaaagagaagaaagug

SEQ ID NO: 15510 - RNA, 21 nt, Artificial Sequence
  RNA Oligomer
ugagggagaaagagaagaaag

SEQ ID NO: 15511 - RNA, 21 nt, Artificial Sequence
  RNA Oligomer
cugggaaugcucuggaucaag

SEQ ID NO: 15512 - RNA, 21 nt, Artificial Sequence
  RNA Oligomer
accaugacaaucagucugcag

SEQ ID NO: 15513 - RNA, 21 nt, Artificial Sequence
  RNA Oligomer
agaugaauaauuuguuccagc

SEQ ID NO: 15514 - RNA, 21 nt, Artificial Sequence
  RNA Oligomer
aaacuuguggaggaaauugaa

SEQ ID NO: 15515 - RNA, 21 nt, Artificial Sequence
  RNA Oligomer
agaagagacuaagcaauggga

SEQ ID NO: 15516 - RNA, 21 nt, Artificial Sequence
  RNA Oligomer
ccguaauauuugucaagauca

SEQ ID NO: 15517 - RNA, 21 nt, Artificial Sequence
  RNA Oligomer
agacuuacccguaauauuugu

SEQ ID NO: 15518 - RNA, 21 nt, Artificial Sequence
  RNA Oligomer
ucgaaggcacugcacacuugu

SEQ ID NO: 15519 - RNA, 21 nt, Artificial Sequence
  RNA Oligomer
aggacauuuagcgugaugaaa

SEQ ID NO: 15520 - RNA, 21 nt, Artificial Sequence
  RNA Oligomer
gcuuuacugcuagauucgucu

SEQ ID NO: 15521 - RNA, 21 nt, Artificial Sequence
  RNA Oligomer
aacagcccaaaucuccagaau

SEQ ID NO: 15522 - RNA, 21 nt, Artificial Sequence
  RNA Oligomer
gggaaugccaguacagagaac

SEQ ID NO: 15523 - RNA, 21 nt, Artificial Sequence
  RNA Oligomer
cucugguuccugaaucauugu

SEQ ID NO: 15524 - RNA, 21 nt, Artificial Sequence
  RNA Oligomer
ccaucauacccauccaaguca

SEQ ID NO: 15525 - RNA, 21 nt, Artificial Sequence
  RNA Oligomer
gaagcuuuuauaucagaggac

SEQ ID NO: 15526 - RNA, 21 nt, Artificial Sequence
  RNA Oligomer
gcagcacccagagaacauuua

SEQ ID NO: 15527 - RNA, 21 nt, Artificial Sequence
  RNA Oligomer
agagggccacacuuuucaagu

SEQ ID NO: 15528 - RNA, 21 nt, Artificial Sequence
  RNA Oligomer
guggcagcaaguucaauauau

SEQ ID NO: 15529 - RNA, 21 nt, Artificial Sequence
  RNA Oligomer
guccguucucaauguuugaug

SEQ ID NO: 15530 - RNA, 21 nt, Artificial Sequence
  RNA Oligomer
gagaaagagaagaaagugcgu

SEQ ID NO: 15531 - RNA, 21 nt, Artificial Sequence
  RNA Oligomer
ggaaugcucuggaucaaguug

SEQ ID NO: 15532 - RNA, 21 nt, Artificial Sequence
  RNA Oligomer
aggccugaauugcuggugaag

SEQ ID NO: 15533 - RNA, 21 nt, Artificial Sequence
  RNA Oligomer
aaggccugaauugcuggugaa

SEQ ID NO: 15534 - RNA, 21 nt, Artificial Sequence
  RNA Oligomer
ugcagcuaagaaacaaauuga

SEQ ID NO: 15535 - RNA, 21 nt, Artificial Sequence
  RNA Oligomer
uguggaggaaauugaacagau

SEQ ID NO: 15536 - RNA, 21 nt, Artificial Sequence
  RNA Oligomer
gggaaacuuguggaggaaauu

SEQ ID NO: 15537 - RNA, 21 nt, Artificial Sequence
  RNA Oligomer
gagacuaagcaaugggaaacu

SEQ ID NO: 15538 - RNA, 21 nt, Artificial Sequence
  RNA Oligomer
cugagcaggagaaacuuaaaa

SEQ ID NO: 15539 - RNA, 21 nt, Artificial Sequence
  RNA Oligomer
ugcugagcaggagaaacuuaa

SEQ ID NO: 15540 - RNA, 21 nt, Artificial Sequence
  RNA Oligomer
caaguugcugagcaggagaaa

SEQ ID NO: 15541 - RNA, 21 nt, Artificial Sequence
  RNA Oligomer
gugaagaacuguuaguugguu

SEQ ID NO: 15542 - RNA, 21 nt, Artificial Sequence
  RNA Oligomer
agugaagaacuguuaguuggu

SEQ ID NO: 15543 - RNA, 21 nt, Artificial Sequence
  RNA Oligomer
aggcacugcacacuuguauau

SEQ ID NO: 15544 - RNA, 21 nt, Artificial Sequence
  RNA Oligomer
gaaggcacugcacacuuguau

SEQ ID NO: 15545 - RNA, 21 nt, Artificial Sequence
  RNA Oligomer
agaggacauuuagcgugauga

SEQ ID NO: 15546 - RNA, 21 nt, Artificial Sequence
  RNA Oligomer
agggaagacgaagaugaaauc

SEQ ID NO: 15547 - RNA, 21 nt, Artificial Sequence
  RNA Oligomer
ugaaagaaggagacugcauga

SEQ ID NO: 15548 - RNA, 21 nt, Artificial Sequence
  RNA Oligomer
caggccacacagaaaucguua

SEQ ID NO: 15549 - RNA, 21 nt, Artificial Sequence
  RNA Oligomer
gaaugccaguacagagaacag

SEQ ID NO: 15550 - RNA, 21 nt, Artificial Sequence
  RNA Oligomer
ucucucugguuccugaaucau

SEQ ID NO: 15551 - RNA, 21 nt, Artificial Sequence
  RNA Oligomer
agaagcuuuuauaucagagga

SEQ ID NO: 15552 - RNA, 21 nt, Artificial Sequence
  RNA Oligomer
ucagaagcuuuuauaucagag

SEQ ID NO: 15553 - RNA, 21 nt, Artificial Sequence
  RNA Oligomer
ccuuucuuaucuaauccuuac

SEQ ID NO: 15554 - RNA, 21 nt, Artificial Sequence
  RNA Oligomer
cugccuuucuuaucuaauccu

SEQ ID NO: 15555 - RNA, 21 nt, Artificial Sequence
  RNA Oligomer
accguggcagcaaguucaaua

SEQ ID NO: 15556 - RNA, 21 nt, Artificial Sequence
  RNA Oligomer
guucucaauguuugaugcagu

SEQ ID NO: 15557 - RNA, 21 nt, Artificial Sequence
  RNA Oligomer
caaggccugaauugcugguga

SEQ ID NO: 15558 - RNA, 21 nt, Artificial Sequence
  RNA Oligomer
ggcagucauggauaagcgugu

SEQ ID NO: 15559 - RNA, 21 nt, Artificial Sequence
  RNA Oligomer
guggcagucauggauaagcgu

SEQ ID NO: 15560 - RNA, 21 nt, Artificial Sequence
  RNA Oligomer
gguguuaauaguccuaggaug

SEQ ID NO: 15561 - RNA, 21 nt, Artificial Sequence
  RNA Oligomer
aaggcacugcacacuuguaua

SEQ ID NO: 15562 - RNA, 21 nt, Artificial Sequence
  RNA Oligomer
gaagacgaagaugaaaucgaa

SEQ ID NO: 15563 - RNA, 21 nt, Artificial Sequence
  RNA Oligomer
cagggaagacgaagaugaaau

SEQ ID NO: 15564 - RNA, 21 nt, Artificial Sequence
  RNA Oligomer
gcaggccacacagaaaucguu

SEQ ID NO: 15565 - RNA, 21 nt, Artificial Sequence
  RNA Oligomer
gauguuucuuaccguguaucu

SEQ ID NO: 15566 - RNA, 21 nt, Artificial Sequence
  RNA Oligomer
cuuuacugcuagauucgucuu

SEQ ID NO: 15567 - RNA, 21 nt, Artificial Sequence
  RNA Oligomer
caguacagagaacagugacau

SEQ ID NO: 15568 - RNA, 21 nt, Artificial Sequence
  RNA Oligomer
ccaguacagagaacagugaca

SEQ ID NO: 15569 - RNA, 21 nt, Artificial Sequence
  RNA Oligomer
cucucugguuccugaaucauu

SEQ ID NO: 15570 - RNA, 21 nt, Artificial Sequence
  RNA Oligomer
ucagcaguugucaacaguugu

SEQ ID NO: 15571 - RNA, 21 nt, Artificial Sequence
  RNA Oligomer
gaaguucucagcaguugucaa

SEQ ID NO: 15572 - RNA, 21 nt, Artificial Sequence
  RNA Oligomer
cggaaguucucagcaguuguc

SEQ ID NO: 15573 - RNA, 21 nt, Artificial Sequence
  RNA Oligomer
cguccguucucaauguuugau

SEQ ID NO: 15574 - RNA, 21 nt, Artificial Sequence
  RNA Oligomer
cacaaacuaaaggcucuaaaa

SEQ ID NO: 15575 - RNA, 21 nt, Artificial Sequence
  RNA Oligomer
ucacaaacuaaaggcucuaaa

SEQ ID NO: 15576 - RNA, 21 nt, Artificial Sequence
  RNA Oligomer
gccagcagcaacagauugaag

SEQ ID NO: 15577 - RNA, 21 nt, Artificial Sequence
  RNA Oligomer
acuuguauauugucagugaag

SEQ ID NO: 15578 - RNA, 21 nt, Artificial Sequence
  RNA Oligomer
uuagaggacauuuagcgugau

SEQ ID NO: 15579 - RNA, 21 nt, Artificial Sequence
  RNA Oligomer
auguagcuugaaagcgaugaa

SEQ ID NO: 15580 - RNA, 21 nt, Artificial Sequence
  RNA Oligomer
acagggaagacgaagaugaaa

SEQ ID NO: 15581 - RNA, 21 nt, Artificial Sequence
  RNA Oligomer
agcagcacccagagaacauuu

SEQ ID NO: 15582 - RNA, 21 nt, Artificial Sequence
  RNA Oligomer
ccagccuuccaaagacaccuu

SEQ ID NO: 15583 - RNA, 21 nt, Artificial Sequence
  RNA Oligomer
gcaguugucaacaguuguucc

SEQ ID NO: 15584 - RNA, 21 nt, Artificial Sequence
  RNA Oligomer
cccaccuuccuuugguacucu

SEQ ID NO: 15585 - RNA, 21 nt, Artificial Sequence
  RNA Oligomer
ggcucuaaaauccauccaguu

SEQ ID NO: 15586 - RNA, 21 nt, Artificial Sequence
  RNA Oligomer
agaaggcagcucuacagcaaa

SEQ ID NO: 15587 - RNA, 21 nt, Artificial Sequence
  RNA Oligomer
gcaaaaacagagggagcucgu

SEQ ID NO: 15588 - RNA, 21 nt, Artificial Sequence
  RNA Oligomer
uaagcuacgguaccaguaauu

SEQ ID NO: 15589 - RNA, 21 nt, Artificial Sequence
  RNA Oligomer
acccaagaauuaaaccaagac

SEQ ID NO: 15590 - RNA, 21 nt, Artificial Sequence
  RNA Oligomer
cuacacucagugcucccaauu

SEQ ID NO: 15591 - RNA, 21 nt, Artificial Sequence
  RNA Oligomer
ccacucagcccaacuaaauua

SEQ ID NO: 15592 - RNA, 21 nt, Artificial Sequence
  RNA Oligomer
cagcaguugucaacaguuguu

SEQ ID NO: 15593 - RNA, 21 nt, Artificial Sequence
  RNA Oligomer
ucucagcaguugucaacaguu

SEQ ID NO: 15594 - RNA, 21 nt, Artificial Sequence
  RNA Oligomer
ugauugccauuuggcugaagu

SEQ ID NO: 15595 - RNA, 21 nt, Artificial Sequence
  RNA Oligomer
ucaagagcagaaugccaagcu

SEQ ID NO: 15596 - RNA, 21 nt, Artificial Sequence
  RNA Oligomer
acaaguugcugagcaggagaa

SEQ ID NO: 15597 - RNA, 21 nt, Artificial Sequence
  RNA Oligomer
gcagcaacagauugaagccca

SEQ ID NO: 15598 - RNA, 21 nt, Artificial Sequence
  RNA Oligomer
aaaggacaaacuugcguaaaa

SEQ ID NO: 15599 - RNA, 21 nt, Artificial Sequence
  RNA Oligomer
aaaaggacaaacuugcguaaa

SEQ ID NO: 15600 - RNA, 21 nt, Artificial Sequence
  RNA Oligomer
uaaaaggacaaacuugcguaa

SEQ ID NO: 15601 - RNA, 21 nt, Artificial Sequence
  RNA Oligomer
cagagaacagugacaugccag

SEQ ID NO: 15602 - RNA, 21 nt, Artificial Sequence
  RNA Oligomer
cccauccaagucagcuucugu

SEQ ID NO: 15603 - RNA, 21 nt, Artificial Sequence
  RNA Oligomer
ccuuacuuccacccuucagaa

SEQ ID NO: 15604 - RNA, 21 nt, Artificial Sequence
  RNA Oligomer
ccagguucuaagcaagaaagu

SEQ ID NO: 15605 - RNA, 21 nt, Artificial Sequence
  RNA Oligomer
agcaguugucaacaguuguuc

SEQ ID NO: 15606 - RNA, 21 nt, Artificial Sequence
  RNA Oligomer
cgggaugcucagguugcaaau

SEQ ID NO: 15607 - RNA, 21 nt, Artificial Sequence
  RNA Oligomer
ggucccuauauccagucgucu

SEQ ID NO: 15608 - RNA, 21 nt, Artificial Sequence
  RNA Oligomer
aggucccuauauccagucguc

SEQ ID NO: 15609 - RNA, 21 nt, Artificial Sequence
  RNA Oligomer
ggagcugcagcuaagaaacaa

SEQ ID NO: 15610 - RNA, 21 nt, Artificial Sequence
  RNA Oligomer
cgugaugaaauaaagcaucua

SEQ ID NO: 15611 - RNA, 21 nt, Artificial Sequence
  RNA Oligomer
guacccaagaauuaaaccaag

SEQ ID NO: 15612 - RNA, 21 nt, Artificial Sequence
  RNA Oligomer
gcugauagugauggauggacu

SEQ ID NO: 15613 - RNA, 21 nt, Artificial Sequence
  RNA Oligomer
caaacuugcguaaaacuggcu

SEQ ID NO: 15614 - RNA, 21 nt, Artificial Sequence
  RNA Oligomer
guaaaaggacaaacuugcgua

SEQ ID NO: 15615 - RNA, 21 nt, Artificial Sequence
  RNA Oligomer
uugucuugguuuaauucuugg

SEQ ID NO: 15616 - RNA, 21 nt, Artificial Sequence
  RNA Oligomer
ugucuugguuuaauucuuggg

SEQ ID NO: 15617 - RNA, 21 nt, Artificial Sequence
  RNA Oligomer
uaauggugaauucuucaaucc

SEQ ID NO: 15618 - RNA, 21 nt, Artificial Sequence
  RNA Oligomer
uuuaauucuuggguacagucc

SEQ ID NO: 15619 - RNA, 21 nt, Artificial Sequence
  RNA Oligomer
auugacuaaaauucugugugg

SEQ ID NO: 15620 - RNA, 21 nt, Artificial Sequence
  RNA Oligomer
aaaaacuuacacacuuggacg

SEQ ID NO: 15621 - RNA, 21 nt, Artificial Sequence
  RNA Oligomer
aaaggcaguaauuuaguuggg

SEQ ID NO: 15622 - RNA, 21 nt, Artificial Sequence
  RNA Oligomer
aacaccguucuccuuucuucg

SEQ ID NO: 15623 - RNA, 21 nt, Artificial Sequence
  RNA Oligomer
uacaucuaauuacugguaccg

SEQ ID NO: 15624 - RNA, 21 nt, Artificial Sequence
  RNA Oligomer
uuggacguuguuacaugaggc

SEQ ID NO: 15625 - RNA, 21 nt, Artificial Sequence
  RNA Oligomer
auuaacaccguucuccuuucu

SEQ ID NO: 15626 - RNA, 21 nt, Artificial Sequence
  RNA Oligomer
uugguuuaauucuuggguaca

SEQ ID NO: 15627 - RNA, 21 nt, Artificial Sequence
  RNA Oligomer
aacuuaacgauuucugugugg

SEQ ID NO: 15628 - RNA, 21 nt, Artificial Sequence
  RNA Oligomer
aaggcaguaauuuaguugggc

SEQ ID NO: 15629 - RNA, 21 nt, Artificial Sequence
  RNA Oligomer
ugaaggguggaaguaaggugu

SEQ ID NO: 15630 - RNA, 21 nt, Artificial Sequence
  RNA Oligomer
uuauucaaacacucccucugu

SEQ ID NO: 15631 - RNA, 21 nt, Artificial Sequence
  RNA Oligomer
ucuacaucuaauuacugguac

SEQ ID NO: 15632 - RNA, 21 nt, Artificial Sequence
  RNA Oligomer
aauaauucucuguacaagguc

SEQ ID NO: 15633 - RNA, 21 nt, Artificial Sequence
  RNA Oligomer
guaugagucuuggucaacgcg

SEQ ID NO: 15634 - RNA, 21 nt, Artificial Sequence
  RNA Oligomer
uuacgcuuauucaaacacucc

SEQ ID NO: 15635 - RNA, 21 nt, Artificial Sequence
  RNA Oligomer
aauuuguuucuuagcugcagc

SEQ ID NO: 15636 - RNA, 21 nt, Artificial Sequence
  RNA Oligomer
uucuccuuucuucgauauuca

SEQ ID NO: 15637 - RNA, 21 nt, Artificial Sequence
  RNA Oligomer
auugucgcuguauacuuaucu

SEQ ID NO: 15638 - RNA, 21 nt, Artificial Sequence
  RNA Oligomer
guuuaauucuuggguacaguc

SEQ ID NO: 15639 - RNA, 21 nt, Artificial Sequence
  RNA Oligomer
cuguacaaggucaaauucucc

SEQ ID NO: 15640 - RNA, 21 nt, Artificial Sequence
  RNA Oligomer
cuuggauggguaugaugggac

SEQ ID NO: 15641 - RNA, 21 nt, Artificial Sequence
  RNA Oligomer
uuggauggguaugaugggaca

SEQ ID NO: 15642 - RNA, 21 nt, Artificial Sequence
  RNA Oligomer
gaaaggcaguaauuuaguugg

SEQ ID NO: 15643 - RNA, 21 nt, Artificial Sequence
  RNA Oligomer
uaugagucuuggucaacgcgc

SEQ ID NO: 15644 - RNA, 21 nt, Artificial Sequence
  RNA Oligomer
gaaggguggaaguaagguguc

SEQ ID NO: 15645 - RNA, 21 nt, Artificial Sequence
  RNA Oligomer
aaguaaggugucuuuggaagg

SEQ ID NO: 15646 - RNA, 21 nt, Artificial Sequence
  RNA Oligomer
aacuuccgucuggcuuaaugu

SEQ ID NO: 15647 - RNA, 21 nt, Artificial Sequence
  RNA Oligomer
uauuguuucuggaguaacugg

SEQ ID NO: 15648 - RNA, 21 nt, Artificial Sequence
  RNA Oligomer
ucugcucuugauucaauuugu

SEQ ID NO: 15649 - RNA, 21 nt, Artificial Sequence
  RNA Oligomer
uguuucaaaaacuuuaagcgc

SEQ ID NO: 15650 - RNA, 21 nt, Artificial Sequence
  RNA Oligomer
aaaaacuuuaagcgcuguucc

SEQ ID NO: 15651 - RNA, 21 nt, Artificial Sequence
  RNA Oligomer
gauucuacaucuaauuacugg

SEQ ID NO: 15652 - RNA, 21 nt, Artificial Sequence
  RNA Oligomer
uucuucaauccuucauucucu

SEQ ID NO: 15653 - RNA, 21 nt, Artificial Sequence
  RNA Oligomer
cuucaauccuucauucucuuc

SEQ ID NO: 15654 - RNA, 21 nt, Artificial Sequence
  RNA Oligomer
ugacuccuuuauucauuaugc

SEQ ID NO: 15655 - RNA, 21 nt, Artificial Sequence
  RNA Oligomer
cuuaacgauuucuguguggcc

SEQ ID NO: 15656 - RNA, 21 nt, Artificial Sequence
  RNA Oligomer
guugaauuucacccucauucc

SEQ ID NO: 15657 - RNA, 21 nt, Artificial Sequence
  RNA Oligomer
uggauggguaugaugggacag

SEQ ID NO: 15658 - RNA, 21 nt, Artificial Sequence
  RNA Oligomer
auucuuucguuuucaugguuc

SEQ ID NO: 15659 - RNA, 21 nt, Artificial Sequence
  RNA Oligomer
aaagaucugcauuugaaggac

SEQ ID NO: 15660 - RNA, 21 nt, Artificial Sequence
  RNA Oligomer
auucaaacacucccucuguug

SEQ ID NO: 15661 - RNA, 21 nt, Artificial Sequence
  RNA Oligomer
uucugcucuugauucaauuug

SEQ ID NO: 15662 - RNA, 21 nt, Artificial Sequence
  RNA Oligomer
uucuucuacuuuugacacagc

SEQ ID NO: 15663 - RNA, 21 nt, Artificial Sequence
  RNA Oligomer
uuuuuuuagcuuagcuuccug

SEQ ID NO: 15664 - RNA, 21 nt, Artificial Sequence
  RNA Oligomer
uuuuuuagcuuagcuuccuga

SEQ ID NO: 15665 - RNA, 21 nt, Artificial Sequence
  RNA Oligomer
aucuaauuacugguaccguag

SEQ ID NO: 15666 - RNA, 21 nt, Artificial Sequence
  RNA Oligomer
gaauucuucaauccuucauuc

SEQ ID NO: 15667 - RNA, 21 nt, Artificial Sequence
  RNA Oligomer
gacuccuuuauucauuaugcc

SEQ ID NO: 15668 - RNA, 21 nt, Artificial Sequence
  RNA Oligomer
acuccuuuauucauuaugccc

SEQ ID NO: 15669 - RNA, 21 nt, Artificial Sequence
  RNA Oligomer
uucaugacgaaggaagaagcg

SEQ ID NO: 15670 - RNA, 21 nt, Artificial Sequence
  RNA Oligomer
cagcacaauguaauggagucc

SEQ ID NO: 15671 - RNA, 21 nt, Artificial Sequence
  RNA Oligomer
aucagcagcauuuacauuuac

SEQ ID NO: 15672 - RNA, 21 nt, Artificial Sequence
  RNA Oligomer
uaccaggaacuuaacgauuuc

SEQ ID NO: 15673 - RNA, 21 nt, Artificial Sequence
  RNA Oligomer
uacaaggucaaauucucccuc

SEQ ID NO: 15674 - RNA, 21 nt, Artificial Sequence
  RNA Oligomer
acaaggucaaauucucccucc

SEQ ID NO: 15675 - RNA, 21 nt, Artificial Sequence
  RNA Oligomer
aaacauucgcucauuauccgc

SEQ ID NO: 15676 - RNA, 21 nt, Artificial Sequence
  RNA Oligomer
uggcuauuggaauaaauguuc

SEQ ID NO: 15677 - RNA, 21 nt, Artificial Sequence
  RNA Oligomer
auaaauguucucugggugcug

SEQ ID NO: 15678 - RNA, 21 nt, Artificial Sequence
  RNA Oligomer
uugaaaaguguggcccucugg

SEQ ID NO: 15679 - RNA, 21 nt, Artificial Sequence
  RNA Oligomer
gguaugagucuuggucaacgc

SEQ ID NO: 15680 - RNA, 21 nt, Artificial Sequence
  RNA Oligomer
aaggguggaaguaaggugucu

SEQ ID NO: 15681 - RNA, 21 nt, Artificial Sequence
  RNA Oligomer
uucuuugcacagauccaccac

SEQ ID NO: 15682 - RNA, 21 nt, Artificial Sequence
  RNA Oligomer
auauuguuucuggaguaacug

SEQ ID NO: 15683 - RNA, 21 nt, Artificial Sequence
  RNA Oligomer
uagagcugccuucuucuucca

SEQ ID NO: 15684 - RNA, 21 nt, Artificial Sequence
  RNA Oligomer
uugcuuagucucuucuguucc

SEQ ID NO: 15685 - RNA, 21 nt, Artificial Sequence
  RNA Oligomer
uuuagccuuuuaaguuucucc

SEQ ID NO: 15686 - RNA, 21 nt, Artificial Sequence
  RNA Oligomer
uauuaacaccguucuccuuuc

SEQ ID NO: 15687 - RNA, 21 nt, Artificial Sequence
  RNA Oligomer
cuacaucuaauuacugguacc

SEQ ID NO: 15688 - RNA, 21 nt, Artificial Sequence
  RNA Oligomer
cugguaccguagcuuaguuuc

SEQ ID NO: 15689 - RNA, 21 nt, Artificial Sequence
  RNA Oligomer
uugucgcuguauacuuaucug

SEQ ID NO: 15690 - RNA, 21 nt, Artificial Sequence
  RNA Oligomer
uuauucauuaugcccaucuuc

SEQ ID NO: 15691 - RNA, 21 nt, Artificial Sequence
  RNA Oligomer
gacuccaccaaaaacuuacac

SEQ ID NO: 15692 - RNA, 21 nt, Artificial Sequence
  RNA Oligomer
cacuuggacguuguuacauga

SEQ ID NO: 15693 - RNA, 21 nt, Artificial Sequence
  RNA Oligomer
ucucuguacaaggucaaauuc

SEQ ID NO: 15694 - RNA, 21 nt, Artificial Sequence
  RNA Oligomer
aauuucacccucauuccauga

SEQ ID NO: 15695 - RNA, 21 nt, Artificial Sequence
  RNA Oligomer
caguuuuacgcaaguuugucc

SEQ ID NO: 15696 - RNA, 21 nt, Artificial Sequence
  RNA Oligomer
aguuuuacgcaaguuuguccu

SEQ ID NO: 15697 - RNA, 21 nt, Artificial Sequence
  RNA Oligomer
aucaagcacauguggagccuc

SEQ ID NO: 15698 - RNA, 21 nt, Artificial Sequence
  RNA Oligomer
agaaaggcaguaauuuaguug

SEQ ID NO: 15699 - RNA, 21 nt, Artificial Sequence
  RNA Oligomer
uuaguuuguccaaaauaaggc

SEQ ID NO: 15700 - RNA, 21 nt, Artificial Sequence
  RNA Oligomer
aaucuguuuugguuuuguagg

SEQ ID NO: 15701 - RNA, 21 nt, Artificial Sequence
  RNA Oligomer
cacauuuuuauuugcaaccug

SEQ ID NO: 15702 - RNA, 21 nt, Artificial Sequence
  RNA Oligomer
aagauaucuucacugcucugg

SEQ ID NO: 15703 - RNA, 21 nt, Artificial Sequence
  RNA Oligomer
aacuugauccagagcauuccc

SEQ ID NO: 15704 - RNA, 21 nt, Artificial Sequence
  RNA Oligomer
gaucugcauuugaaggacucc

SEQ ID NO: 15705 - RNA, 21 nt, Artificial Sequence
  RNA Oligomer
gucucugcauauuguuucugg

SEQ ID NO: 15706 - RNA, 21 nt, Artificial Sequence
  RNA Oligomer
acuucugaauuacgcuuauuc

SEQ ID NO: 15707 - RNA, 21 nt, Artificial Sequence
  RNA Oligomer
auuacgcuuauucaaacacuc

SEQ ID NO: 15708 - RNA, 21 nt, Artificial Sequence
  RNA Oligomer
uucaauuuguuucuuagcugc

SEQ ID NO: 15709 - RNA, 21 nt, Artificial Sequence
  RNA Oligomer
uggucaguucuucuacuuuug

SEQ ID NO: 15710 - RNA, 21 nt, Artificial Sequence
  RNA Oligomer
caguucuucuacuuuugacac

SEQ ID NO: 15711 - RNA, 21 nt, Artificial Sequence
  RNA Oligomer
ucuucuacuuuugacacagcc

SEQ ID NO: 15712 - RNA, 21 nt, Artificial Sequence
  RNA Oligomer
auucaucuguucaauuuccuc

SEQ ID NO: 15713 - RNA, 21 nt, Artificial Sequence
  RNA Oligomer
uucaucuguucaauuuccucc

SEQ ID NO: 15714 - RNA, 21 nt, Artificial Sequence
  RNA Oligomer
cuguugucgcugaucuuguug

SEQ ID NO: 15715 - RNA, 21 nt, Artificial Sequence
  RNA Oligomer
uugcugggcuucaaucuguug

SEQ ID NO: 15716 - RNA, 21 nt, Artificial Sequence
  RNA Oligomer
aaguucagcaagagucagauc

SEQ ID NO: 15717 - RNA, 21 nt, Artificial Sequence
  RNA Oligomer
auccuaggacuauuaacaccg

SEQ ID NO: 15718 - RNA, 21 nt, Artificial Sequence
  RNA Oligomer
uuaacaccguucuccuuucuu

SEQ ID NO: 15719 - RNA, 21 nt, Artificial Sequence
  RNA Oligomer
uaacaccguucuccuuucuuc

SEQ ID NO: 15720 - RNA, 21 nt, Artificial Sequence
  RNA Oligomer
acaucuaauuacugguaccgu

SEQ ID NO: 15721 - RNA, 21 nt, Artificial Sequence
  RNA Oligomer
cugacguagaugcuuuauuuc

SEQ ID NO: 15722 - RNA, 21 nt, Artificial Sequence
  RNA Oligomer
auuucaucacgcuaaaugucc

SEQ ID NO: 15723 - RNA, 21 nt, Artificial Sequence
  RNA Oligomer
auucuucaauccuucauucuc

SEQ ID NO: 15724 - RNA, 21 nt, Artificial Sequence
  RNA Oligomer
uucaauccuucauucucuucu

SEQ ID NO: 15725 - RNA, 21 nt, Artificial Sequence
  RNA Oligomer
caauccuucauucucuucuag

SEQ ID NO: 15726 - RNA, 21 nt, Artificial Sequence
  RNA Oligomer
uuucaggccaagcuccuuugu

SEQ ID NO: 15727 - RNA, 21 nt, Artificial Sequence
  RNA Oligomer
caccaaaaacuuacacacuug

SEQ ID NO: 15728 - RNA, 21 nt, Artificial Sequence
  RNA Oligomer
aaaacuuacacacuuggacgu

SEQ ID NO: 15729 - RNA, 21 nt, Artificial Sequence
  RNA Oligomer
aaacuuacacacuuggacguu

SEQ ID NO: 15730 - RNA, 21 nt, Artificial Sequence
  RNA Oligomer
acuuggacguuguuacaugag

SEQ ID NO: 15731 - RNA, 21 nt, Artificial Sequence
  RNA Oligomer
acuuaacgauuucuguguggc

SEQ ID NO: 15732 - RNA, 21 nt, Artificial Sequence
  RNA Oligomer
auaauucucuguacaagguca

SEQ ID NO: 15733 - RNA, 21 nt, Artificial Sequence
  RNA Oligomer
uuagacaguuucuuucguaag

SEQ ID NO: 15734 - RNA, 21 nt, Artificial Sequence
  RNA Oligomer
uaaggauuagauaagaaaggc

SEQ ID NO: 15735 - RNA, 21 nt, Artificial Sequence
  RNA Oligomer
uucuuucguuuucaugguucu

SEQ ID NO: 15736 - RNA, 21 nt, Artificial Sequence
  RNA Oligomer
auuuuuauuugcaaccugagc

SEQ ID NO: 15737 - RNA, 21 nt, Artificial Sequence
  RNA Oligomer
auaucuucacugcucugguuc

SEQ ID NO: 15738 - RNA, 21 nt, Artificial Sequence
  RNA Oligomer
aacggacgcacuuucuucucu

SEQ ID NO: 15739 - RNA, 21 nt, Artificial Sequence
  RNA Oligomer
uuugcacagauccaccacguc

SEQ ID NO: 15740 - RNA, 21 nt, Artificial Sequence
  RNA Oligomer
gauuuucuuuuugcuguagag

SEQ ID NO: 15741 - RNA, 21 nt, Artificial Sequence
  RNA Oligomer
auuaacacgcuuauccaugac

SEQ ID NO: 15742 - RNA, 21 nt, Artificial Sequence
  RNA Oligomer
aacacgcuuauccaugacugc

SEQ ID NO: 15743 - RNA, 21 nt, Artificial Sequence
  RNA Oligomer
acacucccucuguuguuguag

SEQ ID NO: 15744 - RNA, 21 nt, Artificial Sequence
  RNA Oligomer
cacuuuuuuuagcuuagcuuc

SEQ ID NO: 15745 - RNA, 21 nt, Artificial Sequence
  RNA Oligomer
acuuuuuuuagcuuagcuucc

SEQ ID NO: 15746 - RNA, 21 nt, Artificial Sequence
  RNA Oligomer
uugucgcugaucuuguuguuu

SEQ ID NO: 15747 - RNA, 21 nt, Artificial Sequence
  RNA Oligomer
gacuauuaacaccguucuccu

SEQ ID NO: 15748 - RNA, 21 nt, Artificial Sequence
  RNA Oligomer
cugacaaccaacuaacaguuc

SEQ ID NO: 15749 - RNA, 21 nt, Artificial Sequence
  RNA Oligomer
ucuccuuucuucgauauucac

SEQ ID NO: 15750 - RNA, 21 nt, Artificial Sequence
  RNA Oligomer
uucaccaggaacuuuuacacc

SEQ ID NO: 15751 - RNA, 21 nt, Artificial Sequence
  RNA Oligomer
cauugacuaaaauucugugug

SEQ ID NO: 15752 - RNA, 21 nt, Artificial Sequence
  RNA Oligomer
uugacuaaaauucugugugga

SEQ ID NO: 15753 - RNA, 21 nt, Artificial Sequence
  RNA Oligomer
guacagucccagcaaguuacg

SEQ ID NO: 15754 - RNA, 21 nt, Artificial Sequence
  RNA Oligomer
ucaucuucgucuucccugugg

SEQ ID NO: 15755 - RNA, 21 nt, Artificial Sequence
  RNA Oligomer
ccaaagcgcauaaaugacucc

SEQ ID NO: 15756 - RNA, 21 nt, Artificial Sequence
  RNA Oligomer
aagcgcauaaaugacuccuuu

SEQ ID NO: 15757 - RNA, 21 nt, Artificial Sequence
  RNA Oligomer
cuccaccaaaaacuuacacac

SEQ ID NO: 15758 - RNA, 21 nt, Artificial Sequence
  RNA Oligomer
uggacguuguuacaugaggca

SEQ ID NO: 15759 - RNA, 21 nt, Artificial Sequence
  RNA Oligomer
uaauucucuguacaaggucaa

SEQ ID NO: 15760 - RNA, 21 nt, Artificial Sequence
  RNA Oligomer
guacaaggucaaauucucccu

SEQ ID NO: 15761 - RNA, 21 nt, Artificial Sequence
  RNA Oligomer
aaauucucccuccaaagacga

SEQ ID NO: 15762 - RNA, 21 nt, Artificial Sequence
  RNA Oligomer
auggguaugaugggacagaga

SEQ ID NO: 15763 - RNA, 21 nt, Artificial Sequence
  RNA Oligomer
aagaacaucaaacauucgcuc

SEQ ID NO: 15764 - RNA, 21 nt, Artificial Sequence
  RNA Oligomer
aucacucugguuucgguaagg

SEQ ID NO: 15765 - RNA, 21 nt, Artificial Sequence
  RNA Oligomer
aaguuuuuuccuggcgccugc

SEQ ID NO: 15766 - RNA, 21 nt, Artificial Sequence
  RNA Oligomer
cauggaauauauugaacuugc

SEQ ID NO: 15767 - RNA, 21 nt, Artificial Sequence
  RNA Oligomer
aauauauugaacuugcugcca

SEQ ID NO: 15768 - RNA, 21 nt, Artificial Sequence
  RNA Oligomer
auauugaacuugcugccacgg

SEQ ID NO: 15769 - RNA, 21 nt, Artificial Sequence
  RNA Oligomer
aucuguuuugguuuuguagga

SEQ ID NO: 15770 - RNA, 21 nt, Artificial Sequence
  RNA Oligomer
ucuuccucagaguaccaaagg

SEQ ID NO: 15771 - RNA, 21 nt, Artificial Sequence
  RNA Oligomer
uuugagguacagaagcagagc

SEQ ID NO: 15772 - RNA, 21 nt, Artificial Sequence
  RNA Oligomer
uugggaaaagaucugcauuug

SEQ ID NO: 15773 - RNA, 21 nt, Artificial Sequence
  RNA Oligomer
gauggauuuuagagccuuuag

SEQ ID NO: 15774 - RNA, 21 nt, Artificial Sequence
  RNA Oligomer
agugucuguauuuucaucggc

SEQ ID NO: 15775 - RNA, 21 nt, Artificial Sequence
  RNA Oligomer
guagagcugccuucuucuucc

SEQ ID NO: 15776 - RNA, 21 nt, Artificial Sequence
  RNA Oligomer
cugccuggucaguucuucuac

SEQ ID NO: 15777 - RNA, 21 nt, Artificial Sequence
  RNA Oligomer
ucucacuuuuuuuagcuuagc

SEQ ID NO: 15778 - RNA, 21 nt, Artificial Sequence
  RNA Oligomer
ucauuguuacugagauacacg

SEQ ID NO: 15779 - RNA, 21 nt, Artificial Sequence
  RNA Oligomer
aguucagcaagagucagaucc

SEQ ID NO: 15780 - RNA, 21 nt, Artificial Sequence
  RNA Oligomer
aagagucagauccauccuagg

SEQ ID NO: 15781 - RNA, 21 nt, Artificial Sequence
  RNA Oligomer
uucagccuacaaacaagauuc

SEQ ID NO: 15782 - RNA, 21 nt, Artificial Sequence
  RNA Oligomer
uucacugacaaccaacuaaca

SEQ ID NO: 15783 - RNA, 21 nt, Artificial Sequence
  RNA Oligomer
aauauacaagugugcagugcc

SEQ ID NO: 15784 - RNA, 21 nt, Artificial Sequence
  RNA Oligomer
cuuucuucgauauucaccagg

SEQ ID NO: 15785 - RNA, 21 nt, Artificial Sequence
  RNA Oligomer
uuucuucgauauucaccagga

SEQ ID NO: 15786 - RNA, 21 nt, Artificial Sequence
  RNA Oligomer
caacugcccaauaaaugaucc

SEQ ID NO: 15787 - RNA, 21 nt, Artificial Sequence
  RNA Oligomer
ugucgcuguauacuuaucuga

SEQ ID NO: 15788 - RNA, 21 nt, Artificial Sequence
  RNA Oligomer
cuaauggugaauucuucaauc

SEQ ID NO: 15789 - RNA, 21 nt, Artificial Sequence
  RNA Oligomer
caaagcgcauaaaugacuccu

SEQ ID NO: 15790 - RNA, 21 nt, Artificial Sequence
  RNA Oligomer
aaagcgcauaaaugacuccuu

SEQ ID NO: 15791 - RNA, 21 nt, Artificial Sequence
  RNA Oligomer
uucauuaugcccaucuucucc

SEQ ID NO: 15792 - RNA, 21 nt, Artificial Sequence
  RNA Oligomer
auuaugcccaucuucuccuga

SEQ ID NO: 15793 - RNA, 21 nt, Artificial Sequence
  RNA Oligomer
uagccuuccuccauuuccucg

SEQ ID NO: 15794 - RNA, 21 nt, Artificial Sequence
  RNA Oligomer
uccaccaaaaacuuacacacu

SEQ ID NO: 15795 - RNA, 21 nt, Artificial Sequence
  RNA Oligomer
aacuuacacacuuggacguug

SEQ ID NO: 15796 - RNA, 21 nt, Artificial Sequence
  RNA Oligomer
uuaacgauuucuguguggccu

SEQ ID NO: 15797 - RNA, 21 nt, Artificial Sequence
  RNA Oligomer
uugaauuucacccucauucca

SEQ ID NO: 15798 - RNA, 21 nt, Artificial Sequence
  RNA Oligomer
guuuuacgcaaguuuguccuu

SEQ ID NO: 15799 - RNA, 21 nt, Artificial Sequence
  RNA Oligomer
caucaagcacauguggagccu

SEQ ID NO: 15800 - RNA, 21 nt, Artificial Sequence
  RNA Oligomer
uauucuggagauuugggcugu

SEQ ID NO: 15801 - RNA, 21 nt, Artificial Sequence
  RNA Oligomer
aaaagcuucugaauauuuggc

SEQ ID NO: 15802 - RNA, 21 nt, Artificial Sequence
  RNA Oligomer
cuguaauagaacuacguuucu

SEQ ID NO: 15803 - RNA, 21 nt, Artificial Sequence
  RNA Oligomer
uagacaguuucuuucguaagg

SEQ ID NO: 15804 - RNA, 21 nt, Artificial Sequence
  RNA Oligomer
aauuacaggcuuaccauauac

SEQ ID NO: 15805 - RNA, 21 nt, Artificial Sequence
  RNA Oligomer
cauuuuuauuugcaaccugag

SEQ ID NO: 15806 - RNA, 21 nt, Artificial Sequence
  RNA Oligomer
aaccucuccaucaucaacuug

SEQ ID NO: 15807 - RNA, 21 nt, Artificial Sequence
  RNA Oligomer
uugcacagauccaccacgucu

SEQ ID NO: 15808 - RNA, 21 nt, Artificial Sequence
  RNA Oligomer
aaaagaucugcauuugaagga

SEQ ID NO: 15809 - RNA, 21 nt, Artificial Sequence
  RNA Oligomer
cauuugaaggacuccaaucag

SEQ ID NO: 15810 - RNA, 21 nt, Artificial Sequence
  RNA Oligomer
aagauuuccaucagaugaaac

SEQ ID NO: 15811 - RNA, 21 nt, Artificial Sequence
  RNA Oligomer
gauuuccaucagaugaaacug

SEQ ID NO: 15812 - RNA, 21 nt, Artificial Sequence
  RNA Oligomer
agagcugccuucuucuuccac

SEQ ID NO: 15813 - RNA, 21 nt, Artificial Sequence
  RNA Oligomer
agcucauuaacacgcuuaucc

SEQ ID NO: 15814 - RNA, 21 nt, Artificial Sequence
  RNA Oligomer
uacgcuuauucaaacacuccc

SEQ ID NO: 15815 - RNA, 21 nt, Artificial Sequence
  RNA Oligomer
uucaaacacucccucuguugu

SEQ ID NO: 15816 - RNA, 21 nt, Artificial Sequence
  RNA Oligomer
acucccucuguuguuguagcu

SEQ ID NO: 15817 - RNA, 21 nt, Artificial Sequence
  RNA Oligomer
gaguaacuggaacuucuguga

SEQ ID NO: 15818 - RNA, 21 nt, Artificial Sequence
  RNA Oligomer
uagucucuucuguuccacgug

SEQ ID NO: 15819 - RNA, 21 nt, Artificial Sequence
  RNA Oligomer
cucacuuuuuuuagcuuagcu

SEQ ID NO: 15820 - RNA, 21 nt, Artificial Sequence
  RNA Oligomer
uuuuuagcuuagcuuccugau

SEQ ID NO: 15821 - RNA, 21 nt, Artificial Sequence
  RNA Oligomer
uagccuuuuaaguuucuccug

SEQ ID NO: 15822 - RNA, 21 nt, Artificial Sequence
  RNA Oligomer
uuuaaguuucuccugcucagc

SEQ ID NO: 15823 - RNA, 21 nt, Artificial Sequence
  RNA Oligomer
uuucaaaaacuuuaagcgcug

SEQ ID NO: 15824 - RNA, 21 nt, Artificial Sequence
  RNA Oligomer
uucaaaaacuuuaagcgcugu

SEQ ID NO: 15825 - RNA, 21 nt, Artificial Sequence
  RNA Oligomer
guucagcaagagucagaucca

SEQ ID NO: 15826 - RNA, 21 nt, Artificial Sequence
  RNA Oligomer
cuuaagaugcuacaaaaacuc

SEQ ID NO: 15827 - RNA, 21 nt, Artificial Sequence
  RNA Oligomer
acugacaauauacaagugugc

SEQ ID NO: 15828 - RNA, 21 nt, Artificial Sequence
  RNA Oligomer
uguagaaaacaggauugucgc

SEQ ID NO: 15829 - RNA, 21 nt, Artificial Sequence
  RNA Oligomer
auucaccaggaacuuuuacac

SEQ ID NO: 15830 - RNA, 21 nt, Artificial Sequence
  RNA Oligomer
aauccuucauucucuucuaga

SEQ ID NO: 15831 - RNA, 21 nt, Artificial Sequence
  RNA Oligomer
ucauucugagguucauaaucc

SEQ ID NO: 15832 - RNA, 21 nt, Artificial Sequence
  RNA Oligomer
cuuuauucauuaugcccaucu

SEQ ID NO: 15833 - RNA, 21 nt, Artificial Sequence
  RNA Oligomer
aucuugguccacucacaaugu

SEQ ID NO: 15834 - RNA, 21 nt, Artificial Sequence
  RNA Oligomer
aguguagccuuccuccauuuc

SEQ ID NO: 15835 - RNA, 21 nt, Artificial Sequence
  RNA Oligomer
acuuacacacuuggacguugu

SEQ ID NO: 15836 - RNA, 21 nt, Artificial Sequence
  RNA Oligomer
agcacaauguaauggagucca

SEQ ID NO: 15837 - RNA, 21 nt, Artificial Sequence
  RNA Oligomer
agcagcauuuacauuuacacc

SEQ ID NO: 15838 - RNA, 21 nt, Artificial Sequence
  RNA Oligomer
gaacuuaacgauuucugugug

SEQ ID NO: 15839 - RNA, 21 nt, Artificial Sequence
  RNA Oligomer
uguacaaggucaaauucuccc

SEQ ID NO: 15840 - RNA, 21 nt, Artificial Sequence
  RNA Oligomer
acaucaagcacauguggagcc

SEQ ID NO: 15841 - RNA, 21 nt, Artificial Sequence
  RNA Oligomer
auuucuacugggcuuucugag

SEQ ID NO: 15842 - RNA, 21 nt, Artificial Sequence
  RNA Oligomer
guaugaugggacagagauggu

SEQ ID NO: 15843 - RNA, 21 nt, Artificial Sequence
  RNA Oligomer
ucugaauauuuggcccauuag

SEQ ID NO: 15844 - RNA, 21 nt, Artificial Sequence
  RNA Oligomer
uagaacuacguuucuuuagag

SEQ ID NO: 15845 - RNA, 21 nt, Artificial Sequence
  RNA Oligomer
uuucuuucguaaggcuucuag

SEQ ID NO: 15846 - RNA, 21 nt, Artificial Sequence
  RNA Oligomer
uucuuucguaaggcuucuagg

SEQ ID NO: 15847 - RNA, 21 nt, Artificial Sequence
  RNA Oligomer
ucuuucguuuucaugguucuc

SEQ ID NO: 15848 - RNA, 21 nt, Artificial Sequence
  RNA Oligomer
aauaaauguucucugggugcu

SEQ ID NO: 15849 - RNA, 21 nt, Artificial Sequence
  RNA Oligomer
uuacaggcuuaccauauacac

SEQ ID NO: 15850 - RNA, 21 nt, Artificial Sequence
  RNA Oligomer
gaauauauugaacuugcugcc

SEQ ID NO: 15851 - RNA, 21 nt, Artificial Sequence
  RNA Oligomer
aacugcugagaacuuccgucu

SEQ ID NO: 15852 - RNA, 21 nt, Artificial Sequence
  RNA Oligomer
agauaucuucacugcucuggu

SEQ ID NO: 15853 - RNA, 21 nt, Artificial Sequence
  RNA Oligomer
ucaaacauugagaacggacgc

SEQ ID NO: 15854 - RNA, 21 nt, Artificial Sequence
  RNA Oligomer
aaacauugagaacggacgcac

SEQ ID NO: 15855 - RNA, 21 nt, Artificial Sequence
  RNA Oligomer
uucuucucuuucucccucagc

SEQ ID NO: 15856 - RNA, 21 nt, Artificial Sequence
  RNA Oligomer
agaucugcauuugaaggacuc

SEQ ID NO: 15857 - RNA, 21 nt, Artificial Sequence
  RNA Oligomer
auccgaggcauaguagacgac

SEQ ID NO: 15858 - RNA, 21 nt, Artificial Sequence
  RNA Oligomer
ucccucagcucauuaacacgc

SEQ ID NO: 15859 - RNA, 21 nt, Artificial Sequence
  RNA Oligomer
uaacacgcuuauccaugacug

SEQ ID NO: 15860 - RNA, 21 nt, Artificial Sequence
  RNA Oligomer
uauccaugacugccacuucug

SEQ ID NO: 15861 - RNA, 21 nt, Artificial Sequence
  RNA Oligomer
ugacugccacuucugaauuac

SEQ ID NO: 15862 - RNA, 21 nt, Artificial Sequence
  RNA Oligomer
gcuuauucaaacacucccucu

SEQ ID NO: 15863 - RNA, 21 nt, Artificial Sequence
  RNA Oligomer
guucuucuacuuuugacacag

SEQ ID NO: 15864 - RNA, 21 nt, Artificial Sequence
  RNA Oligomer
uucccauugcuuagucucuuc

SEQ ID NO: 15865 - RNA, 21 nt, Artificial Sequence
  RNA Oligomer
cucucacuuuuuuuagcuuag

SEQ ID NO: 15866 - RNA, 21 nt, Artificial Sequence
  RNA Oligomer
uuagcuuagcuuccugauucu

SEQ ID NO: 15867 - RNA, 21 nt, Artificial Sequence
  RNA Oligomer
uuagccuuuuaaguuucuccu

SEQ ID NO: 15868 - RNA, 21 nt, Artificial Sequence
  RNA Oligomer
aacaucggcaucaucuuggac

SEQ ID NO: 15869 - RNA, 21 nt, Artificial Sequence
  RNA Oligomer
gucgcugaucuuguuguuuca

SEQ ID NO: 15870 - RNA, 21 nt, Artificial Sequence
  RNA Oligomer
ugcugggcuucaaucuguugc

SEQ ID NO: 15871 - RNA, 21 nt, Artificial Sequence
  RNA Oligomer
agaugccauuuccugaaguuc

SEQ ID NO: 15872 - RNA, 21 nt, Artificial Sequence
  RNA Oligomer
agcaagagucagauccauccu

SEQ ID NO: 15873 - RNA, 21 nt, Artificial Sequence
  RNA Oligomer
caagagucagauccauccuag

SEQ ID NO: 15874 - RNA, 21 nt, Artificial Sequence
  RNA Oligomer
ucagccuacaaacaagauucu

SEQ ID NO: 15875 - RNA, 21 nt, Artificial Sequence
  RNA Oligomer
acaaccaacuaacaguucuuc

SEQ ID NO: 15876 - RNA, 21 nt, Artificial Sequence
  RNA Oligomer
aacugcccaauaaaugauccu

SEQ ID NO: 15877 - RNA, 21 nt, Artificial Sequence
  RNA Oligomer
gucgcuguauacuuaucugag

SEQ ID NO: 15878 - RNA, 21 nt, Artificial Sequence
  RNA Oligomer
auauucaccaggaacuuuuac

SEQ ID NO: 15879 - RNA, 21 nt, Artificial Sequence
  RNA Oligomer
uauuucaucacgcuaaauguc

SEQ ID NO: 15880 - RNA, 21 nt, Artificial Sequence
  RNA Oligomer
uucaucacgcuaaauguccuc

SEQ ID NO: 15881 - RNA, 21 nt, Artificial Sequence
  RNA Oligomer
uacagucccagcaaguuacgu

SEQ ID NO: 15882 - RNA, 21 nt, Artificial Sequence
  RNA Oligomer
cugaacuccauaaagaaauug

SEQ ID NO: 15883 - RNA, 21 nt, Artificial Sequence
  RNA Oligomer
auaaagaaauugggagcacug

SEQ ID NO: 15884 - RNA, 21 nt, Artificial Sequence
  RNA Oligomer
guguagccuuccuccauuucc

SEQ ID NO: 15885 - RNA, 21 nt, Artificial Sequence
  RNA Oligomer
cuccagguacacaucaagcac

SEQ ID NO: 15886 - RNA, 21 nt, Artificial Sequence
  RNA Oligomer
uuccucugacuuccaaaucgu

SEQ ID NO: 15887 - RNA, 21 nt, Artificial Sequence
  RNA Oligomer
uggguuauucuggagauuugg

SEQ ID NO: 15888 - RNA, 21 nt, Artificial Sequence
  RNA Oligomer
uguucucuguacuggcauucc

SEQ ID NO: 15889 - RNA, 21 nt, Artificial Sequence
  RNA Oligomer
ucuguaauagaacuacguuuc

SEQ ID NO: 15890 - RNA, 21 nt, Artificial Sequence
  RNA Oligomer
cuuggugcguuagacaguuuc

SEQ ID NO: 15891 - RNA, 21 nt, Artificial Sequence
  RNA Oligomer
cuucuaggucagcaucacucu

SEQ ID NO: 15892 - RNA, 21 nt, Artificial Sequence
  RNA Oligomer
uucuaggucagcaucacucug

SEQ ID NO: 15893 - RNA, 21 nt, Artificial Sequence
  RNA Oligomer
uucgguaaggauuagauaaga

SEQ ID NO: 15894 - RNA, 21 nt, Artificial Sequence
  RNA Oligomer
cuuucguuuucaugguucucc

SEQ ID NO: 15895 - RNA, 21 nt, Artificial Sequence
  RNA Oligomer
ugggugcugcuguugauucug

SEQ ID NO: 15896 - RNA, 21 nt, Artificial Sequence
  RNA Oligomer
auucugggcagcagcaauuac

SEQ ID NO: 15897 - RNA, 21 nt, Artificial Sequence
  RNA Oligomer
uauauugaacuugcugccacg

SEQ ID NO: 15898 - RNA, 21 nt, Artificial Sequence
  RNA Oligomer
aagguggcugauuaguuuguc

SEQ ID NO: 15899 - RNA, 21 nt, Artificial Sequence
  RNA Oligomer
gucuacugcaucaaacauuga

SEQ ID NO: 15900 - RNA, 21 nt, Artificial Sequence
  RNA Oligomer
ugcaucaaacauugagaacgg

SEQ ID NO: 15901 - RNA, 21 nt, Artificial Sequence
  RNA Oligomer
aacauugagaacggacgcacu

SEQ ID NO: 15902 - RNA, 21 nt, Artificial Sequence
  RNA Oligomer
cuuugcacagauccaccacgu

SEQ ID NO: 15903 - RNA, 21 nt, Artificial Sequence
  RNA Oligomer
ugggaaaagaucugcauuuga

SEQ ID NO: 15904 - RNA, 21 nt, Artificial Sequence
  RNA Oligomer
cagugucuguauuuucaucgg

SEQ ID NO: 15905 - RNA, 21 nt, Artificial Sequence
  RNA Oligomer
gugucuguauuuucaucggcc

SEQ ID NO: 15906 - RNA, 21 nt, Artificial Sequence
  RNA Oligomer
ugucuguauuuucaucggccc

SEQ ID NO: 15907 - RNA, 21 nt, Artificial Sequence
  RNA Oligomer
cuuuuugcuguagagcugccu

SEQ ID NO: 15908 - RNA, 21 nt, Artificial Sequence
  RNA Oligomer
uuuuugcuguagagcugccuu

SEQ ID NO: 15909 - RNA, 21 nt, Artificial Sequence
  RNA Oligomer
gucccucagcucauuaacacg

SEQ ID NO: 15910 - RNA, 21 nt, Artificial Sequence
  RNA Oligomer
cuuauccaugacugccacuuc

SEQ ID NO: 15911 - RNA, 21 nt, Artificial Sequence
  RNA Oligomer
gacugccacuucugaauuacg

SEQ ID NO: 15912 - RNA, 21 nt, Artificial Sequence
  RNA Oligomer
acugccacuucugaauuacgc

SEQ ID NO: 15913 - RNA, 21 nt, Artificial Sequence
  RNA Oligomer
cugccacuucugaauuacgcu

SEQ ID NO: 15914 - RNA, 21 nt, Artificial Sequence
  RNA Oligomer
acgcuuauucaaacacucccu

SEQ ID NO: 15915 - RNA, 21 nt, Artificial Sequence
  RNA Oligomer
cuucuacuuuugacacagcca

SEQ ID NO: 15916 - RNA, 21 nt, Artificial Sequence
  RNA Oligomer
ucuacuuuugacacagccagg

SEQ ID NO: 15917 - RNA, 21 nt, Artificial Sequence
  RNA Oligomer
uagcuuagcuuccugauucuc

SEQ ID NO: 15918 - RNA, 21 nt, Artificial Sequence
  RNA Oligomer
cauuguuacugagauacacgg

SEQ ID NO: 15919 - RNA, 21 nt, Artificial Sequence
  RNA Oligomer
uccuaggacuauuaacaccgu

SEQ ID NO: 15920 - RNA, 21 nt, Artificial Sequence
  RNA Oligomer
guaagucuguagcaaguuucu

SEQ ID NO: 15921 - RNA, 21 nt, Artificial Sequence
  RNA Oligomer
agcaaguuucuaauuucugag

SEQ ID NO: 15922 - RNA, 21 nt, Artificial Sequence
  RNA Oligomer
caaccaacuaacaguucuuca

SEQ ID NO: 15923 - RNA, 21 nt, Artificial Sequence
  RNA Oligomer
ccuuucuucgauauucaccag

SEQ ID NO: 15924 - RNA, 21 nt, Artificial Sequence
  RNA Oligomer
augauccuauuuacuagacag

SEQ ID NO: 15925 - RNA, 21 nt, Artificial Sequence
  RNA Oligomer
augcuuuauuucaucacgcua

SEQ ID NO: 15926 - RNA, 21 nt, Artificial Sequence
  RNA Oligomer
acgcuaaauguccucuaaugg

SEQ ID NO: 15927 - RNA, 21 nt, Artificial Sequence
  RNA Oligomer
cuugguccacucacaaugucc

SEQ ID NO: 15928 - RNA, 21 nt, Artificial Sequence
  RNA Oligomer
uuauucuggagauuugggcug

SEQ ID NO: 15929 - RNA, 21 nt, Artificial Sequence
  RNA Oligomer
uucuggagauuugggcuguug

SEQ ID NO: 15930 - RNA, 21 nt, Artificial Sequence
  RNA Oligomer
agaacaucaaacauucgcuca

SEQ ID NO: 15931 - RNA, 21 nt, Artificial Sequence
  RNA Oligomer
aaggauuagauaagaaaggca

SEQ ID NO: 15932 - RNA, 21 nt, Artificial Sequence
  RNA Oligomer
ucaaacauucgcucauuaucc

SEQ ID NO: 15933 - RNA, 21 nt, Artificial Sequence
  RNA Oligomer
caagauaucuucacugcucug

SEQ ID NO: 15934 - RNA, 21 nt, Artificial Sequence
  RNA Oligomer
gaaaagaucugcauuugaagg

SEQ ID NO: 15935 - RNA, 21 nt, Artificial Sequence
  RNA Oligomer
acgucucugcauauuguuucu

SEQ ID NO: 15936 - RNA, 21 nt, Artificial Sequence
  RNA Oligomer
ucucugcauauuguuucugga

SEQ ID NO: 15937 - RNA, 21 nt, Artificial Sequence
  RNA Oligomer
cauccgaggcauaguagacga

SEQ ID NO: 15938 - RNA, 21 nt, Artificial Sequence
  RNA Oligomer
uucuuuuugcuguagagcugc

SEQ ID NO: 15939 - RNA, 21 nt, Artificial Sequence
  RNA Oligomer
uuauccaugacugccacuucu

SEQ ID NO: 15940 - RNA, 21 nt, Artificial Sequence
  RNA Oligomer
auccaugacugccacuucuga

SEQ ID NO: 15941 - RNA, 21 nt, Artificial Sequence
  RNA Oligomer
aguaacuggaacuucugugaa

SEQ ID NO: 15942 - RNA, 21 nt, Artificial Sequence
  RNA Oligomer
uucuacuuuugacacagccag

SEQ ID NO: 15943 - RNA, 21 nt, Artificial Sequence
  RNA Oligomer
ugcuggaacaaauuauucauc

SEQ ID NO: 15944 - RNA, 21 nt, Artificial Sequence
  RNA Oligomer
ucaucuguucaauuuccucca

SEQ ID NO: 15945 - RNA, 21 nt, Artificial Sequence
  RNA Oligomer
caucuguucaauuuccuccac

SEQ ID NO: 15946 - RNA, 21 nt, Artificial Sequence
  RNA Oligomer
aaacaucggcaucaucuugga

SEQ ID NO: 15947 - RNA, 21 nt, Artificial Sequence
  RNA Oligomer
cuuagucucuucuguuccacg

SEQ ID NO: 15948 - RNA, 21 nt, Artificial Sequence
  RNA Oligomer
uuagucucuucuguuccacgu

SEQ ID NO: 15949 - RNA, 21 nt, Artificial Sequence
  RNA Oligomer
agucucuucuguuccacgugg

SEQ ID NO: 15950 - RNA, 21 nt, Artificial Sequence
  RNA Oligomer
uuuagcuuagcuuccugauuc

SEQ ID NO: 15951 - RNA, 21 nt, Artificial Sequence
  RNA Oligomer
aaaacuuuaagcgcuguuccu

SEQ ID NO: 15952 - RNA, 21 nt, Artificial Sequence
  RNA Oligomer
cagcaagagucagauccaucc

SEQ ID NO: 15953 - RNA, 21 nt, Artificial Sequence
  RNA Oligomer
gaucuugacaaauauuacggg

SEQ ID NO: 15954 - RNA, 21 nt, Artificial Sequence
  RNA Oligomer
uugacaaauauuacggguaag

SEQ ID NO: 15955 - RNA, 21 nt, Artificial Sequence
  RNA Oligomer
aaauucagccuacaaacaaga

SEQ ID NO: 15956 - RNA, 21 nt, Artificial Sequence
  RNA Oligomer
aauucagccuacaaacaagau

SEQ ID NO: 15957 - RNA, 21 nt, Artificial Sequence
  RNA Oligomer
uacaagugugcagugccuucg

SEQ ID NO: 15958 - RNA, 21 nt, Artificial Sequence
  RNA Oligomer
aggaacuuuuacaccauuucu

SEQ ID NO: 15959 - RNA, 21 nt, Artificial Sequence
  RNA Oligomer
cuuuuuaaacuuggauccuga

SEQ ID NO: 15960 - RNA, 21 nt, Artificial Sequence
  RNA Oligomer
ucaucaucauucugagguuca

SEQ ID NO: 15961 - RNA, 21 nt, Artificial Sequence
  RNA Oligomer
uauucauuaugcccaucuucu

SEQ ID NO: 15962 - RNA, 21 nt, Artificial Sequence
  RNA Oligomer
cauuaugcccaucuucuccug

SEQ ID NO: 15963 - RNA, 21 nt, Artificial Sequence
  RNA Oligomer
guagccuuccuccauuuccuc

SEQ ID NO: 15964 - RNA, 21 nt, Artificial Sequence
  RNA Oligomer
ucucccuccaaagacgaaucu

SEQ ID NO: 15965 - RNA, 21 nt, Artificial Sequence
  RNA Oligomer
auguggagccucuggauuugg

SEQ ID NO: 15966 - RNA, 21 nt, Artificial Sequence
  RNA Oligomer
guuccucugacuuccaaaucg

SEQ ID NO: 15967 - RNA, 21 nt, Artificial Sequence
  RNA Oligomer
ugaagaacaucaaacauucgc

SEQ ID NO: 15968 - RNA, 21 nt, Artificial Sequence
  RNA Oligomer
gaagaacaucaaacauucgcu

SEQ ID NO: 15969 - RNA, 21 nt, Artificial Sequence
  RNA Oligomer
uggaauauauugaacuugcug

SEQ ID NO: 15970 - RNA, 21 nt, Artificial Sequence
  RNA Oligomer
ugaagguggcugauuaguuug

SEQ ID NO: 15971 - RNA, 21 nt, Artificial Sequence
  RNA Oligomer
ccaaauggcaaucacucucgc

SEQ ID NO: 15972 - RNA, 21 nt, Artificial Sequence
  RNA Oligomer
uaucuucacugcucugguucu

SEQ ID NO: 15973 - RNA, 21 nt, Artificial Sequence
  RNA Oligomer
ucuucacugcucugguucuuc

SEQ ID NO: 15974 - RNA, 21 nt, Artificial Sequence
  RNA Oligomer
auugagaacggacgcacuuuc

SEQ ID NO: 15975 - RNA, 21 nt, Artificial Sequence
  RNA Oligomer
cgcacuuucuucucuuucucc

SEQ ID NO: 15976 - RNA, 21 nt, Artificial Sequence
  RNA Oligomer
uuucuucucuuucucccucag

SEQ ID NO: 15977 - RNA, 21 nt, Artificial Sequence
  RNA Oligomer
uuaacacgcuuauccaugacu

SEQ ID NO: 15978 - RNA, 21 nt, Artificial Sequence
  RNA Oligomer
cuggaacaaauuauucaucug

SEQ ID NO: 15979 - RNA, 21 nt, Artificial Sequence
  RNA Oligomer
auugcuuagucucuucuguuc

SEQ ID NO: 15980 - RNA, 21 nt, Artificial Sequence
  RNA Oligomer
agccuuuuaaguuucuccugc

SEQ ID NO: 15981 - RNA, 21 nt, Artificial Sequence
  RNA Oligomer
cuuuuaaguuucuccugcuca

SEQ ID NO: 15982 - RNA, 21 nt, Artificial Sequence
  RNA Oligomer
caaaaacuuuaagcgcuguuc

SEQ ID NO: 15983 - RNA, 21 nt, Artificial Sequence
  RNA Oligomer
aucuugacaaauauuacgggu

SEQ ID NO: 15984 - RNA, 21 nt, Artificial Sequence
  RNA Oligomer
gacaaauauuacggguaaguc

SEQ ID NO: 15985 - RNA, 21 nt, Artificial Sequence
  RNA Oligomer
cuguagcaaguuucuaauuuc

SEQ ID NO: 15986 - RNA, 21 nt, Artificial Sequence
  RNA Oligomer
guagcaaguuucuaauuucug

SEQ ID NO: 15987 - RNA, 21 nt, Artificial Sequence
  RNA Oligomer
agagcugauuucccaacugcc

SEQ ID NO: 15988 - RNA, 21 nt, Artificial Sequence
  RNA Oligomer
gagacauucuucaucgcuuuc

SEQ ID NO: 15989 - RNA, 21 nt, Artificial Sequence
  RNA Oligomer
acauucuucaucgcuuucaag

SEQ ID NO: 15990 - RNA, 21 nt, Artificial Sequence
  RNA Oligomer
guuucaggccaagcuccuuug

SEQ ID NO: 15991 - RNA, 21 nt, Artificial Sequence
  RNA Oligomer
uucaucuucgucuucccugug

SEQ ID NO: 15992 - RNA, 21 nt, Artificial Sequence
  RNA Oligomer
aaucccaaagcgcauaaauga

SEQ ID NO: 15993 - RNA, 21 nt, Artificial Sequence
  RNA Oligomer
aucccaaagcgcauaaaugac

SEQ ID NO: 15994 - RNA, 21 nt, Artificial Sequence
  RNA Oligomer
auucauuaugcccaucuucuc

SEQ ID NO: 15995 - RNA, 21 nt, Artificial Sequence
  RNA Oligomer
guucaugacgaaggaagaagc

SEQ ID NO: 15996 - RNA, 21 nt, Artificial Sequence
  RNA Oligomer
cagcagcauuuacauuuacac

SEQ ID NO: 15997 - RNA, 21 nt, Artificial Sequence
  RNA Oligomer
uucucccuccaaagacgaauc

SEQ ID NO: 15998 - RNA, 21 nt, Artificial Sequence
  RNA Oligomer
ccucaggcucauaaucaaggc

SEQ ID NO: 15999 - RNA, 21 nt, Artificial Sequence
  RNA Oligomer
gucacuguucucuguacuggc

SEQ ID NO: 16000 - RNA, 21 nt, Artificial Sequence
  RNA Oligomer
ugauucaggaaccagagagac

SEQ ID NO: 16001 - RNA, 21 nt, Artificial Sequence
  RNA Oligomer
agaacuacguuucuuuagagg

SEQ ID NO: 16002 - RNA, 21 nt, Artificial Sequence
  RNA Oligomer
caaacauucgcucauuauccg

SEQ ID NO: 16003 - RNA, 21 nt, Artificial Sequence
  RNA Oligomer
auuacaggcuuaccauauaca

SEQ ID NO: 16004 - RNA, 21 nt, Artificial Sequence
  RNA Oligomer
ugacaacugcugagaacuucc

SEQ ID NO: 16005 - RNA, 21 nt, Artificial Sequence
  RNA Oligomer
acaacugcugagaacuuccgu

SEQ ID NO: 16006 - RNA, 21 nt, Artificial Sequence
  RNA Oligomer
acugcugagaacuuccgucug

SEQ ID NO: 16007 - RNA, 21 nt, Artificial Sequence
  RNA Oligomer
cuucacugcucugguucuucc

SEQ ID NO: 16008 - RNA, 21 nt, Artificial Sequence
  RNA Oligomer
uacugcaucaaacauugagaa

SEQ ID NO: 16009 - RNA, 21 nt, Artificial Sequence
  RNA Oligomer
cacuuucuucucuuucucccu

SEQ ID NO: 16010 - RNA, 21 nt, Artificial Sequence
  RNA Oligomer
cuuucuucucuuucucccuca

SEQ ID NO: 16011 - RNA, 21 nt, Artificial Sequence
  RNA Oligomer
cuugauccagagcauucccag

SEQ ID NO: 16012 - RNA, 21 nt, Artificial Sequence
  RNA Oligomer
cugcagacugauugucauggu

SEQ ID NO: 16013 - RNA, 21 nt, Artificial Sequence
  RNA Oligomer
gcuggaacaaauuauucaucu

SEQ ID NO: 16014 - RNA, 21 nt, Artificial Sequence
  RNA Oligomer
uucaauuuccuccacaaguuu

SEQ ID NO: 16015 - RNA, 21 nt, Artificial Sequence
  RNA Oligomer
ucccauugcuuagucucuucu

SEQ ID NO: 16016 - RNA, 21 nt, Artificial Sequence
  RNA Oligomer
ugaucuugacaaauauuacgg

SEQ ID NO: 16017 - RNA, 21 nt, Artificial Sequence
  RNA Oligomer
acaaauauuacggguaagucu

SEQ ID NO: 16018 - RNA, 21 nt, Artificial Sequence
  RNA Oligomer
acaagugugcagugccuucga

SEQ ID NO: 16019 - RNA, 21 nt, Artificial Sequence
  RNA Oligomer
uuucaucacgcuaaauguccu

SEQ ID NO: 16020 - RNA, 21 nt, Artificial Sequence
  RNA Oligomer
agacgaaucuagcaguaaagc

SEQ ID NO: 16021 - RNA, 21 nt, Artificial Sequence
  RNA Oligomer
auucuggagauuugggcuguu

SEQ ID NO: 16022 - RNA, 21 nt, Artificial Sequence
  RNA Oligomer
guucucuguacuggcauuccc

SEQ ID NO: 16023 - RNA, 21 nt, Artificial Sequence
  RNA Oligomer
acaaugauucaggaaccagag

SEQ ID NO: 16024 - RNA, 21 nt, Artificial Sequence
  RNA Oligomer
ugacuuggauggguaugaugg

SEQ ID NO: 16025 - RNA, 21 nt, Artificial Sequence
  RNA Oligomer
guccucugauauaaaagcuuc

SEQ ID NO: 16026 - RNA, 21 nt, Artificial Sequence
  RNA Oligomer
uaaauguucucugggugcugc

SEQ ID NO: 16027 - RNA, 21 nt, Artificial Sequence
  RNA Oligomer
acuugaaaaguguggcccucu

SEQ ID NO: 16028 - RNA, 21 nt, Artificial Sequence
  RNA Oligomer
auauauugaacuugcugccac

SEQ ID NO: 16029 - RNA, 21 nt, Artificial Sequence
  RNA Oligomer
caucaaacauugagaacggac

SEQ ID NO: 16030 - RNA, 21 nt, Artificial Sequence
  RNA Oligomer
acgcacuuucuucucuuucuc

SEQ ID NO: 16031 - RNA, 21 nt, Artificial Sequence
  RNA Oligomer
caacuugauccagagcauucc

SEQ ID NO: 16032 - RNA, 21 nt, Artificial Sequence
  RNA Oligomer
cuucaccagcaauucaggccu

SEQ ID NO: 16033 - RNA, 21 nt, Artificial Sequence
  RNA Oligomer
uucaccagcaauucaggccuu

SEQ ID NO: 16034 - RNA, 21 nt, Artificial Sequence
  RNA Oligomer
ucaauuuguuucuuagcugca

SEQ ID NO: 16035 - RNA, 21 nt, Artificial Sequence
  RNA Oligomer
aucuguucaauuuccuccaca

SEQ ID NO: 16036 - RNA, 21 nt, Artificial Sequence
  RNA Oligomer
aauuuccuccacaaguuuccc

SEQ ID NO: 16037 - RNA, 21 nt, Artificial Sequence
  RNA Oligomer
aguuucccauugcuuagucuc

SEQ ID NO: 16038 - RNA, 21 nt, Artificial Sequence
  RNA Oligomer
uuuuaaguuucuccugcucag

SEQ ID NO: 16039 - RNA, 21 nt, Artificial Sequence
  RNA Oligomer
uuaaguuucuccugcucagca

SEQ ID NO: 16040 - RNA, 21 nt, Artificial Sequence
  RNA Oligomer
uuucuccugcucagcaacuug

SEQ ID NO: 16041 - RNA, 21 nt, Artificial Sequence
  RNA Oligomer
aaccaacuaacaguucuucac

SEQ ID NO: 16042 - RNA, 21 nt, Artificial Sequence
  RNA Oligomer
accaacuaacaguucuucacu

SEQ ID NO: 16043 - RNA, 21 nt, Artificial Sequence
  RNA Oligomer
auauacaagugugcagugccu

SEQ ID NO: 16044 - RNA, 21 nt, Artificial Sequence
  RNA Oligomer
auacaagugugcagugccuuc

SEQ ID NO: 16045 - RNA, 21 nt, Artificial Sequence
  RNA Oligomer
ucaucacgcuaaauguccucu

SEQ ID NO: 16046 - RNA, 21 nt, Artificial Sequence
  RNA Oligomer
gauuucaucuucgucuucccu

SEQ ID NO: 16047 - RNA, 21 nt, Artificial Sequence
  RNA Oligomer
ucaugcagucuccuucuuuca

SEQ ID NO: 16048 - RNA, 21 nt, Artificial Sequence
  RNA Oligomer
uaacgauuucuguguggccug

SEQ ID NO: 16049 - RNA, 21 nt, Artificial Sequence
  RNA Oligomer
cuguucucuguacuggcauuc

SEQ ID NO: 16050 - RNA, 21 nt, Artificial Sequence
  RNA Oligomer
augauucaggaaccagagaga

SEQ ID NO: 16051 - RNA, 21 nt, Artificial Sequence
  RNA Oligomer
uccucugauauaaaagcuucu

SEQ ID NO: 16052 - RNA, 21 nt, Artificial Sequence
  RNA Oligomer
cucugauauaaaagcuucuga

SEQ ID NO: 16053 - RNA, 21 nt, Artificial Sequence
  RNA Oligomer
guaaggauuagauaagaaagg

SEQ ID NO: 16054 - RNA, 21 nt, Artificial Sequence
  RNA Oligomer
aggauuagauaagaaaggcag

SEQ ID NO: 16055 - RNA, 21 nt, Artificial Sequence
  RNA Oligomer
uauugaacuugcugccacggu

SEQ ID NO: 16056 - RNA, 21 nt, Artificial Sequence
  RNA Oligomer
acugcaucaaacauugagaac

SEQ ID NO: 16057 - RNA, 21 nt, Artificial Sequence
  RNA Oligomer
ucaccagcaauucaggccuug

SEQ ID NO: 16058 - RNA, 21 nt, Artificial Sequence
  RNA Oligomer
acacgcuuauccaugacugcc

SEQ ID NO: 16059 - RNA, 21 nt, Artificial Sequence
  RNA Oligomer
acgcuuauccaugacugccac

SEQ ID NO: 16060 - RNA, 21 nt, Artificial Sequence
  RNA Oligomer
cauccuaggacuauuaacacc

SEQ ID NO: 16061 - RNA, 21 nt, Artificial Sequence
  RNA Oligomer
uauacaagugugcagugccuu

SEQ ID NO: 16062 - RNA, 21 nt, Artificial Sequence
  RNA Oligomer
uucgauuucaucuucgucuuc

SEQ ID NO: 16063 - RNA, 21 nt, Artificial Sequence
  RNA Oligomer
auuucaucuucgucuucccug

SEQ ID NO: 16064 - RNA, 21 nt, Artificial Sequence
  RNA Oligomer
aacgauuucuguguggccugc

SEQ ID NO: 16065 - RNA, 21 nt, Artificial Sequence
  RNA Oligomer
agauacacgguaagaaacauc

SEQ ID NO: 16066 - RNA, 21 nt, Artificial Sequence
  RNA Oligomer
aagacgaaucuagcaguaaag

SEQ ID NO: 16067 - RNA, 21 nt, Artificial Sequence
  RNA Oligomer
augucacuguucucuguacug

SEQ ID NO: 16068 - RNA, 21 nt, Artificial Sequence
  RNA Oligomer
ugucacuguucucuguacugg

SEQ ID NO: 16069 - RNA, 21 nt, Artificial Sequence
  RNA Oligomer
aaugauucaggaaccagagag

SEQ ID NO: 16070 - RNA, 21 nt, Artificial Sequence
  RNA Oligomer
acaacuguugacaacugcuga

SEQ ID NO: 16071 - RNA, 21 nt, Artificial Sequence
  RNA Oligomer
uugacaacugcugagaacuuc

SEQ ID NO: 16072 - RNA, 21 nt, Artificial Sequence
  RNA Oligomer
gacaacugcugagaacuuccg

SEQ ID NO: 16073 - RNA, 21 nt, Artificial Sequence
  RNA Oligomer
aucaaacauugagaacggacg

SEQ ID NO: 16074 - RNA, 21 nt, Artificial Sequence
  RNA Oligomer
uuuuagagccuuuaguuugug

SEQ ID NO: 16075 - RNA, 21 nt, Artificial Sequence
  RNA Oligomer
uuuagagccuuuaguuuguga

SEQ ID NO: 16076 - RNA, 21 nt, Artificial Sequence
  RNA Oligomer
cuucaaucuguugcugcuggc

SEQ ID NO: 16077 - RNA, 21 nt, Artificial Sequence
  RNA Oligomer
cuucacugacaauauacaagu

SEQ ID NO: 16078 - RNA, 21 nt, Artificial Sequence
  RNA Oligomer
aucacgcuaaauguccucuaa

SEQ ID NO: 16079 - RNA, 21 nt, Artificial Sequence
  RNA Oligomer
uucaucgcuuucaagcuacau

SEQ ID NO: 16080 - RNA, 21 nt, Artificial Sequence
  RNA Oligomer
uuucaucuucgucuucccugu

SEQ ID NO: 16081 - RNA, 21 nt, Artificial Sequence
  RNA Oligomer
aaauguucucugggugcugcu

SEQ ID NO: 16082 - RNA, 21 nt, Artificial Sequence
  RNA Oligomer
aaggugucuuuggaaggcugg

SEQ ID NO: 16083 - RNA, 21 nt, Artificial Sequence
  RNA Oligomer
ggaacaacuguugacaacugc

SEQ ID NO: 16084 - RNA, 21 nt, Artificial Sequence
  RNA Oligomer
agaguaccaaaggaagguggg

SEQ ID NO: 16085 - RNA, 21 nt, Artificial Sequence
  RNA Oligomer
aacuggauggauuuuagagcc

SEQ ID NO: 16086 - RNA, 21 nt, Artificial Sequence
  RNA Oligomer
uuugcuguagagcugccuucu

SEQ ID NO: 16087 - RNA, 21 nt, Artificial Sequence
  RNA Oligomer
acgagcucccucuguuuuugc

SEQ ID NO: 16088 - RNA, 21 nt, Artificial Sequence
  RNA Oligomer
aauuacugguaccguagcuua

SEQ ID NO: 16089 - RNA, 21 nt, Artificial Sequence
  RNA Oligomer
gucuugguuuaauucuugggu

SEQ ID NO: 16090 - RNA, 21 nt, Artificial Sequence
  RNA Oligomer
aauugggagcacugaguguag

SEQ ID NO: 16091 - RNA, 21 nt, Artificial Sequence
  RNA Oligomer
uaauuuaguugggcugagugg

SEQ ID NO: 16092 - RNA, 21 nt, Artificial Sequence
  RNA Oligomer
aacaacuguugacaacugcug

SEQ ID NO: 16093 - RNA, 21 nt, Artificial Sequence
  RNA Oligomer
aacuguugacaacugcugaga

SEQ ID NO: 16094 - RNA, 21 nt, Artificial Sequence
  RNA Oligomer
acuucagccaaauggcaauca

SEQ ID NO: 16095 - RNA, 21 nt, Artificial Sequence
  RNA Oligomer
agcuuggcauucugcucuuga

SEQ ID NO: 16096 - RNA, 21 nt, Artificial Sequence
  RNA Oligomer
uucuccugcucagcaacuugu

SEQ ID NO: 16097 - RNA, 21 nt, Artificial Sequence
  RNA Oligomer
ugggcuucaaucuguugcugc

SEQ ID NO: 16098 - RNA, 21 nt, Artificial Sequence
  RNA Oligomer
uuuuacgcaaguuuguccuuu

SEQ ID NO: 16099 - RNA, 21 nt, Artificial Sequence
  RNA Oligomer
uuuacgcaaguuuguccuuuu

SEQ ID NO: 16100 - RNA, 21 nt, Artificial Sequence
  RNA Oligomer
uuacgcaaguuuguccuuuua

SEQ ID NO: 16101 - RNA, 21 nt, Artificial Sequence
  RNA Oligomer
cuggcaugucacuguucucug

SEQ ID NO: 16102 - RNA, 21 nt, Artificial Sequence
  RNA Oligomer
acagaagcugacuuggauggg

SEQ ID NO: 16103 - RNA, 21 nt, Artificial Sequence
  RNA Oligomer
uucugaaggguggaaguaagg

SEQ ID NO: 16104 - RNA, 21 nt, Artificial Sequence
  RNA Oligomer
acuuucuugcuuagaaccugg

SEQ ID NO: 16105 - RNA, 21 nt, Artificial Sequence
  RNA Oligomer
gaacaacuguugacaacugcu

SEQ ID NO: 16106 - RNA, 21 nt, Artificial Sequence
  RNA Oligomer
auuugcaaccugagcaucccg

SEQ ID NO: 16107 - RNA, 21 nt, Artificial Sequence
  RNA Oligomer
agacgacuggauauagggacc

SEQ ID NO: 16108 - RNA, 21 nt, Artificial Sequence
  RNA Oligomer
gacgacuggauauagggaccu

SEQ ID NO: 16109 - RNA, 21 nt, Artificial Sequence
  RNA Oligomer
uuguuucuuagcugcagcucc

SEQ ID NO: 16110 - RNA, 21 nt, Artificial Sequence
  RNA Oligomer
uagaugcuuuauuucaucacg

SEQ ID NO: 16111 - RNA, 21 nt, Artificial Sequence
  RNA Oligomer
cuugguuuaauucuuggguac

SEQ ID NO: 16112 - RNA, 21 nt, Artificial Sequence
  RNA Oligomer
aguccauccaucacuaucagc

SEQ ID NO: 16113 - RNA, 21 nt, Artificial Sequence
  RNA Oligomer
agccaguuuuacgcaaguuug

SEQ ID NO: 16114 - RNA, 21 nt, Artificial Sequence
  RNA Oligomer
uacgcaaguuuguccuuuuac

SEQ ID NO: 16115 - RNA, 21 nt, Artificial Sequence
  RNA Oligomer
gcaccugaagaaugugaagga

SEQ ID NO: 16116 - RNA, 21 nt, Artificial Sequence
  RNA Oligomer
cgaagaguucuuugcggccuu

SEQ ID NO: 16117 - RNA, 21 nt, Artificial Sequence
  RNA Oligomer
ugucuucuacucgcaccugaa

SEQ ID NO: 16118 - RNA, 21 nt, Artificial Sequence
  RNA Oligomer
gaccucagauuuggacagcuu

SEQ ID NO: 16119 - RNA, 21 nt, Artificial Sequence
  RNA Oligomer
caggagaugcuucagaggauu

SEQ ID NO: 16120 - RNA, 21 nt, Artificial Sequence
  RNA Oligomer
ggaugacaucacagcucaggu

SEQ ID NO: 16121 - RNA, 21 nt, Artificial Sequence
  RNA Oligomer
accucagauuuggacagcuuu

SEQ ID NO: 16122 - RNA, 21 nt, Artificial Sequence
  RNA Oligomer
cugcacuguuucuuucaccuc

SEQ ID NO: 16123 - RNA, 21 nt, Artificial Sequence
  RNA Oligomer
ccuuccucacagugacacaca

SEQ ID NO: 16124 - RNA, 21 nt, Artificial Sequence
  RNA Oligomer
aggagaugcuucagaggauuc

SEQ ID NO: 16125 - RNA, 21 nt, Artificial Sequence
  RNA Oligomer
agaaucugcuuugucuucuac

SEQ ID NO: 16126 - RNA, 21 nt, Artificial Sequence
  RNA Oligomer
caccugaagaaugugaaggag

SEQ ID NO: 16127 - RNA, 21 nt, Artificial Sequence
  RNA Oligomer
gaaucugcuuugucuucuacu

SEQ ID NO: 16128 - RNA, 21 nt, Artificial Sequence
  RNA Oligomer
gcugcugcagguggaauucuu

SEQ ID NO: 16129 - RNA, 21 nt, Artificial Sequence
  RNA Oligomer
ugacuguguggagggcagaau

SEQ ID NO: 16130 - RNA, 21 nt, Artificial Sequence
  RNA Oligomer
gguggaauucuugcgucugag

SEQ ID NO: 16131 - RNA, 21 nt, Artificial Sequence
  RNA Oligomer
cugcugcagguggaauucuug

SEQ ID NO: 16132 - RNA, 21 nt, Artificial Sequence
  RNA Oligomer
cucugacacgguggagauguu

SEQ ID NO: 16133 - RNA, 21 nt, Artificial Sequence
  RNA Oligomer
cgccucgaucucucucagaau

SEQ ID NO: 16134 - RNA, 21 nt, Artificial Sequence
  RNA Oligomer
ggagggcagaaucugcuuugu

SEQ ID NO: 16135 - RNA, 21 nt, Artificial Sequence
  RNA Oligomer
gggcagaaucugcuuugucuu

SEQ ID NO: 16136 - RNA, 21 nt, Artificial Sequence
  RNA Oligomer
gcucuugcugucucacaacug

SEQ ID NO: 16137 - RNA, 21 nt, Artificial Sequence
  RNA Oligomer
gggucccugugagcaacaaaa

SEQ ID NO: 16138 - RNA, 21 nt, Artificial Sequence
  RNA Oligomer
gcacccuugaaucugggagau

SEQ ID NO: 16139 - RNA, 21 nt, Artificial Sequence
  RNA Oligomer
acuguuccugaccucagauuu

SEQ ID NO: 16140 - RNA, 21 nt, Artificial Sequence
  RNA Oligomer
ggaugagcagauccgucacau

SEQ ID NO: 16141 - RNA, 21 nt, Artificial Sequence
  RNA Oligomer
agacuguuccugaccucagau

SEQ ID NO: 16142 - RNA, 21 nt, Artificial Sequence
  RNA Oligomer
gcagguggaauucuugcgucu

SEQ ID NO: 16143 - RNA, 21 nt, Artificial Sequence
  RNA Oligomer
gacuguuccugaccucagauu

SEQ ID NO: 16144 - RNA, 21 nt, Artificial Sequence
  RNA Oligomer
gcagcccucauuccagaaaug

SEQ ID NO: 16145 - RNA, 21 nt, Artificial Sequence
  RNA Oligomer
acacgcuaccuccugagauug

SEQ ID NO: 16146 - RNA, 21 nt, Artificial Sequence
  RNA Oligomer
cucgcaccugaagaaugugaa

SEQ ID NO: 16147 - RNA, 21 nt, Artificial Sequence
  RNA Oligomer
cagaaucugcuuugucuucua

SEQ ID NO: 16148 - RNA, 21 nt, Artificial Sequence
  RNA Oligomer
gcucugguacaccaccaagaa

SEQ ID NO: 16149 - RNA, 21 nt, Artificial Sequence
  RNA Oligomer
gcaggagaugcuucagaggau

SEQ ID NO: 16150 - RNA, 21 nt, Artificial Sequence
  RNA Oligomer
cugucucacaacugccucucu

SEQ ID NO: 16151 - RNA, 21 nt, Artificial Sequence
  RNA Oligomer
ccacuucuccugguuccuugu

SEQ ID NO: 16152 - RNA, 21 nt, Artificial Sequence
  RNA Oligomer
cagaaucugcuggacacgcua

SEQ ID NO: 16153 - RNA, 21 nt, Artificial Sequence
  RNA Oligomer
cgcucuugcugucucacaacu

SEQ ID NO: 16154 - RNA, 21 nt, Artificial Sequence
  RNA Oligomer
ggucccugugagcaacaaaac

SEQ ID NO: 16155 - RNA, 21 nt, Artificial Sequence
  RNA Oligomer
cugcuuugucuucuacucgca

SEQ ID NO: 16156 - RNA, 21 nt, Artificial Sequence
  RNA Oligomer
gagggcagaaucugcuuuguc

SEQ ID NO: 16157 - RNA, 21 nt, Artificial Sequence
  RNA Oligomer
gucucacaacugccucucuga

SEQ ID NO: 16158 - RNA, 21 nt, Artificial Sequence
  RNA Oligomer
ugcgcucuugcugucucacaa

SEQ ID NO: 16159 - RNA, 21 nt, Artificial Sequence
  RNA Oligomer
ccugugagcaacaaaacugca

SEQ ID NO: 16160 - RNA, 21 nt, Artificial Sequence
  RNA Oligomer
cccugugagcaacaaaacugc

SEQ ID NO: 16161 - RNA, 21 nt, Artificial Sequence
  RNA Oligomer
ucgcaccugaagaaugugaag

SEQ ID NO: 16162 - RNA, 21 nt, Artificial Sequence
  RNA Oligomer
agauuuggacagcuuuccugu

SEQ ID NO: 16163 - RNA, 21 nt, Artificial Sequence
  RNA Oligomer
ggcagcccucauuccagaaau

SEQ ID NO: 16164 - RNA, 21 nt, Artificial Sequence
  RNA Oligomer
gccucgaucucucucagaauc

SEQ ID NO: 16165 - RNA, 21 nt, Artificial Sequence
  RNA Oligomer
ggaugaucuggaugagcagau

SEQ ID NO: 16166 - RNA, 21 nt, Artificial Sequence
  RNA Oligomer
gaguuccgggaugaucuggau

SEQ ID NO: 16167 - RNA, 21 nt, Artificial Sequence
  RNA Oligomer
ggaauucuugcgucugagcac

SEQ ID NO: 16168 - RNA, 21 nt, Artificial Sequence
  RNA Oligomer
ugcuuugucuucuacucgcac

SEQ ID NO: 16169 - RNA, 21 nt, Artificial Sequence
  RNA Oligomer
cagguggaauucuugcgucug

SEQ ID NO: 16170 - RNA, 21 nt, Artificial Sequence
  RNA Oligomer
cugguacaccaccaagaacug

SEQ ID NO: 16171 - RNA, 21 nt, Artificial Sequence
  RNA Oligomer
ugaccucagauuuggacagcu

SEQ ID NO: 16172 - RNA, 21 nt, Artificial Sequence
  RNA Oligomer
gacacgcuaccuccugagauu

SEQ ID NO: 16173 - RNA, 21 nt, Artificial Sequence
  RNA Oligomer
caccuuccucacagugacaca

SEQ ID NO: 16174 - RNA, 21 nt, Artificial Sequence
  RNA Oligomer
gcagauccgucacaugcucuu

SEQ ID NO: 16175 - RNA, 21 nt, Artificial Sequence
  RNA Oligomer
gcagaaucugcuuugucuucu

SEQ ID NO: 16176 - RNA, 21 nt, Artificial Sequence
  RNA Oligomer
cucuccuuggcacccuugaau

SEQ ID NO: 16177 - RNA, 21 nt, Artificial Sequence
  RNA Oligomer
gaagaguucuuugcggccuuc

SEQ ID NO: 16178 - RNA, 21 nt, Artificial Sequence
  RNA Oligomer
ucagauuuggacagcuuuccu

SEQ ID NO: 16179 - RNA, 21 nt, Artificial Sequence
  RNA Oligomer
ggcagaaucugcuuugucuuc

SEQ ID NO: 16180 - RNA, 21 nt, Artificial Sequence
  RNA Oligomer
agaaaugcccagacuguuccu

SEQ ID NO: 16181 - RNA, 21 nt, Artificial Sequence
  RNA Oligomer
ccagaaaugcccagacuguuc

SEQ ID NO: 16182 - RNA, 21 nt, Artificial Sequence
  RNA Oligomer
agcagauccgucacaugcucu

SEQ ID NO: 16183 - RNA, 21 nt, Artificial Sequence
  RNA Oligomer
cacccuugaaucugggagaug

SEQ ID NO: 16184 - RNA, 21 nt, Artificial Sequence
  RNA Oligomer
cccucauuccagaaaugccca

SEQ ID NO: 16185 - RNA, 21 nt, Artificial Sequence
  RNA Oligomer
ccucgaucucucucagaaucu

SEQ ID NO: 16186 - RNA, 21 nt, Artificial Sequence
  RNA Oligomer
uccagaaaugcccagacuguu

SEQ ID NO: 16187 - RNA, 21 nt, Artificial Sequence
  RNA Oligomer
ucauuccagaaaugcccagac

SEQ ID NO: 16188 - RNA, 21 nt, Artificial Sequence
  RNA Oligomer
ugggaugacaucacagcucag

SEQ ID NO: 16189 - RNA, 21 nt, Artificial Sequence
  RNA Oligomer
cugggaugacaucacagcuca

SEQ ID NO: 16190 - RNA, 21 nt, Artificial Sequence
  RNA Oligomer
cgaucucucucagaaucugcu

SEQ ID NO: 16191 - RNA, 21 nt, Artificial Sequence
  RNA Oligomer
guacaccaccaagaacugugu

SEQ ID NO: 16192 - RNA, 21 nt, Artificial Sequence
  RNA Oligomer
uccuucacauucuucaggugc

SEQ ID NO: 16193 - RNA, 21 nt, Artificial Sequence
  RNA Oligomer
aaggccgcaaagaacucuucg

SEQ ID NO: 16194 - RNA, 21 nt, Artificial Sequence
  RNA Oligomer
uucaggugcgaguagaagaca

SEQ ID NO: 16195 - RNA, 21 nt, Artificial Sequence
  RNA Oligomer
aagcuguccaaaucugagguc

SEQ ID NO: 16196 - RNA, 21 nt, Artificial Sequence
  RNA Oligomer
aauccucugaagcaucuccug

SEQ ID NO: 16197 - RNA, 21 nt, Artificial Sequence
  RNA Oligomer
accugagcugugaugucaucc

SEQ ID NO: 16198 - RNA, 21 nt, Artificial Sequence
  RNA Oligomer
aaagcuguccaaaucugaggu

SEQ ID NO: 16199 - RNA, 21 nt, Artificial Sequence
  RNA Oligomer
gaggugaaagaaacagugcag

SEQ ID NO: 16200 - RNA, 21 nt, Artificial Sequence
  RNA Oligomer
ugugugucacugugaggaagg

SEQ ID NO: 16201 - RNA, 21 nt, Artificial Sequence
  RNA Oligomer
gaauccucugaagcaucuccu

SEQ ID NO: 16202 - RNA, 21 nt, Artificial Sequence
  RNA Oligomer
guagaagacaaagcagauucu

SEQ ID NO: 16203 - RNA, 21 nt, Artificial Sequence
  RNA Oligomer
cuccuucacauucuucaggug

SEQ ID NO: 16204 - RNA, 21 nt, Artificial Sequence
  RNA Oligomer
aguagaagacaaagcagauuc

SEQ ID NO: 16205 - RNA, 21 nt, Artificial Sequence
  RNA Oligomer
aagaauuccaccugcagcagc

SEQ ID NO: 16206 - RNA, 21 nt, Artificial Sequence
  RNA Oligomer
auucugcccuccacacaguca

SEQ ID NO: 16207 - RNA, 21 nt, Artificial Sequence
  RNA Oligomer
cucagacgcaagaauuccacc

SEQ ID NO: 16208 - RNA, 21 nt, Artificial Sequence
  RNA Oligomer
caagaauuccaccugcagcag

SEQ ID NO: 16209 - RNA, 21 nt, Artificial Sequence
  RNA Oligomer
aacaucuccaccgugucagag

SEQ ID NO: 16210 - RNA, 21 nt, Artificial Sequence
  RNA Oligomer
auucugagagagaucgaggcg

SEQ ID NO: 16211 - RNA, 21 nt, Artificial Sequence
  RNA Oligomer
acaaagcagauucugcccucc

SEQ ID NO: 16212 - RNA, 21 nt, Artificial Sequence
  RNA Oligomer
aagacaaagcagauucugccc

SEQ ID NO: 16213 - RNA, 21 nt, Artificial Sequence
  RNA Oligomer
caguugugagacagcaagagc

SEQ ID NO: 16214 - RNA, 21 nt, Artificial Sequence
  RNA Oligomer
uuuuguugcucacagggaccc

SEQ ID NO: 16215 - RNA, 21 nt, Artificial Sequence
  RNA Oligomer
aucucccagauucaagggugc

SEQ ID NO: 16216 - RNA, 21 nt, Artificial Sequence
  RNA Oligomer
aaaucugaggucaggaacagu

SEQ ID NO: 16217 - RNA, 21 nt, Artificial Sequence
  RNA Oligomer
augugacggaucugcucaucc

SEQ ID NO: 16218 - RNA, 21 nt, Artificial Sequence
  RNA Oligomer
aucugaggucaggaacagucu

SEQ ID NO: 16219 - RNA, 21 nt, Artificial Sequence
  RNA Oligomer
agacgcaagaauuccaccugc

SEQ ID NO: 16220 - RNA, 21 nt, Artificial Sequence
  RNA Oligomer
aaucugaggucaggaacaguc

SEQ ID NO: 16221 - RNA, 21 nt, Artificial Sequence
  RNA Oligomer
cauuucuggaaugagggcugc

SEQ ID NO: 16222 - RNA, 21 nt, Artificial Sequence
  RNA Oligomer
caaucucaggagguagcgugu

SEQ ID NO: 16223 - RNA, 21 nt, Artificial Sequence
  RNA Oligomer
uucacauucuucaggugcgag

SEQ ID NO: 16224 - RNA, 21 nt, Artificial Sequence
  RNA Oligomer
uagaagacaaagcagauucug

SEQ ID NO: 16225 - RNA, 21 nt, Artificial Sequence
  RNA Oligomer
uucuuggugguguaccagagc

SEQ ID NO: 16226 - RNA, 21 nt, Artificial Sequence
  RNA Oligomer
auccucugaagcaucuccugc

SEQ ID NO: 16227 - RNA, 21 nt, Artificial Sequence
  RNA Oligomer
agagaggcaguugugagacag

SEQ ID NO: 16228 - RNA, 21 nt, Artificial Sequence
  RNA Oligomer
acaaggaaccaggagaagugg

SEQ ID NO: 16229 - RNA, 21 nt, Artificial Sequence
  RNA Oligomer
uagcguguccagcagauucug

SEQ ID NO: 16230 - RNA, 21 nt, Artificial Sequence
  RNA Oligomer
aguugugagacagcaagagcg

SEQ ID NO: 16231 - RNA, 21 nt, Artificial Sequence
  RNA Oligomer
guuuuguugcucacagggacc

SEQ ID NO: 16232 - RNA, 21 nt, Artificial Sequence
  RNA Oligomer
ugcgaguagaagacaaagcag

SEQ ID NO: 16233 - RNA, 21 nt, Artificial Sequence
  RNA Oligomer
gacaaagcagauucugcccuc

SEQ ID NO: 16234 - RNA, 21 nt, Artificial Sequence
  RNA Oligomer
ucagagaggcaguugugagac

SEQ ID NO: 16235 - RNA, 21 nt, Artificial Sequence
  RNA Oligomer
uugugagacagcaagagcgca

SEQ ID NO: 16236 - RNA, 21 nt, Artificial Sequence
  RNA Oligomer
ugcaguuuuguugcucacagg

SEQ ID NO: 16237 - RNA, 21 nt, Artificial Sequence
  RNA Oligomer
gcaguuuuguugcucacaggg

SEQ ID NO: 16238 - RNA, 21 nt, Artificial Sequence
  RNA Oligomer
cuucacauucuucaggugcga

SEQ ID NO: 16239 - RNA, 21 nt, Artificial Sequence
  RNA Oligomer
acaggaaagcuguccaaaucu

SEQ ID NO: 16240 - RNA, 21 nt, Artificial Sequence
  RNA Oligomer
auuucuggaaugagggcugcc

SEQ ID NO: 16241 - RNA, 21 nt, Artificial Sequence
  RNA Oligomer
gauucugagagagaucgaggc

SEQ ID NO: 16242 - RNA, 21 nt, Artificial Sequence
  RNA Oligomer
aucugcucauccagaucaucc

SEQ ID NO: 16243 - RNA, 21 nt, Artificial Sequence
  RNA Oligomer
auccagaucaucccggaacuc

SEQ ID NO: 16244 - RNA, 21 nt, Artificial Sequence
  RNA Oligomer
gugcucagacgcaagaauucc

SEQ ID NO: 16245 - RNA, 21 nt, Artificial Sequence
  RNA Oligomer
gugcgaguagaagacaaagca

SEQ ID NO: 16246 - RNA, 21 nt, Artificial Sequence
  RNA Oligomer
cagacgcaagaauuccaccug

SEQ ID NO: 16247 - RNA, 21 nt, Artificial Sequence
  RNA Oligomer
caguucuuggugguguaccag

SEQ ID NO: 16248 - RNA, 21 nt, Artificial Sequence
  RNA Oligomer
agcuguccaaaucugagguca

SEQ ID NO: 16249 - RNA, 21 nt, Artificial Sequence
  RNA Oligomer
aaucucaggagguagcguguc

SEQ ID NO: 16250 - RNA, 21 nt, Artificial Sequence
  RNA Oligomer
ugugucacugugaggaaggug

SEQ ID NO: 16251 - RNA, 21 nt, Artificial Sequence
  RNA Oligomer
aagagcaugugacggaucugc

SEQ ID NO: 16252 - RNA, 21 nt, Artificial Sequence
  RNA Oligomer
agaagacaaagcagauucugc

SEQ ID NO: 16253 - RNA, 21 nt, Artificial Sequence
  RNA Oligomer
auucaagggugccaaggagag

SEQ ID NO: 16254 - RNA, 21 nt, Artificial Sequence
  RNA Oligomer
gaaggccgcaaagaacucuuc

SEQ ID NO: 16255 - RNA, 21 nt, Artificial Sequence
  RNA Oligomer
aggaaagcuguccaaaucuga

SEQ ID NO: 16256 - RNA, 21 nt, Artificial Sequence
  RNA Oligomer
gaagacaaagcagauucugcc

SEQ ID NO: 16257 - RNA, 21 nt, Artificial Sequence
  RNA Oligomer
aggaacagucugggcauuucu

SEQ ID NO: 16258 - RNA, 21 nt, Artificial Sequence
  RNA Oligomer
gaacagucugggcauuucugg

SEQ ID NO: 16259 - RNA, 21 nt, Artificial Sequence
  RNA Oligomer
agagcaugugacggaucugcu

SEQ ID NO: 16260 - RNA, 21 nt, Artificial Sequence
  RNA Oligomer
caucucccagauucaagggug

SEQ ID NO: 16261 - RNA, 21 nt, Artificial Sequence
  RNA Oligomer
ugggcauuucuggaaugaggg

SEQ ID NO: 16262 - RNA, 21 nt, Artificial Sequence
  RNA Oligomer
agauucugagagagaucgagg

SEQ ID NO: 16263 - RNA, 21 nt, Artificial Sequence
  RNA Oligomer
aacagucugggcauuucugga

SEQ ID NO: 16264 - RNA, 21 nt, Artificial Sequence
  RNA Oligomer
gucugggcauuucuggaauga

SEQ ID NO: 16265 - RNA, 21 nt, Artificial Sequence
  RNA Oligomer
cugagcugugaugucauccca

SEQ ID NO: 16266 - RNA, 21 nt, Artificial Sequence
  RNA Oligomer
ugagcugugaugucaucccag

SEQ ID NO: 16267 - RNA, 21 nt, Artificial Sequence
  RNA Oligomer
agcagauucugagagagaucg

SEQ ID NO: 16268 - RNA, 21 nt, Artificial Sequence
  RNA Oligomer
acacaguucuuggugguguac

SEQ ID NO: 16269 - RNA, 21 nt, Artificial Sequence
  RNA Oligomer
ggaauuacuauguucgggccg

SEQ ID NO: 16270 - RNA, 21 nt, Artificial Sequence
  RNA Oligomer
cgggcccuuuaccaggaauua

SEQ ID NO: 16271 - RNA, 21 nt, Artificial Sequence
  RNA Oligomer
gcccuuuaccaggaauuacua

SEQ ID NO: 16272 - RNA, 21 nt, Artificial Sequence
  RNA Oligomer
cgcuucacccagugguacuuu

SEQ ID NO: 16273 - RNA, 21 nt, Artificial Sequence
  RNA Oligomer
ggcccuuuaccaggaauuacu

SEQ ID NO: 16274 - RNA, 21 nt, Artificial Sequence
  RNA Oligomer
ucgggcccuuuaccaggaauu

SEQ ID NO: 16275 - RNA, 21 nt, Artificial Sequence
  RNA Oligomer
cccuuuaccaggaauuacuau

SEQ ID NO: 16276 - RNA, 21 nt, Artificial Sequence
  RNA Oligomer
ccagugguacuuuggugccua

SEQ ID NO: 16277 - RNA, 21 nt, Artificial Sequence
  RNA Oligomer
gggcccuuuaccaggaauuac

SEQ ID NO: 16278 - RNA, 21 nt, Artificial Sequence
  RNA Oligomer
ugaagcuguucgggcccuuua

SEQ ID NO: 16279 - RNA, 21 nt, Artificial Sequence
  RNA Oligomer
cagugguacuuuggugccuac

SEQ ID NO: 16280 - RNA, 21 nt, Artificial Sequence
  RNA Oligomer
aggugcacccaccugcaauaa

SEQ ID NO: 16281 - RNA, 21 nt, Artificial Sequence
  RNA Oligomer
acagaaguacaugaccgccgu

SEQ ID NO: 16282 - RNA, 21 nt, Artificial Sequence
  RNA Oligomer
ggugcacccaccugcaauaaa

SEQ ID NO: 16283 - RNA, 21 nt, Artificial Sequence
  RNA Oligomer
guacuuuggugccuacuccau

SEQ ID NO: 16284 - RNA, 21 nt, Artificial Sequence
  RNA Oligomer
gguacuuuggugccuacucca

SEQ ID NO: 16285 - RNA, 21 nt, Artificial Sequence
  RNA Oligomer
cggcccgaacauaguaauucc

SEQ ID NO: 16286 - RNA, 21 nt, Artificial Sequence
  RNA Oligomer
uaauuccugguaaagggcccg

SEQ ID NO: 16287 - RNA, 21 nt, Artificial Sequence
  RNA Oligomer
uaguaauuccugguaaagggc

SEQ ID NO: 16288 - RNA, 21 nt, Artificial Sequence
  RNA Oligomer
aaaguaccacugggugaagcg

SEQ ID NO: 16289 - RNA, 21 nt, Artificial Sequence
  RNA Oligomer
aguaauuccugguaaagggcc

SEQ ID NO: 16290 - RNA, 21 nt, Artificial Sequence
  RNA Oligomer
aauuccugguaaagggcccga

SEQ ID NO: 16291 - RNA, 21 nt, Artificial Sequence
  RNA Oligomer
auaguaauuccugguaaaggg

SEQ ID NO: 16292 - RNA, 21 nt, Artificial Sequence
  RNA Oligomer
uaggcaccaaaguaccacugg

SEQ ID NO: 16293 - RNA, 21 nt, Artificial Sequence
  RNA Oligomer
guaauuccugguaaagggccc

SEQ ID NO: 16294 - RNA, 21 nt, Artificial Sequence
  RNA Oligomer
uaaagggcccgaacagcuuca

SEQ ID NO: 16295 - RNA, 21 nt, Artificial Sequence
  RNA Oligomer
guaggcaccaaaguaccacug

SEQ ID NO: 16296 - RNA, 21 nt, Artificial Sequence
  RNA Oligomer
uuauugcaggugggugcaccu

SEQ ID NO: 16297 - RNA, 21 nt, Artificial Sequence
  RNA Oligomer
acggcggucauguacuucugu

SEQ ID NO: 16298 - RNA, 21 nt, Artificial Sequence
  RNA Oligomer
uuuauugcaggugggugcacc

SEQ ID NO: 16299 - RNA, 21 nt, Artificial Sequence
  RNA Oligomer
auggaguaggcaccaaaguac

SEQ ID NO: 16300 - RNA, 21 nt, Artificial Sequence
  RNA Oligomer
uggaguaggcaccaaaguacc

SEQ ID NO: 16301 - RNA, 21 nt, Artificial Sequence
  RNA Oligomer
ccugaagaagaugaaaggaaa

SEQ ID NO: 16302 - RNA, 21 nt, Artificial Sequence
  RNA Oligomer
cugaagaagaugaaaggaaaa

SEQ ID NO: 16303 - RNA, 21 nt, Artificial Sequence
  RNA Oligomer
gcgacgagaaagaaauaagau

SEQ ID NO: 16304 - RNA, 21 nt, Artificial Sequence
  RNA Oligomer
gcaagaaaacuaggcaaugua

SEQ ID NO: 16305 - RNA, 21 nt, Artificial Sequence
  RNA Oligomer
ggaaaaagaggcgacgagaaa

SEQ ID NO: 16306 - RNA, 21 nt, Artificial Sequence
  RNA Oligomer
ccucauugaauccucauuuua

SEQ ID NO: 16307 - RNA, 21 nt, Artificial Sequence
  RNA Oligomer
ccgaaacaagaagaaggagaa

SEQ ID NO: 16308 - RNA, 21 nt, Artificial Sequence
  RNA Oligomer
cgagaaagaaauaagauugca

SEQ ID NO: 16309 - RNA, 21 nt, Artificial Sequence
  RNA Oligomer
cgacgagaaagaaauaagauu

SEQ ID NO: 16310 - RNA, 21 nt, Artificial Sequence
  RNA Oligomer
gaagaagaugaaaggaaaaag

SEQ ID NO: 16311 - RNA, 21 nt, Artificial Sequence
  RNA Oligomer
gaauccucauuuuauacccaa

SEQ ID NO: 16312 - RNA, 21 nt, Artificial Sequence
  RNA Oligomer
ggcgacgagaaagaaauaaga

SEQ ID NO: 16313 - RNA, 21 nt, Artificial Sequence
  RNA Oligomer
agaggcgacgagaaagaaaua

SEQ ID NO: 16314 - RNA, 21 nt, Artificial Sequence
  RNA Oligomer
agaagaugaaaggaaaaagag

SEQ ID NO: 16315 - RNA, 21 nt, Artificial Sequence
  RNA Oligomer
agaaauugugugugcaagaaa

SEQ ID NO: 16316 - RNA, 21 nt, Artificial Sequence
  RNA Oligomer
ccagaaauugugugugcaaga

SEQ ID NO: 16317 - RNA, 21 nt, Artificial Sequence
  RNA Oligomer
uccucauugaauccucauuuu

SEQ ID NO: 16318 - RNA, 21 nt, Artificial Sequence
  RNA Oligomer
gacgagaaagaaauaagauug

SEQ ID NO: 16319 - RNA, 21 nt, Artificial Sequence
  RNA Oligomer
ggaagaaagcagaaaguucaa

SEQ ID NO: 16320 - RNA, 21 nt, Artificial Sequence
  RNA Oligomer
cgaaacaagaagaaggagaag

SEQ ID NO: 16321 - RNA, 21 nt, Artificial Sequence
  RNA Oligomer
aggcgacgagaaagaaauaag

SEQ ID NO: 16322 - RNA, 21 nt, Artificial Sequence
  RNA Oligomer
ggaugucaauagcauuguuuu

SEQ ID NO: 16323 - RNA, 21 nt, Artificial Sequence
  RNA Oligomer
ugaauccucauuuuauaccca

SEQ ID NO: 16324 - RNA, 21 nt, Artificial Sequence
  RNA Oligomer
guccucauugaauccucauuu

SEQ ID NO: 16325 - RNA, 21 nt, Artificial Sequence
  RNA Oligomer
aggaaaaagaggcgacgagaa

SEQ ID NO: 16326 - RNA, 21 nt, Artificial Sequence
  RNA Oligomer
cagcaagaggaggacagaauu

SEQ ID NO: 16327 - RNA, 21 nt, Artificial Sequence
  RNA Oligomer
gaaggaacauugcagagcuaa

SEQ ID NO: 16328 - RNA, 21 nt, Artificial Sequence
  RNA Oligomer
agaaggaacauugcagagcua

SEQ ID NO: 16329 - RNA, 21 nt, Artificial Sequence
  RNA Oligomer
gagaaagaaauaagauugcag

SEQ ID NO: 16330 - RNA, 21 nt, Artificial Sequence
  RNA Oligomer
gaaaggaaaaagaggcgacga

SEQ ID NO: 16331 - RNA, 21 nt, Artificial Sequence
  RNA Oligomer
gaaauugugugugcaagaaaa

SEQ ID NO: 16332 - RNA, 21 nt, Artificial Sequence
  RNA Oligomer
gccuuucaucuggauucuaca

SEQ ID NO: 16333 - RNA, 21 nt, Artificial Sequence
  RNA Oligomer
ccgccuuucaucuggauucua

SEQ ID NO: 16334 - RNA, 21 nt, Artificial Sequence
  RNA Oligomer
acccaaaacccugaagccauu

SEQ ID NO: 16335 - RNA, 21 nt, Artificial Sequence
  RNA Oligomer
ccaacagauaaaagaaggaac

SEQ ID NO: 16336 - RNA, 21 nt, Artificial Sequence
  RNA Oligomer
auauacaugcucaaccuucau

SEQ ID NO: 16337 - RNA, 21 nt, Artificial Sequence
  RNA Oligomer
gaaagaaauaagauugcagcu

SEQ ID NO: 16338 - RNA, 21 nt, Artificial Sequence
  RNA Oligomer
gccaaagaauauuccauuuuc

SEQ ID NO: 16339 - RNA, 21 nt, Artificial Sequence
  RNA Oligomer
gcaagaggaggacagaauucu

SEQ ID NO: 16340 - RNA, 21 nt, Artificial Sequence
  RNA Oligomer
caagaaaacuaggcaauguac

SEQ ID NO: 16341 - RNA, 21 nt, Artificial Sequence
  RNA Oligomer
guccagaaauugugugugcaa

SEQ ID NO: 16342 - RNA, 21 nt, Artificial Sequence
  RNA Oligomer
ucacugguguuugaggauuuu

SEQ ID NO: 16343 - RNA, 21 nt, Artificial Sequence
  RNA Oligomer
caacagauaaaagaaggaaca

SEQ ID NO: 16344 - RNA, 21 nt, Artificial Sequence
  RNA Oligomer
cgagaagcagcauuugauaua

SEQ ID NO: 16345 - RNA, 21 nt, Artificial Sequence
  RNA Oligomer
caagaacgagaagcagcauuu

SEQ ID NO: 16346 - RNA, 21 nt, Artificial Sequence
  RNA Oligomer
gccgaaacaagaagaaggaga

SEQ ID NO: 16347 - RNA, 21 nt, Artificial Sequence
  RNA Oligomer
gugccgaaacaagaagaagga

SEQ ID NO: 16348 - RNA, 21 nt, Artificial Sequence
  RNA Oligomer
aaagugccgaaacaagaagaa

SEQ ID NO: 16349 - RNA, 21 nt, Artificial Sequence
  RNA Oligomer
caaagugccgaaacaagaaga

SEQ ID NO: 16350 - RNA, 21 nt, Artificial Sequence
  RNA Oligomer
gcaaagugccgaaacaagaag

SEQ ID NO: 16351 - RNA, 21 nt, Artificial Sequence
  RNA Oligomer
ggcuacugucuauuaaaauuc

SEQ ID NO: 16352 - RNA, 21 nt, Artificial Sequence
  RNA Oligomer
uggaugucaauagcauuguuu

SEQ ID NO: 16353 - RNA, 21 nt, Artificial Sequence
  RNA Oligomer
caguggagagauguuuggaaa

SEQ ID NO: 16354 - RNA, 21 nt, Artificial Sequence
  RNA Oligomer
uguugcaaacucaguuccaaa

SEQ ID NO: 16355 - RNA, 21 nt, Artificial Sequence
  RNA Oligomer
ucagcaagaggaggacagaau

SEQ ID NO: 16356 - RNA, 21 nt, Artificial Sequence
  RNA Oligomer
cagaaauugugugugcaagaa

SEQ ID NO: 16357 - RNA, 21 nt, Artificial Sequence
  RNA Oligomer
gggucacugguguuugaggau

SEQ ID NO: 16358 - RNA, 21 nt, Artificial Sequence
  RNA Oligomer
gucauguagcuguuuuaagaa

SEQ ID NO: 16359 - RNA, 21 nt, Artificial Sequence
  RNA Oligomer
gcauuguuuuugucauguagc

SEQ ID NO: 16360 - RNA, 21 nt, Artificial Sequence
  RNA Oligomer
ccaaagaauauuccauuuucc

SEQ ID NO: 16361 - RNA, 21 nt, Artificial Sequence
  RNA Oligomer
ggaguugugucuaggcuggaa

SEQ ID NO: 16362 - RNA, 21 nt, Artificial Sequence
  RNA Oligomer
gucaaggaagagcugagguuu

SEQ ID NO: 16363 - RNA, 21 nt, Artificial Sequence
  RNA Oligomer
agaucugguuucuaagaguuu

SEQ ID NO: 16364 - RNA, 21 nt, Artificial Sequence
  RNA Oligomer
aaauugugugugcaagaaaac

SEQ ID NO: 16365 - RNA, 21 nt, Artificial Sequence
  RNA Oligomer
gucacugguguuugaggauuu

SEQ ID NO: 16366 - RNA, 21 nt, Artificial Sequence
  RNA Oligomer
ggauuuaggccuuaacacacu

SEQ ID NO: 16367 - RNA, 21 nt, Artificial Sequence
  RNA Oligomer
uugauauacaugcucaaccuu

SEQ ID NO: 16368 - RNA, 21 nt, Artificial Sequence
  RNA Oligomer
ggagaagcuggaaagugugaa

SEQ ID NO: 16369 - RNA, 21 nt, Artificial Sequence
  RNA Oligomer
gaagaaggagaagacggagug

SEQ ID NO: 16370 - RNA, 21 nt, Artificial Sequence
  RNA Oligomer
cuggcuacugucuauuaaaau

SEQ ID NO: 16371 - RNA, 21 nt, Artificial Sequence
  RNA Oligomer
guagcuguuuuaagaaaucug

SEQ ID NO: 16372 - RNA, 21 nt, Artificial Sequence
  RNA Oligomer
agcauuguuuuugucauguag

SEQ ID NO: 16373 - RNA, 21 nt, Artificial Sequence
  RNA Oligomer
ccacucaaugucuuaggucag

SEQ ID NO: 16374 - RNA, 21 nt, Artificial Sequence
  RNA Oligomer
acaggaagaaagcagaaaguu

SEQ ID NO: 16375 - RNA, 21 nt, Artificial Sequence
  RNA Oligomer
caagauauucagguggccaga

SEQ ID NO: 16376 - RNA, 21 nt, Artificial Sequence
  RNA Oligomer
cagaucugguuucuaagaguu

SEQ ID NO: 16377 - RNA, 21 nt, Artificial Sequence
  RNA Oligomer
ccuuucaucuggauucuacaa

SEQ ID NO: 16378 - RNA, 21 nt, Artificial Sequence
  RNA Oligomer
cuuaacacacuggccauucuu

SEQ ID NO: 16379 - RNA, 21 nt, Artificial Sequence
  RNA Oligomer
gaacgagaagcagcauuugau

SEQ ID NO: 16380 - RNA, 21 nt, Artificial Sequence
  RNA Oligomer
uguuuuugucauguagcuguu

SEQ ID NO: 16381 - RNA, 21 nt, Artificial Sequence
  RNA Oligomer
gucaauagcauuguuuuuguc

SEQ ID NO: 16382 - RNA, 21 nt, Artificial Sequence
  RNA Oligomer
gagccaaagaauauuccauuu

SEQ ID NO: 16383 - RNA, 21 nt, Artificial Sequence
  RNA Oligomer
agagccaaagaauauuccauu

SEQ ID NO: 16384 - RNA, 21 nt, Artificial Sequence
  RNA Oligomer
acagaauucucccagcguuaa

SEQ ID NO: 16385 - RNA, 21 nt, Artificial Sequence
  RNA Oligomer
aaaacuaggcaauguacucuu

SEQ ID NO: 16386 - RNA, 21 nt, Artificial Sequence
  RNA Oligomer
guggagugagaacagcauuua

SEQ ID NO: 16387 - RNA, 21 nt, Artificial Sequence
  RNA Oligomer
cgccuuucaucuggauucuac

SEQ ID NO: 16388 - RNA, 21 nt, Artificial Sequence
  RNA Oligomer
aacgagaagcagcauuugaua

SEQ ID NO: 16389 - RNA, 21 nt, Artificial Sequence
  RNA Oligomer
uuggaugucaauagcauuguu

SEQ ID NO: 16390 - RNA, 21 nt, Artificial Sequence
  RNA Oligomer
uggagagauguuuggaaacca

SEQ ID NO: 16391 - RNA, 21 nt, Artificial Sequence
  RNA Oligomer
ucaguggagagauguuuggaa

SEQ ID NO: 16392 - RNA, 21 nt, Artificial Sequence
  RNA Oligomer
cagucaguggagagauguuug

SEQ ID NO: 16393 - RNA, 21 nt, Artificial Sequence
  RNA Oligomer
cugaugugacuuuuauaugcu

SEQ ID NO: 16394 - RNA, 21 nt, Artificial Sequence
  RNA Oligomer
cugguguuugaggauuuugcu

SEQ ID NO: 16395 - RNA, 21 nt, Artificial Sequence
  RNA Oligomer
gugaaauucucagaguguuua

SEQ ID NO: 16396 - RNA, 21 nt, Artificial Sequence
  RNA Oligomer
cugauguuucugugaaauucu

SEQ ID NO: 16397 - RNA, 21 nt, Artificial Sequence
  RNA Oligomer
guuuuugucauguagcuguuu

SEQ ID NO: 16398 - RNA, 21 nt, Artificial Sequence
  RNA Oligomer
gaguugugucuaggcuggaag

SEQ ID NO: 16399 - RNA, 21 nt, Artificial Sequence
  RNA Oligomer
ucaggaguugugucuaggcug

SEQ ID NO: 16400 - RNA, 21 nt, Artificial Sequence
  RNA Oligomer
gacucuccacucaaugucuua

SEQ ID NO: 16401 - RNA, 21 nt, Artificial Sequence
  RNA Oligomer
ggguuaggacucuccacucaa

SEQ ID NO: 16402 - RNA, 21 nt, Artificial Sequence
  RNA Oligomer
ccaaagucacaggaagaaagc

SEQ ID NO: 16403 - RNA, 21 nt, Artificial Sequence
  RNA Oligomer
cucaagauauucagguggcca

SEQ ID NO: 16404 - RNA, 21 nt, Artificial Sequence
  RNA Oligomer
ggagugagaacagcauuuagu

SEQ ID NO: 16405 - RNA, 21 nt, Artificial Sequence
  RNA Oligomer
ccuuaacacacuggccauucu

SEQ ID NO: 16406 - RNA, 21 nt, Artificial Sequence
  RNA Oligomer
acgagaagcagcauuugauau

SEQ ID NO: 16407 - RNA, 21 nt, Artificial Sequence
  RNA Oligomer
ucaagaacgagaagcagcauu

SEQ ID NO: 16408 - RNA, 21 nt, Artificial Sequence
  RNA Oligomer
ucggagaagcuggaaagugug

SEQ ID NO: 16409 - RNA, 21 nt, Artificial Sequence
  RNA Oligomer
gaaaucuggcccaggguguuu

SEQ ID NO: 16410 - RNA, 21 nt, Artificial Sequence
  RNA Oligomer
agaaaucuggcccaggguguu

SEQ ID NO: 16411 - RNA, 21 nt, Artificial Sequence
  RNA Oligomer
gucuuaggucaggaguugugu

SEQ ID NO: 16412 - RNA, 21 nt, Artificial Sequence
  RNA Oligomer
cacaggaagaaagcagaaagu

SEQ ID NO: 16413 - RNA, 21 nt, Artificial Sequence
  RNA Oligomer
ucacaggaagaaagcagaaag

SEQ ID NO: 16414 - RNA, 21 nt, Artificial Sequence
  RNA Oligomer
guguuugaggauuuugcuaac

SEQ ID NO: 16415 - RNA, 21 nt, Artificial Sequence
  RNA Oligomer
gguguuugaggauuuugcuaa

SEQ ID NO: 16416 - RNA, 21 nt, Artificial Sequence
  RNA Oligomer
uggagugagaacagcauuuag

SEQ ID NO: 16417 - RNA, 21 nt, Artificial Sequence
  RNA Oligomer
ggauguggagugagaacagca

SEQ ID NO: 16418 - RNA, 21 nt, Artificial Sequence
  RNA Oligomer
cacugguguuugaggauuuug

SEQ ID NO: 16419 - RNA, 21 nt, Artificial Sequence
  RNA Oligomer
cggagaagcuggaaaguguga

SEQ ID NO: 16420 - RNA, 21 nt, Artificial Sequence
  RNA Oligomer
ccauccagaacaagcaccucu

SEQ ID NO: 16421 - RNA, 21 nt, Artificial Sequence
  RNA Oligomer
gaauauuccauuuuccuuucc

SEQ ID NO: 16422 - RNA, 21 nt, Artificial Sequence
  RNA Oligomer
aggaguugugucuaggcugga

SEQ ID NO: 16423 - RNA, 21 nt, Artificial Sequence
  RNA Oligomer
ccagaagagcuugucagcaag

SEQ ID NO: 16424 - RNA, 21 nt, Artificial Sequence
  RNA Oligomer
ggguugugcuuucuagcaaau

SEQ ID NO: 16425 - RNA, 21 nt, Artificial Sequence
  RNA Oligomer
ugguguuugaggauuuugcua

SEQ ID NO: 16426 - RNA, 21 nt, Artificial Sequence
  RNA Oligomer
gaaugggaggacuccagaaga

SEQ ID NO: 16427 - RNA, 21 nt, Artificial Sequence
  RNA Oligomer
gauguuucugugaaauucuca

SEQ ID NO: 16428 - RNA, 21 nt, Artificial Sequence
  RNA Oligomer
uccuuuccuugugguugaaaa

SEQ ID NO: 16429 - RNA, 21 nt, Artificial Sequence
  RNA Oligomer
caaugucuuaggucaggaguu

SEQ ID NO: 16430 - RNA, 21 nt, Artificial Sequence
  RNA Oligomer
cucccagcguuaacacaaaau

SEQ ID NO: 16431 - RNA, 21 nt, Artificial Sequence
  RNA Oligomer
ggucacugguguuugaggauu

SEQ ID NO: 16432 - RNA, 21 nt, Artificial Sequence
  RNA Oligomer
gaagagccaaagaauauucca

SEQ ID NO: 16433 - RNA, 21 nt, Artificial Sequence
  RNA Oligomer
uggaagagccaaagaauauuc

SEQ ID NO: 16434 - RNA, 21 nt, Artificial Sequence
  RNA Oligomer
ucaaugucuuaggucaggagu

SEQ ID NO: 16435 - RNA, 21 nt, Artificial Sequence
  RNA Oligomer
cucaaugucuuaggucaggag

SEQ ID NO: 16436 - RNA, 21 nt, Artificial Sequence
  RNA Oligomer
agucacaggaagaaagcagaa

SEQ ID NO: 16437 - RNA, 21 nt, Artificial Sequence
  RNA Oligomer
gccagaagagcuugucagcaa

SEQ ID NO: 16438 - RNA, 21 nt, Artificial Sequence
  RNA Oligomer
aggguugugcuuucuagcaaa

SEQ ID NO: 16439 - RNA, 21 nt, Artificial Sequence
  RNA Oligomer
gguuaggacucuccacucaau

SEQ ID NO: 16440 - RNA, 21 nt, Artificial Sequence
  RNA Oligomer
gguugugcuuucuagcaaaua

SEQ ID NO: 16441 - RNA, 21 nt, Artificial Sequence
  RNA Oligomer
cccugaagaagaugaaaggaa

SEQ ID NO: 16442 - RNA, 21 nt, Artificial Sequence
  RNA Oligomer
ucccagcguuaacacaaaauc

SEQ ID NO: 16443 - RNA, 21 nt, Artificial Sequence
  RNA Oligomer
cagaagagcuugucagcaaga

SEQ ID NO: 16444 - RNA, 21 nt, Artificial Sequence
  RNA Oligomer
gcauuugauauacaugcucaa

SEQ ID NO: 16445 - RNA, 21 nt, Artificial Sequence
  RNA Oligomer
ugaggagcucaagaacgagaa

SEQ ID NO: 16446 - RNA, 21 nt, Artificial Sequence
  RNA Oligomer
gcugaacugaaggcucagauu

SEQ ID NO: 16447 - RNA, 21 nt, Artificial Sequence
  RNA Oligomer
agcugcaaagugccgaaacaa

SEQ ID NO: 16448 - RNA, 21 nt, Artificial Sequence
  RNA Oligomer
gcagaaaguucaacuuccaaa

SEQ ID NO: 16449 - RNA, 21 nt, Artificial Sequence
  RNA Oligomer
gcaaacucaguuccaaaguca

SEQ ID NO: 16450 - RNA, 21 nt, Artificial Sequence
  RNA Oligomer
agagcuugucagcaagaggag

SEQ ID NO: 16451 - RNA, 21 nt, Artificial Sequence
  RNA Oligomer
ggccauucuuauguuccagau

SEQ ID NO: 16452 - RNA, 21 nt, Artificial Sequence
  RNA Oligomer
uccucauuuuauacccaaaac

SEQ ID NO: 16453 - RNA, 21 nt, Artificial Sequence
  RNA Oligomer
ggacuccagaagaugagagaa

SEQ ID NO: 16454 - RNA, 21 nt, Artificial Sequence
  RNA Oligomer
ggagcucaagaacgagaagca

SEQ ID NO: 16455 - RNA, 21 nt, Artificial Sequence
  RNA Oligomer
uccuaaccugucagaauaaua

SEQ ID NO: 16456 - RNA, 21 nt, Artificial Sequence
  RNA Oligomer
agcagaaaguucaacuuccaa

SEQ ID NO: 16457 - RNA, 21 nt, Artificial Sequence
  RNA Oligomer
uggcagguccucuguugcaaa

SEQ ID NO: 16458 - RNA, 21 nt, Artificial Sequence
  RNA Oligomer
gcaguaucucaagauauucag

SEQ ID NO: 16459 - RNA, 21 nt, Artificial Sequence
  RNA Oligomer
ucaccguggcuaccauuguca

SEQ ID NO: 16460 - RNA, 21 nt, Artificial Sequence
  RNA Oligomer
agaagaugagagaaaccucuu

SEQ ID NO: 16461 - RNA, 21 nt, Artificial Sequence
  RNA Oligomer
ggaagagcugagguuugccau

SEQ ID NO: 16462 - RNA, 21 nt, Artificial Sequence
  RNA Oligomer
caaacucaguuccaaagucac

SEQ ID NO: 16463 - RNA, 21 nt, Artificial Sequence
  RNA Oligomer
ugugcaagaaaacuaggcaau

SEQ ID NO: 16464 - RNA, 21 nt, Artificial Sequence
  RNA Oligomer
caacuccaggauuuaggccuu

SEQ ID NO: 16465 - RNA, 21 nt, Artificial Sequence
  RNA Oligomer
gcaagugcaucuuugccucaa

SEQ ID NO: 16466 - RNA, 21 nt, Artificial Sequence
  RNA Oligomer
cccaaaacccugaagccauug

SEQ ID NO: 16467 - RNA, 21 nt, Artificial Sequence
  RNA Oligomer
ugaaaaccacagucaguggag

SEQ ID NO: 16468 - RNA, 21 nt, Artificial Sequence
  RNA Oligomer
agguccucuguugcaaacuca

SEQ ID NO: 16469 - RNA, 21 nt, Artificial Sequence
  RNA Oligomer
uccuucaccguggcuaccauu

SEQ ID NO: 16470 - RNA, 21 nt, Artificial Sequence
  RNA Oligomer
gccauucuuauguuccagaug

SEQ ID NO: 16471 - RNA, 21 nt, Artificial Sequence
  RNA Oligomer
cacacuggccauucuuauguu

SEQ ID NO: 16472 - RNA, 21 nt, Artificial Sequence
  RNA Oligomer
ccaggauuuaggccuuaacac

SEQ ID NO: 16473 - RNA, 21 nt, Artificial Sequence
  RNA Oligomer
ccucauuuuauacccaaaacc

SEQ ID NO: 16474 - RNA, 21 nt, Artificial Sequence
  RNA Oligomer
ggaacauugcagagcuaagca

SEQ ID NO: 16475 - RNA, 21 nt, Artificial Sequence
  RNA Oligomer
agaugagagaaaccucuuuau

SEQ ID NO: 16476 - RNA, 21 nt, Artificial Sequence
  RNA Oligomer
ucagaaugggaggacuccaga

SEQ ID NO: 16477 - RNA, 21 nt, Artificial Sequence
  RNA Oligomer
gaagcagcauuugauauacau

SEQ ID NO: 16478 - RNA, 21 nt, Artificial Sequence
  RNA Oligomer
gaaauaagauugcagcugcaa

SEQ ID NO: 16479 - RNA, 21 nt, Artificial Sequence
  RNA Oligomer
uccaucacaaaagccgaggua

SEQ ID NO: 16480 - RNA, 21 nt, Artificial Sequence
  RNA Oligomer
guacucaaugguaucauuaca

SEQ ID NO: 16481 - RNA, 21 nt, Artificial Sequence
  RNA Oligomer
cagaaaguucaacuuccaaag

SEQ ID NO: 16482 - RNA, 21 nt, Artificial Sequence
  RNA Oligomer
ccucuguugcaaacucaguuc

SEQ ID NO: 16483 - RNA, 21 nt, Artificial Sequence
  RNA Oligomer
gcagguccucuguugcaaacu

SEQ ID NO: 16484 - RNA, 21 nt, Artificial Sequence
  RNA Oligomer
cagcguuaacacaaaauccau

SEQ ID NO: 16485 - RNA, 21 nt, Artificial Sequence
  RNA Oligomer
caagaggaggacagaauucuc

SEQ ID NO: 16486 - RNA, 21 nt, Artificial Sequence
  RNA Oligomer
cuagcaaauaugcuguuaugu

SEQ ID NO: 16487 - RNA, 21 nt, Artificial Sequence
  RNA Oligomer
gcuuucuagcaaauaugcugu

SEQ ID NO: 16488 - RNA, 21 nt, Artificial Sequence
  RNA Oligomer
guugugcuuucuagcaaauau

SEQ ID NO: 16489 - RNA, 21 nt, Artificial Sequence
  RNA Oligomer
acacuggccauucuuauguuc

SEQ ID NO: 16490 - RNA, 21 nt, Artificial Sequence
  RNA Oligomer
gaggagcucaagaacgagaag

SEQ ID NO: 16491 - RNA, 21 nt, Artificial Sequence
  RNA Oligomer
ccaucacaaaagccgagguag

SEQ ID NO: 16492 - RNA, 21 nt, Artificial Sequence
  RNA Oligomer
ccuaaccugucagaauaauaa

SEQ ID NO: 16493 - RNA, 21 nt, Artificial Sequence
  RNA Oligomer
auuccuaaccugucagaauaa

SEQ ID NO: 16494 - RNA, 21 nt, Artificial Sequence
  RNA Oligomer
ggacgcuggcuacugucuauu

SEQ ID NO: 16495 - RNA, 21 nt, Artificial Sequence
  RNA Oligomer
ccacagucaguggagagaugu

SEQ ID NO: 16496 - RNA, 21 nt, Artificial Sequence
  RNA Oligomer
agaaagcagaaaguucaacuu

SEQ ID NO: 16497 - RNA, 21 nt, Artificial Sequence
  RNA Oligomer
ucucccagcguuaacacaaaa

SEQ ID NO: 16498 - RNA, 21 nt, Artificial Sequence
  RNA Oligomer
gacagaauucucccagcguua

SEQ ID NO: 16499 - RNA, 21 nt, Artificial Sequence
  RNA Oligomer
ggacagaauucucccagcguu

SEQ ID NO: 16500 - RNA, 21 nt, Artificial Sequence
  RNA Oligomer
gugcaguaucucaagauauuc

SEQ ID NO: 16501 - RNA, 21 nt, Artificial Sequence
  RNA Oligomer
auaugcuguuauguccagaaa

SEQ ID NO: 16502 - RNA, 21 nt, Artificial Sequence
  RNA Oligomer
acaaaaaaccaggaugcccac

SEQ ID NO: 16503 - RNA, 21 nt, Artificial Sequence
  RNA Oligomer
ugcccgccuuucaucuggauu

SEQ ID NO: 16504 - RNA, 21 nt, Artificial Sequence
  RNA Oligomer
gccuuaacacacuggccauuc

SEQ ID NO: 16505 - RNA, 21 nt, Artificial Sequence
  RNA Oligomer
cuccaggauuuaggccuuaac

SEQ ID NO: 16506 - RNA, 21 nt, Artificial Sequence
  RNA Oligomer
ggaagugagugcuucugccau

SEQ ID NO: 16507 - RNA, 21 nt, Artificial Sequence
  RNA Oligomer
ggaguccucauugaauccuca

SEQ ID NO: 16508 - RNA, 21 nt, Artificial Sequence
  RNA Oligomer
gaagaugagagaaaccucuuu

SEQ ID NO: 16509 - RNA, 21 nt, Artificial Sequence
  RNA Oligomer
ccagaagaugagagaaaccuc

SEQ ID NO: 16510 - RNA, 21 nt, Artificial Sequence
  RNA Oligomer
ugcaaagugccgaaacaagaa

SEQ ID NO: 16511 - RNA, 21 nt, Artificial Sequence
  RNA Oligomer
ugcagcugcaaagugccgaaa

SEQ ID NO: 16512 - RNA, 21 nt, Artificial Sequence
  RNA Oligomer
agaaauaagauugcagcugca

SEQ ID NO: 16513 - RNA, 21 nt, Artificial Sequence
  RNA Oligomer
gcagcugugagaagucacuca

SEQ ID NO: 16514 - RNA, 21 nt, Artificial Sequence
  RNA Oligomer
gagguuugccauccagaacaa

SEQ ID NO: 16515 - RNA, 21 nt, Artificial Sequence
  RNA Oligomer
agagcugagguuugccaucca

SEQ ID NO: 16516 - RNA, 21 nt, Artificial Sequence
  RNA Oligomer
ggagagauguuuggaaaccac

SEQ ID NO: 16517 - RNA, 21 nt, Artificial Sequence
  RNA Oligomer
cccuuugucaaggaagagcug

SEQ ID NO: 16518 - RNA, 21 nt, Artificial Sequence
  RNA Oligomer
gcccuuugucaaggaagagcu

SEQ ID NO: 16519 - RNA, 21 nt, Artificial Sequence
  RNA Oligomer
uccucuguugcaaacucaguu

SEQ ID NO: 16520 - RNA, 21 nt, Artificial Sequence
  RNA Oligomer
gugugcaagaaaacuaggcaa

SEQ ID NO: 16521 - RNA, 21 nt, Artificial Sequence
  RNA Oligomer
ugcuguuauguccagaaauug

SEQ ID NO: 16522 - RNA, 21 nt, Artificial Sequence
  RNA Oligomer
gcaaauaugcuguuaugucca

SEQ ID NO: 16523 - RNA, 21 nt, Artificial Sequence
  RNA Oligomer
cuuucuagcaaauaugcuguu

SEQ ID NO: 16524 - RNA, 21 nt, Artificial Sequence
  RNA Oligomer
caggguugugcuuucuagcaa

SEQ ID NO: 16525 - RNA, 21 nt, Artificial Sequence
  RNA Oligomer
ccaggguugugcuuucuagca

SEQ ID NO: 16526 - RNA, 21 nt, Artificial Sequence
  RNA Oligomer
ggccuuaacacacuggccauu

SEQ ID NO: 16527 - RNA, 21 nt, Artificial Sequence
  RNA Oligomer
aggccuuaacacacuggccau

SEQ ID NO: 16528 - RNA, 21 nt, Artificial Sequence
  RNA Oligomer
acuccaggauuuaggccuuaa

SEQ ID NO: 16529 - RNA, 21 nt, Artificial Sequence
  RNA Oligomer
gaguccucauugaauccucau

SEQ ID NO: 16530 - RNA, 21 nt, Artificial Sequence
  RNA Oligomer
gacuccagaagaugagagaaa

SEQ ID NO: 16531 - RNA, 21 nt, Artificial Sequence
  RNA Oligomer
gagagauguuuggaaaccaca

SEQ ID NO: 16532 - RNA, 21 nt, Artificial Sequence
  RNA Oligomer
cauuuuccuuuccuugugguu

SEQ ID NO: 16533 - RNA, 21 nt, Artificial Sequence
  RNA Oligomer
aaguucaacuuccaaaggguu

SEQ ID NO: 16534 - RNA, 21 nt, Artificial Sequence
  RNA Oligomer
ucaguuccaaagucacaggaa

SEQ ID NO: 16535 - RNA, 21 nt, Artificial Sequence
  RNA Oligomer
gugcaagaaaacuaggcaaug

SEQ ID NO: 16536 - RNA, 21 nt, Artificial Sequence
  RNA Oligomer
cuggccauucuuauguuccag

SEQ ID NO: 16537 - RNA, 21 nt, Artificial Sequence
  RNA Oligomer
uugccucaacuccaggauuua

SEQ ID NO: 16538 - RNA, 21 nt, Artificial Sequence
  RNA Oligomer
caagugcaucuuugccucaac

SEQ ID NO: 16539 - RNA, 21 nt, Artificial Sequence
  RNA Oligomer
ggcaagugcaucuuugccuca

SEQ ID NO: 16540 - RNA, 21 nt, Artificial Sequence
  RNA Oligomer
gggaguccucauugaauccuc

SEQ ID NO: 16541 - RNA, 21 nt, Artificial Sequence
  RNA Oligomer
uccaacagauaaaagaaggaa

SEQ ID NO: 16542 - RNA, 21 nt, Artificial Sequence
  RNA Oligomer
aagaugagagaaaccucuuua

SEQ ID NO: 16543 - RNA, 21 nt, Artificial Sequence
  RNA Oligomer
ggaggacuccagaagaugaga

SEQ ID NO: 16544 - RNA, 21 nt, Artificial Sequence
  RNA Oligomer
cgcuggaaucagucacuguca

SEQ ID NO: 16545 - RNA, 21 nt, Artificial Sequence
  RNA Oligomer
aggacgcuggcuacugucuau

SEQ ID NO: 16546 - RNA, 21 nt, Artificial Sequence
  RNA Oligomer
uggaaaccacagucaguggag

SEQ ID NO: 16547 - RNA, 21 nt, Artificial Sequence
  RNA Oligomer
ccauuuuccuuuccuuguggu

SEQ ID NO: 16548 - RNA, 21 nt, Artificial Sequence
  RNA Oligomer
ccagcguuaacacaaaaucca

SEQ ID NO: 16549 - RNA, 21 nt, Artificial Sequence
  RNA Oligomer
gaauucucccagcguuaacac

SEQ ID NO: 16550 - RNA, 21 nt, Artificial Sequence
  RNA Oligomer
ggauucuacaaaaaaccagga

SEQ ID NO: 16551 - RNA, 21 nt, Artificial Sequence
  RNA Oligomer
cccgccuuucaucuggauucu

SEQ ID NO: 16552 - RNA, 21 nt, Artificial Sequence
  RNA Oligomer
uggccauucuuauguuccaga

SEQ ID NO: 16553 - RNA, 21 nt, Artificial Sequence
  RNA Oligomer
ucuuugccucaacuccaggau

SEQ ID NO: 16554 - RNA, 21 nt, Artificial Sequence
  RNA Oligomer
gcaucuuugccucaacuccag

SEQ ID NO: 16555 - RNA, 21 nt, Artificial Sequence
  RNA Oligomer
guaccucuagaaucccagcag

SEQ ID NO: 16556 - RNA, 21 nt, Artificial Sequence
  RNA Oligomer
caaaacccugaagccauugga

SEQ ID NO: 16557 - RNA, 21 nt, Artificial Sequence
  RNA Oligomer
ccucuuuauccaacagauaaa

SEQ ID NO: 16558 - RNA, 21 nt, Artificial Sequence
  RNA Oligomer
cucaagaacgagaagcagcau

SEQ ID NO: 16559 - RNA, 21 nt, Artificial Sequence
  RNA Oligomer
guccaucacaaaagccgaggu

SEQ ID NO: 16560 - RNA, 21 nt, Artificial Sequence
  RNA Oligomer
gguguccaucacaaaagccga

SEQ ID NO: 16561 - RNA, 21 nt, Artificial Sequence
  RNA Oligomer
guauuccuaaccugucagaau

SEQ ID NO: 16562 - RNA, 21 nt, Artificial Sequence
  RNA Oligomer
gacgcuggcuacugucuauua

SEQ ID NO: 16563 - RNA, 21 nt, Artificial Sequence
  RNA Oligomer
acagucaguggagagauguuu

SEQ ID NO: 16564 - RNA, 21 nt, Artificial Sequence
  RNA Oligomer
gugguugaaaaccacagucag

SEQ ID NO: 16565 - RNA, 21 nt, Artificial Sequence
  RNA Oligomer
ccuuuccuugugguugaaaac

SEQ ID NO: 16566 - RNA, 21 nt, Artificial Sequence
  RNA Oligomer
cuccacucaaugucuuagguc

SEQ ID NO: 16567 - RNA, 21 nt, Artificial Sequence
  RNA Oligomer
gaaagcagaaaguucaacuuc

SEQ ID NO: 16568 - RNA, 21 nt, Artificial Sequence
  RNA Oligomer
cccagcguuaacacaaaaucc

SEQ ID NO: 16569 - RNA, 21 nt, Artificial Sequence
  RNA Oligomer
ucagaucugguuucuaagagu

SEQ ID NO: 16570 - RNA, 21 nt, Artificial Sequence
  RNA Oligomer
cacugaugugacuuuuauaug

SEQ ID NO: 16571 - RNA, 21 nt, Artificial Sequence
  RNA Oligomer
augcuguuauguccagaaauu

SEQ ID NO: 16572 - RNA, 21 nt, Artificial Sequence
  RNA Oligomer
accucuagaaucccagcagca

SEQ ID NO: 16573 - RNA, 21 nt, Artificial Sequence
  RNA Oligomer
aaccucuuuauccaacagaua

SEQ ID NO: 16574 - RNA, 21 nt, Artificial Sequence
  RNA Oligomer
agauguuuggaaaccacaguc

SEQ ID NO: 16575 - RNA, 21 nt, Artificial Sequence
  RNA Oligomer
cacagucaguggagagauguu

SEQ ID NO: 16576 - RNA, 21 nt, Artificial Sequence
  RNA Oligomer
cuaggcuggaagagccaaaga

SEQ ID NO: 16577 - RNA, 21 nt, Artificial Sequence
  RNA Oligomer
aagcagaaaguucaacuucca

SEQ ID NO: 16578 - RNA, 21 nt, Artificial Sequence
  RNA Oligomer
gguccucuguugcaaacucag

SEQ ID NO: 16579 - RNA, 21 nt, Artificial Sequence
  RNA Oligomer
aggacagaauucucccagcgu

SEQ ID NO: 16580 - RNA, 21 nt, Artificial Sequence
  RNA Oligomer
agauauucagguggccagaag

SEQ ID NO: 16581 - RNA, 21 nt, Artificial Sequence
  RNA Oligomer
cuaggcaauguacucuuccga

SEQ ID NO: 16582 - RNA, 21 nt, Artificial Sequence
  RNA Oligomer
ccauucuuauguuccagaugg

SEQ ID NO: 16583 - RNA, 21 nt, Artificial Sequence
  RNA Oligomer
uccaggauuuaggccuuaaca

SEQ ID NO: 16584 - RNA, 21 nt, Artificial Sequence
  RNA Oligomer
cuagaaucccagcagcagaga

SEQ ID NO: 16585 - RNA, 21 nt, Artificial Sequence
  RNA Oligomer
accucuuuauccaacagauaa

SEQ ID NO: 16586 - RNA, 21 nt, Artificial Sequence
  RNA Oligomer
agaaaccucuuuauccaacag

SEQ ID NO: 16587 - RNA, 21 nt, Artificial Sequence
  RNA Oligomer
gagaaaccucuuuauccaaca

SEQ ID NO: 16588 - RNA, 21 nt, Artificial Sequence
  RNA Oligomer
gagagaaaccucuuuauccaa

SEQ ID NO: 16589 - RNA, 21 nt, Artificial Sequence
  RNA Oligomer
cuaguauuccuaaccugucag

SEQ ID NO: 16590 - RNA, 21 nt, Artificial Sequence
  RNA Oligomer
agucacucacacuggccacaa

SEQ ID NO: 16591 - RNA, 21 nt, Artificial Sequence
  RNA Oligomer
cugugagaagucacucacacu

SEQ ID NO: 16592 - RNA, 21 nt, Artificial Sequence
  RNA Oligomer
gcugagguuugccauccagaa

SEQ ID NO: 16593 - RNA, 21 nt, Artificial Sequence
  RNA Oligomer
ggcuggaagagccaaagaaua

SEQ ID NO: 16594 - RNA, 21 nt, Artificial Sequence
  RNA Oligomer
aggcuggaagagccaaagaau

SEQ ID NO: 16595 - RNA, 21 nt, Artificial Sequence
  RNA Oligomer
ggacucuccacucaaugucuu

SEQ ID NO: 16596 - RNA, 21 nt, Artificial Sequence
  RNA Oligomer
gauucuacaaaaaaccaggau

SEQ ID NO: 16597 - RNA, 21 nt, Artificial Sequence
  RNA Oligomer
aaaccucuuuauccaacagau

SEQ ID NO: 16598 - RNA, 21 nt, Artificial Sequence
  RNA Oligomer
gaaaccucuuuauccaacaga

SEQ ID NO: 16599 - RNA, 21 nt, Artificial Sequence
  RNA Oligomer
agaagcagcauuugauauaca

SEQ ID NO: 16600 - RNA, 21 nt, Artificial Sequence
  RNA Oligomer
aguauuccuaaccugucagaa

SEQ ID NO: 16601 - RNA, 21 nt, Artificial Sequence
  RNA Oligomer
agcugugagaagucacucaca

SEQ ID NO: 16602 - RNA, 21 nt, Artificial Sequence
  RNA Oligomer
cagcugugagaagucacucac

SEQ ID NO: 16603 - RNA, 21 nt, Artificial Sequence
  RNA Oligomer
agcugagguuugccauccaga

SEQ ID NO: 16604 - RNA, 21 nt, Artificial Sequence
  RNA Oligomer
gcuggaagagccaaagaauau

SEQ ID NO: 16605 - RNA, 21 nt, Artificial Sequence
  RNA Oligomer
aaaguucaacuuccaaagggu

SEQ ID NO: 16606 - RNA, 21 nt, Artificial Sequence
  RNA Oligomer
guaucucaagauauucaggug

SEQ ID NO: 16607 - RNA, 21 nt, Artificial Sequence
  RNA Oligomer
aggacuccagaagaugagaga

SEQ ID NO: 16608 - RNA, 21 nt, Artificial Sequence
  RNA Oligomer
guguauuguccgggcucagaa

SEQ ID NO: 16609 - RNA, 21 nt, Artificial Sequence
  RNA Oligomer
gagaagcagcauuugauauac

SEQ ID NO: 16610 - RNA, 21 nt, Artificial Sequence
  RNA Oligomer
ugcgcuggaaucagucacugu

SEQ ID NO: 16611 - RNA, 21 nt, Artificial Sequence
  RNA Oligomer
ugccauccagaacaagcaccu

SEQ ID NO: 16612 - RNA, 21 nt, Artificial Sequence
  RNA Oligomer
cugugaaauucucagaguguu

SEQ ID NO: 16613 - RNA, 21 nt, Artificial Sequence
  RNA Oligomer
ccaaaggguuaggacucucca

SEQ ID NO: 16614 - RNA, 21 nt, Artificial Sequence
  RNA Oligomer
uuccaaagucacaggaagaaa

SEQ ID NO: 16615 - RNA, 21 nt, Artificial Sequence
  RNA Oligomer
ucugugaaauucucagagugu

SEQ ID NO: 16616 - RNA, 21 nt, Artificial Sequence
  RNA Oligomer
agguuugccauccagaacaag

SEQ ID NO: 16617 - RNA, 21 nt, Artificial Sequence
  RNA Oligomer
uccuugugguugaaaaccaca

SEQ ID NO: 16618 - RNA, 21 nt, Artificial Sequence
  RNA Oligomer
cuggaagagccaaagaauauu

SEQ ID NO: 16619 - RNA, 21 nt, Artificial Sequence
  RNA Oligomer
caacuuccaaaggguuaggac

SEQ ID NO: 16620 - RNA, 21 nt, Artificial Sequence
  RNA Oligomer
gcuguuauguccagaaauugu

SEQ ID NO: 16621 - RNA, 21 nt, Artificial Sequence
  RNA Oligomer
ccuaguauuccuaaccuguca

SEQ ID NO: 16622 - RNA, 21 nt, Artificial Sequence
  RNA Oligomer
uccauuuuccuuuccuugugg

SEQ ID NO: 16623 - RNA, 21 nt, Artificial Sequence
  RNA Oligomer
ggaagagccaaagaauauucc

SEQ ID NO: 16624 - RNA, 21 nt, Artificial Sequence
  RNA Oligomer
aggacucuccacucaaugucu

SEQ ID NO: 16625 - RNA, 21 nt, Artificial Sequence
  RNA Oligomer
ucaacuuccaaaggguuagga

SEQ ID NO: 16626 - RNA, 21 nt, Artificial Sequence
  RNA Oligomer
ugagagaaaccucuuuaucca

SEQ ID NO: 16627 - RNA, 21 nt, Artificial Sequence
  RNA Oligomer
uuuccuuucaucuucuucagg

SEQ ID NO: 16628 - RNA, 21 nt, Artificial Sequence
  RNA Oligomer
uuuuccuuucaucuucuucag

SEQ ID NO: 16629 - RNA, 21 nt, Artificial Sequence
  RNA Oligomer
aucuuauuucuuucucgucgc

SEQ ID NO: 16630 - RNA, 21 nt, Artificial Sequence
  RNA Oligomer
uacauugccuaguuuucuugc

SEQ ID NO: 16631 - RNA, 21 nt, Artificial Sequence
  RNA Oligomer
uuucucgucgccucuuuuucc

SEQ ID NO: 16632 - RNA, 21 nt, Artificial Sequence
  RNA Oligomer
uaaaaugaggauucaaugagg

SEQ ID NO: 16633 - RNA, 21 nt, Artificial Sequence
  RNA Oligomer
uucuccuucuucuuguuucgg

SEQ ID NO: 16634 - RNA, 21 nt, Artificial Sequence
  RNA Oligomer
ugcaaucuuauuucuuucucg

SEQ ID NO: 16635 - RNA, 21 nt, Artificial Sequence
  RNA Oligomer
aaucuuauuucuuucucgucg

SEQ ID NO: 16636 - RNA, 21 nt, Artificial Sequence
  RNA Oligomer
cuuuuuccuuucaucuucuuc

SEQ ID NO: 16637 - RNA, 21 nt, Artificial Sequence
  RNA Oligomer
uuggguauaaaaugaggauuc

SEQ ID NO: 16638 - RNA, 21 nt, Artificial Sequence
  RNA Oligomer
ucuuauuucuuucucgucgcc

SEQ ID NO: 16639 - RNA, 21 nt, Artificial Sequence
  RNA Oligomer
uauuucuuucucgucgccucu

SEQ ID NO: 16640 - RNA, 21 nt, Artificial Sequence
  RNA Oligomer
cucuuuuuccuuucaucuucu

SEQ ID NO: 16641 - RNA, 21 nt, Artificial Sequence
  RNA Oligomer
uuucuugcacacacaauuucu

SEQ ID NO: 16642 - RNA, 21 nt, Artificial Sequence
  RNA Oligomer
ucuugcacacacaauuucugg

SEQ ID NO: 16643 - RNA, 21 nt, Artificial Sequence
  RNA Oligomer
aaaaugaggauucaaugagga

SEQ ID NO: 16644 - RNA, 21 nt, Artificial Sequence
  RNA Oligomer
caaucuuauuucuuucucguc

SEQ ID NO: 16645 - RNA, 21 nt, Artificial Sequence
  RNA Oligomer
uugaacuuucugcuuucuucc

SEQ ID NO: 16646 - RNA, 21 nt, Artificial Sequence
  RNA Oligomer
cuucuccuucuucuuguuucg

SEQ ID NO: 16647 - RNA, 21 nt, Artificial Sequence
  RNA Oligomer
cuuauuucuuucucgucgccu

SEQ ID NO: 16648 - RNA, 21 nt, Artificial Sequence
  RNA Oligomer
aaaacaaugcuauugacaucc

SEQ ID NO: 16649 - RNA, 21 nt, Artificial Sequence
  RNA Oligomer
uggguauaaaaugaggauuca

SEQ ID NO: 16650 - RNA, 21 nt, Artificial Sequence
  RNA Oligomer
aaaugaggauucaaugaggac

SEQ ID NO: 16651 - RNA, 21 nt, Artificial Sequence
  RNA Oligomer
uucucgucgccucuuuuuccu

SEQ ID NO: 16652 - RNA, 21 nt, Artificial Sequence
  RNA Oligomer
aauucuguccuccucuugcug

SEQ ID NO: 16653 - RNA, 21 nt, Artificial Sequence
  RNA Oligomer
uuagcucugcaauguuccuuc

SEQ ID NO: 16654 - RNA, 21 nt, Artificial Sequence
  RNA Oligomer
uagcucugcaauguuccuucu

SEQ ID NO: 16655 - RNA, 21 nt, Artificial Sequence
  RNA Oligomer
cugcaaucuuauuucuuucuc

SEQ ID NO: 16656 - RNA, 21 nt, Artificial Sequence
  RNA Oligomer
ucgucgccucuuuuuccuuuc

SEQ ID NO: 16657 - RNA, 21 nt, Artificial Sequence
  RNA Oligomer
uuuucuugcacacacaauuuc

SEQ ID NO: 16658 - RNA, 21 nt, Artificial Sequence
  RNA Oligomer
uguagaauccagaugaaaggc

SEQ ID NO: 16659 - RNA, 21 nt, Artificial Sequence
  RNA Oligomer
uagaauccagaugaaaggcgg

SEQ ID NO: 16660 - RNA, 21 nt, Artificial Sequence
  RNA Oligomer
aauggcuucaggguuuugggu

SEQ ID NO: 16661 - RNA, 21 nt, Artificial Sequence
  RNA Oligomer
guuccuucuuuuaucuguugg

SEQ ID NO: 16662 - RNA, 21 nt, Artificial Sequence
  RNA Oligomer
augaagguugagcauguauau

SEQ ID NO: 16663 - RNA, 21 nt, Artificial Sequence
  RNA Oligomer
agcugcaaucuuauuucuuuc

SEQ ID NO: 16664 - RNA, 21 nt, Artificial Sequence
  RNA Oligomer
gaaaauggaauauucuuuggc

SEQ ID NO: 16665 - RNA, 21 nt, Artificial Sequence
  RNA Oligomer
agaauucuguccuccucuugc

SEQ ID NO: 16666 - RNA, 21 nt, Artificial Sequence
  RNA Oligomer
guacauugccuaguuuucuug

SEQ ID NO: 16667 - RNA, 21 nt, Artificial Sequence
  RNA Oligomer
uugcacacacaauuucuggac

SEQ ID NO: 16668 - RNA, 21 nt, Artificial Sequence
  RNA Oligomer
aaaauccucaaacaccaguga

SEQ ID NO: 16669 - RNA, 21 nt, Artificial Sequence
  RNA Oligomer
uguuccuucuuuuaucuguug

SEQ ID NO: 16670 - RNA, 21 nt, Artificial Sequence
  RNA Oligomer
uauaucaaaugcugcuucucg

SEQ ID NO: 16671 - RNA, 21 nt, Artificial Sequence
  RNA Oligomer
aaaugcugcuucucguucuug

SEQ ID NO: 16672 - RNA, 21 nt, Artificial Sequence
  RNA Oligomer
ucuccuucuucuuguuucggc

SEQ ID NO: 16673 - RNA, 21 nt, Artificial Sequence
  RNA Oligomer
uccuucuucuuguuucggcac

SEQ ID NO: 16674 - RNA, 21 nt, Artificial Sequence
  RNA Oligomer
uucuucuuguuucggcacuuu

SEQ ID NO: 16675 - RNA, 21 nt, Artificial Sequence
  RNA Oligomer
ucuucuuguuucggcacuuug

SEQ ID NO: 16676 - RNA, 21 nt, Artificial Sequence
  RNA Oligomer
cuucuuguuucggcacuuugc

SEQ ID NO: 16677 - RNA, 21 nt, Artificial Sequence
  RNA Oligomer
gaauuuuaauagacaguagcc

SEQ ID NO: 16678 - RNA, 21 nt, Artificial Sequence
  RNA Oligomer
aaacaaugcuauugacaucca

SEQ ID NO: 16679 - RNA, 21 nt, Artificial Sequence
  RNA Oligomer
uuuccaaacaucucuccacug

SEQ ID NO: 16680 - RNA, 21 nt, Artificial Sequence
  RNA Oligomer
uuuggaacugaguuugcaaca

SEQ ID NO: 16681 - RNA, 21 nt, Artificial Sequence
  RNA Oligomer
auucuguccuccucuugcuga

SEQ ID NO: 16682 - RNA, 21 nt, Artificial Sequence
  RNA Oligomer
uucuugcacacacaauuucug

SEQ ID NO: 16683 - RNA, 21 nt, Artificial Sequence
  RNA Oligomer
auccucaaacaccagugaccc

SEQ ID NO: 16684 - RNA, 21 nt, Artificial Sequence
  RNA Oligomer
uucuuaaaacagcuacaugac

SEQ ID NO: 16685 - RNA, 21 nt, Artificial Sequence
  RNA Oligomer
gcuacaugacaaaaacaaugc

SEQ ID NO: 16686 - RNA, 21 nt, Artificial Sequence
  RNA Oligomer
ggaaaauggaauauucuuugg

SEQ ID NO: 16687 - RNA, 21 nt, Artificial Sequence
  RNA Oligomer
uuccagccuagacacaacucc

SEQ ID NO: 16688 - RNA, 21 nt, Artificial Sequence
  RNA Oligomer
aaaccucagcucuuccuugac

SEQ ID NO: 16689 - RNA, 21 nt, Artificial Sequence
  RNA Oligomer
aaacucuuagaaaccagaucu

SEQ ID NO: 16690 - RNA, 21 nt, Artificial Sequence
  RNA Oligomer
guuuucuugcacacacaauuu

SEQ ID NO: 16691 - RNA, 21 nt, Artificial Sequence
  RNA Oligomer
aaauccucaaacaccagugac

SEQ ID NO: 16692 - RNA, 21 nt, Artificial Sequence
  RNA Oligomer
aguguguuaaggccuaaaucc

SEQ ID NO: 16693 - RNA, 21 nt, Artificial Sequence
  RNA Oligomer
aagguugagcauguauaucaa

SEQ ID NO: 16694 - RNA, 21 nt, Artificial Sequence
  RNA Oligomer
uucacacuuuccagcuucucc

SEQ ID NO: 16695 - RNA, 21 nt, Artificial Sequence
  RNA Oligomer
cacuccgucuucuccuucuuc

SEQ ID NO: 16696 - RNA, 21 nt, Artificial Sequence
  RNA Oligomer
auuuuaauagacaguagccag

SEQ ID NO: 16697 - RNA, 21 nt, Artificial Sequence
  RNA Oligomer
cagauuucuuaaaacagcuac

SEQ ID NO: 16698 - RNA, 21 nt, Artificial Sequence
  RNA Oligomer
cuacaugacaaaaacaaugcu

SEQ ID NO: 16699 - RNA, 21 nt, Artificial Sequence
  RNA Oligomer
cugaccuaagacauugagugg

SEQ ID NO: 16700 - RNA, 21 nt, Artificial Sequence
  RNA Oligomer
aacuuucugcuuucuuccugu

SEQ ID NO: 16701 - RNA, 21 nt, Artificial Sequence
  RNA Oligomer
ucuggccaccugaauaucuug

SEQ ID NO: 16702 - RNA, 21 nt, Artificial Sequence
  RNA Oligomer
aacucuuagaaaccagaucug

SEQ ID NO: 16703 - RNA, 21 nt, Artificial Sequence
  RNA Oligomer
uuguagaauccagaugaaagg

SEQ ID NO: 16704 - RNA, 21 nt, Artificial Sequence
  RNA Oligomer
aagaauggccaguguguuaag

SEQ ID NO: 16705 - RNA, 21 nt, Artificial Sequence
  RNA Oligomer
aucaaaugcugcuucucguuc

SEQ ID NO: 16706 - RNA, 21 nt, Artificial Sequence
  RNA Oligomer
aacagcuacaugacaaaaaca

SEQ ID NO: 16707 - RNA, 21 nt, Artificial Sequence
  RNA Oligomer
gacaaaaacaaugcuauugac

SEQ ID NO: 16708 - RNA, 21 nt, Artificial Sequence
  RNA Oligomer
aaauggaauauucuuuggcuc

SEQ ID NO: 16709 - RNA, 21 nt, Artificial Sequence
  RNA Oligomer
aauggaauauucuuuggcucu

SEQ ID NO: 16710 - RNA, 21 nt, Artificial Sequence
  RNA Oligomer
uuaacgcugggagaauucugu

SEQ ID NO: 16711 - RNA, 21 nt, Artificial Sequence
  RNA Oligomer
aagaguacauugccuaguuuu

SEQ ID NO: 16712 - RNA, 21 nt, Artificial Sequence
  RNA Oligomer
uaaaugcuguucucacuccac

SEQ ID NO: 16713 - RNA, 21 nt, Artificial Sequence
  RNA Oligomer
guagaauccagaugaaaggcg

SEQ ID NO: 16714 - RNA, 21 nt, Artificial Sequence
  RNA Oligomer
uaucaaaugcugcuucucguu

SEQ ID NO: 16715 - RNA, 21 nt, Artificial Sequence
  RNA Oligomer
aacaaugcuauugacauccaa

SEQ ID NO: 16716 - RNA, 21 nt, Artificial Sequence
  RNA Oligomer
ugguuuccaaacaucucucca

SEQ ID NO: 16717 - RNA, 21 nt, Artificial Sequence
  RNA Oligomer
uuccaaacaucucuccacuga

SEQ ID NO: 16718 - RNA, 21 nt, Artificial Sequence
  RNA Oligomer
caaacaucucuccacugacug

SEQ ID NO: 16719 - RNA, 21 nt, Artificial Sequence
  RNA Oligomer
agcauauaaaagucacaucag

SEQ ID NO: 16720 - RNA, 21 nt, Artificial Sequence
  RNA Oligomer
agcaaaauccucaaacaccag

SEQ ID NO: 16721 - RNA, 21 nt, Artificial Sequence
  RNA Oligomer
uaaacacucugagaauuucac

SEQ ID NO: 16722 - RNA, 21 nt, Artificial Sequence
  RNA Oligomer
agaauuucacagaaacaucag

SEQ ID NO: 16723 - RNA, 21 nt, Artificial Sequence
  RNA Oligomer
aaacagcuacaugacaaaaac

SEQ ID NO: 16724 - RNA, 21 nt, Artificial Sequence
  RNA Oligomer
cuuccagccuagacacaacuc

SEQ ID NO: 16725 - RNA, 21 nt, Artificial Sequence
  RNA Oligomer
cagccuagacacaacuccuga

SEQ ID NO: 16726 - RNA, 21 nt, Artificial Sequence
  RNA Oligomer
uaagacauugaguggagaguc

SEQ ID NO: 16727 - RNA, 21 nt, Artificial Sequence
  RNA Oligomer
uugaguggagaguccuaaccc

SEQ ID NO: 16728 - RNA, 21 nt, Artificial Sequence
  RNA Oligomer
gcuuucuuccugugacuuugg

SEQ ID NO: 16729 - RNA, 21 nt, Artificial Sequence
  RNA Oligomer
uggccaccugaauaucuugag

SEQ ID NO: 16730 - RNA, 21 nt, Artificial Sequence
  RNA Oligomer
acuaaaugcuguucucacucc

SEQ ID NO: 16731 - RNA, 21 nt, Artificial Sequence
  RNA Oligomer
agaauggccaguguguuaagg

SEQ ID NO: 16732 - RNA, 21 nt, Artificial Sequence
  RNA Oligomer
auaucaaaugcugcuucucgu

SEQ ID NO: 16733 - RNA, 21 nt, Artificial Sequence
  RNA Oligomer
aaugcugcuucucguucuuga

SEQ ID NO: 16734 - RNA, 21 nt, Artificial Sequence
  RNA Oligomer
cacacuuuccagcuucuccga

SEQ ID NO: 16735 - RNA, 21 nt, Artificial Sequence
  RNA Oligomer
aaacacccugggccagauuuc

SEQ ID NO: 16736 - RNA, 21 nt, Artificial Sequence
  RNA Oligomer
aacacccugggccagauuucu

SEQ ID NO: 16737 - RNA, 21 nt, Artificial Sequence
  RNA Oligomer
acacaacuccugaccuaagac

SEQ ID NO: 16738 - RNA, 21 nt, Artificial Sequence
  RNA Oligomer
acuuucugcuuucuuccugug

SEQ ID NO: 16739 - RNA, 21 nt, Artificial Sequence
  RNA Oligomer
cuuucugcuuucuuccuguga

SEQ ID NO: 16740 - RNA, 21 nt, Artificial Sequence
  RNA Oligomer
guuagcaaaauccucaaacac

SEQ ID NO: 16741 - RNA, 21 nt, Artificial Sequence
  RNA Oligomer
uuagcaaaauccucaaacacc

SEQ ID NO: 16742 - RNA, 21 nt, Artificial Sequence
  RNA Oligomer
cuaaaugcuguucucacucca

SEQ ID NO: 16743 - RNA, 21 nt, Artificial Sequence
  RNA Oligomer
ugcuguucucacuccacaucc

SEQ ID NO: 16744 - RNA, 21 nt, Artificial Sequence
  RNA Oligomer
caaaauccucaaacaccagug

SEQ ID NO: 16745 - RNA, 21 nt, Artificial Sequence
  RNA Oligomer
ucacacuuuccagcuucuccg

SEQ ID NO: 16746 - RNA, 21 nt, Artificial Sequence
  RNA Oligomer
agaggugcuuguucuggaugg

SEQ ID NO: 16747 - RNA, 21 nt, Artificial Sequence
  RNA Oligomer
ggaaaggaaaauggaauauuc

SEQ ID NO: 16748 - RNA, 21 nt, Artificial Sequence
  RNA Oligomer
uccagccuagacacaacuccu

SEQ ID NO: 16749 - RNA, 21 nt, Artificial Sequence
  RNA Oligomer
cuugcugacaagcucuucugg

SEQ ID NO: 16750 - RNA, 21 nt, Artificial Sequence
  RNA Oligomer
auuugcuagaaagcacaaccc

SEQ ID NO: 16751 - RNA, 21 nt, Artificial Sequence
  RNA Oligomer
uagcaaaauccucaaacacca

SEQ ID NO: 16752 - RNA, 21 nt, Artificial Sequence
  RNA Oligomer
ucuucuggaguccucccauuc

SEQ ID NO: 16753 - RNA, 21 nt, Artificial Sequence
  RNA Oligomer
ugagaauuucacagaaacauc

SEQ ID NO: 16754 - RNA, 21 nt, Artificial Sequence
  RNA Oligomer
uuuucaaccacaaggaaagga

SEQ ID NO: 16755 - RNA, 21 nt, Artificial Sequence
  RNA Oligomer
aacuccugaccuaagacauug

SEQ ID NO: 16756 - RNA, 21 nt, Artificial Sequence
  RNA Oligomer
auuuuguguuaacgcugggag

SEQ ID NO: 16757 - RNA, 21 nt, Artificial Sequence
  RNA Oligomer
aauccucaaacaccagugacc

SEQ ID NO: 16758 - RNA, 21 nt, Artificial Sequence
  RNA Oligomer
uggaauauucuuuggcucuuc

SEQ ID NO: 16759 - RNA, 21 nt, Artificial Sequence
  RNA Oligomer
gaauauucuuuggcucuucca

SEQ ID NO: 16760 - RNA, 21 nt, Artificial Sequence
  RNA Oligomer
acuccugaccuaagacauuga

SEQ ID NO: 16761 - RNA, 21 nt, Artificial Sequence
  RNA Oligomer
cuccugaccuaagacauugag

SEQ ID NO: 16762 - RNA, 21 nt, Artificial Sequence
  RNA Oligomer
uucugcuuucuuccugugacu

SEQ ID NO: 16763 - RNA, 21 nt, Artificial Sequence
  RNA Oligomer
uugcugacaagcucuucuggc

SEQ ID NO: 16764 - RNA, 21 nt, Artificial Sequence
  RNA Oligomer
uuugcuagaaagcacaacccu

SEQ ID NO: 16765 - RNA, 21 nt, Artificial Sequence
  RNA Oligomer
auugaguggagaguccuaacc

SEQ ID NO: 16766 - RNA, 21 nt, Artificial Sequence
  RNA Oligomer
uauuugcuagaaagcacaacc

SEQ ID NO: 16767 - RNA, 21 nt, Artificial Sequence
  RNA Oligomer
uuccuuucaucuucuucaggg

SEQ ID NO: 16768 - RNA, 21 nt, Artificial Sequence
  RNA Oligomer
gauuuuguguuaacgcuggga

SEQ ID NO: 16769 - RNA, 21 nt, Artificial Sequence
  RNA Oligomer
ucuugcugacaagcucuucug

SEQ ID NO: 16770 - RNA, 21 nt, Artificial Sequence
  RNA Oligomer
uugagcauguauaucaaaugc

SEQ ID NO: 16771 - RNA, 21 nt, Artificial Sequence
  RNA Oligomer
uucucguucuugagcuccuca

SEQ ID NO: 16772 - RNA, 21 nt, Artificial Sequence
  RNA Oligomer
aaucugagccuucaguucagc

SEQ ID NO: 16773 - RNA, 21 nt, Artificial Sequence
  RNA Oligomer
uuguuucggcacuuugcagcu

SEQ ID NO: 16774 - RNA, 21 nt, Artificial Sequence
  RNA Oligomer
uuuggaaguugaacuuucugc

SEQ ID NO: 16775 - RNA, 21 nt, Artificial Sequence
  RNA Oligomer
ugacuuuggaacugaguuugc

SEQ ID NO: 16776 - RNA, 21 nt, Artificial Sequence
  RNA Oligomer
cuccucuugcugacaagcucu

SEQ ID NO: 16777 - RNA, 21 nt, Artificial Sequence
  RNA Oligomer
aucuggaacauaagaauggcc

SEQ ID NO: 16778 - RNA, 21 nt, Artificial Sequence
  RNA Oligomer
guuuuggguauaaaaugagga

SEQ ID NO: 16779 - RNA, 21 nt, Artificial Sequence
  RNA Oligomer
uucucucaucuucuggagucc

SEQ ID NO: 16780 - RNA, 21 nt, Artificial Sequence
  RNA Oligomer
ugcuucucguucuugagcucc

SEQ ID NO: 16781 - RNA, 21 nt, Artificial Sequence
  RNA Oligomer
uauuauucugacagguuagga

SEQ ID NO: 16782 - RNA, 21 nt, Artificial Sequence
  RNA Oligomer
uuggaaguugaacuuucugcu

SEQ ID NO: 16783 - RNA, 21 nt, Artificial Sequence
  RNA Oligomer
uuugcaacagaggaccugcca

SEQ ID NO: 16784 - RNA, 21 nt, Artificial Sequence
  RNA Oligomer
cugaauaucuugagauacugc

SEQ ID NO: 16785 - RNA, 21 nt, Artificial Sequence
  RNA Oligomer
ugacaaugguagccacgguga

SEQ ID NO: 16786 - RNA, 21 nt, Artificial Sequence
  RNA Oligomer
aagagguuucucucaucuucu

SEQ ID NO: 16787 - RNA, 21 nt, Artificial Sequence
  RNA Oligomer
auggcaaaccucagcucuucc

SEQ ID NO: 16788 - RNA, 21 nt, Artificial Sequence
  RNA Oligomer
gugacuuuggaacugaguuug

SEQ ID NO: 16789 - RNA, 21 nt, Artificial Sequence
  RNA Oligomer
auugccuaguuuucuugcaca

SEQ ID NO: 16790 - RNA, 21 nt, Artificial Sequence
  RNA Oligomer
aaggccuaaauccuggaguug

SEQ ID NO: 16791 - RNA, 21 nt, Artificial Sequence
  RNA Oligomer
uugaggcaaagaugcacuugc

SEQ ID NO: 16792 - RNA, 21 nt, Artificial Sequence
  RNA Oligomer
caauggcuucaggguuuuggg

SEQ ID NO: 16793 - RNA, 21 nt, Artificial Sequence
  RNA Oligomer
cuccacugacugugguuuuca

SEQ ID NO: 16794 - RNA, 21 nt, Artificial Sequence
  RNA Oligomer
ugaguuugcaacagaggaccu

SEQ ID NO: 16795 - RNA, 21 nt, Artificial Sequence
  RNA Oligomer
aaugguagccacggugaagga

SEQ ID NO: 16796 - RNA, 21 nt, Artificial Sequence
  RNA Oligomer
caucuggaacauaagaauggc

SEQ ID NO: 16797 - RNA, 21 nt, Artificial Sequence
  RNA Oligomer
aacauaagaauggccagugug

SEQ ID NO: 16798 - RNA, 21 nt, Artificial Sequence
  RNA Oligomer
guguuaaggccuaaauccugg

SEQ ID NO: 16799 - RNA, 21 nt, Artificial Sequence
  RNA Oligomer
gguuuuggguauaaaaugagg

SEQ ID NO: 16800 - RNA, 21 nt, Artificial Sequence
  RNA Oligomer
ugcuuagcucugcaauguucc

SEQ ID NO: 16801 - RNA, 21 nt, Artificial Sequence
  RNA Oligomer
auaaagagguuucucucaucu

SEQ ID NO: 16802 - RNA, 21 nt, Artificial Sequence
  RNA Oligomer
ucuggaguccucccauucuga

SEQ ID NO: 16803 - RNA, 21 nt, Artificial Sequence
  RNA Oligomer
auguauaucaaaugcugcuuc

SEQ ID NO: 16804 - RNA, 21 nt, Artificial Sequence
  RNA Oligomer
uugcagcugcaaucuuauuuc

SEQ ID NO: 16805 - RNA, 21 nt, Artificial Sequence
  RNA Oligomer
uaccucggcuuuugugaugga

SEQ ID NO: 16806 - RNA, 21 nt, Artificial Sequence
  RNA Oligomer
uguaaugauaccauugaguac

SEQ ID NO: 16807 - RNA, 21 nt, Artificial Sequence
  RNA Oligomer
cuuuggaaguugaacuuucug

SEQ ID NO: 16808 - RNA, 21 nt, Artificial Sequence
  RNA Oligomer
gaacugaguuugcaacagagg

SEQ ID NO: 16809 - RNA, 21 nt, Artificial Sequence
  RNA Oligomer
aguuugcaacagaggaccugc

SEQ ID NO: 16810 - RNA, 21 nt, Artificial Sequence
  RNA Oligomer
auggauuuuguguuaacgcug

SEQ ID NO: 16811 - RNA, 21 nt, Artificial Sequence
  RNA Oligomer
gagaauucuguccuccucuug

SEQ ID NO: 16812 - RNA, 21 nt, Artificial Sequence
  RNA Oligomer
acauaacagcauauuugcuag

SEQ ID NO: 16813 - RNA, 21 nt, Artificial Sequence
  RNA Oligomer
acagcauauuugcuagaaagc

SEQ ID NO: 16814 - RNA, 21 nt, Artificial Sequence
  RNA Oligomer
auauuugcuagaaagcacaac

SEQ ID NO: 16815 - RNA, 21 nt, Artificial Sequence
  RNA Oligomer
gaacauaagaauggccagugu

SEQ ID NO: 16816 - RNA, 21 nt, Artificial Sequence
  RNA Oligomer
cuucucguucuugagcuccuc

SEQ ID NO: 16817 - RNA, 21 nt, Artificial Sequence
  RNA Oligomer
cuaccucggcuuuugugaugg

SEQ ID NO: 16818 - RNA, 21 nt, Artificial Sequence
  RNA Oligomer
uuauuauucugacagguuagg

SEQ ID NO: 16819 - RNA, 21 nt, Artificial Sequence
  RNA Oligomer
uuauucugacagguuaggaau

SEQ ID NO: 16820 - RNA, 21 nt, Artificial Sequence
  RNA Oligomer
aauagacaguagccagcgucc

SEQ ID NO: 16821 - RNA, 21 nt, Artificial Sequence
  RNA Oligomer
acaucucuccacugacugugg

SEQ ID NO: 16822 - RNA, 21 nt, Artificial Sequence
  RNA Oligomer
aaguugaacuuucugcuuucu

SEQ ID NO: 16823 - RNA, 21 nt, Artificial Sequence
  RNA Oligomer
uuuuguguuaacgcugggaga

SEQ ID NO: 16824 - RNA, 21 nt, Artificial Sequence
  RNA Oligomer
uaacgcugggagaauucuguc

SEQ ID NO: 16825 - RNA, 21 nt, Artificial Sequence
  RNA Oligomer
aacgcugggagaauucugucc

SEQ ID NO: 16826 - RNA, 21 nt, Artificial Sequence
  RNA Oligomer
gaauaucuugagauacugcac

SEQ ID NO: 16827 - RNA, 21 nt, Artificial Sequence
  RNA Oligomer
uuucuggacauaacagcauau

SEQ ID NO: 16828 - RNA, 21 nt, Artificial Sequence
  RNA Oligomer
gugggcauccugguuuuuugu

SEQ ID NO: 16829 - RNA, 21 nt, Artificial Sequence
  RNA Oligomer
aauccagaugaaaggcgggca

SEQ ID NO: 16830 - RNA, 21 nt, Artificial Sequence
  RNA Oligomer
gaauggccaguguguuaaggc

SEQ ID NO: 16831 - RNA, 21 nt, Artificial Sequence
  RNA Oligomer
guuaaggccuaaauccuggag

SEQ ID NO: 16832 - RNA, 21 nt, Artificial Sequence
  RNA Oligomer
auggcagaagcacucacuucc

SEQ ID NO: 16833 - RNA, 21 nt, Artificial Sequence
  RNA Oligomer
ugaggauucaaugaggacucc

SEQ ID NO: 16834 - RNA, 21 nt, Artificial Sequence
  RNA Oligomer
aaagagguuucucucaucuuc

SEQ ID NO: 16835 - RNA, 21 nt, Artificial Sequence
  RNA Oligomer
gagguuucucucaucuucugg

SEQ ID NO: 16836 - RNA, 21 nt, Artificial Sequence
  RNA Oligomer
uucuuguuucggcacuuugca

SEQ ID NO: 16837 - RNA, 21 nt, Artificial Sequence
  RNA Oligomer
uuucggcacuuugcagcugca

SEQ ID NO: 16838 - RNA, 21 nt, Artificial Sequence
  RNA Oligomer
ugcagcugcaaucuuauuucu

SEQ ID NO: 16839 - RNA, 21 nt, Artificial Sequence
  RNA Oligomer
ugagugacuucucacagcugc

SEQ ID NO: 16840 - RNA, 21 nt, Artificial Sequence
  RNA Oligomer
uuguucuggauggcaaaccuc

SEQ ID NO: 16841 - RNA, 21 nt, Artificial Sequence
  RNA Oligomer
uggauggcaaaccucagcucu

SEQ ID NO: 16842 - RNA, 21 nt, Artificial Sequence
  RNA Oligomer
gugguuuccaaacaucucucc

SEQ ID NO: 16843 - RNA, 21 nt, Artificial Sequence
  RNA Oligomer
cagcucuuccuugacaaaggg

SEQ ID NO: 16844 - RNA, 21 nt, Artificial Sequence
  RNA Oligomer
agcucuuccuugacaaagggc

SEQ ID NO: 16845 - RNA, 21 nt, Artificial Sequence
  RNA Oligomer
aacugaguuugcaacagagga

SEQ ID NO: 16846 - RNA, 21 nt, Artificial Sequence
  RNA Oligomer
uugccuaguuuucuugcacac

SEQ ID NO: 16847 - RNA, 21 nt, Artificial Sequence
  RNA Oligomer
caauuucuggacauaacagca

SEQ ID NO: 16848 - RNA, 21 nt, Artificial Sequence
  RNA Oligomer
uggacauaacagcauauuugc

SEQ ID NO: 16849 - RNA, 21 nt, Artificial Sequence
  RNA Oligomer
aacagcauauuugcuagaaag

SEQ ID NO: 16850 - RNA, 21 nt, Artificial Sequence
  RNA Oligomer
uugcuagaaagcacaacccug

SEQ ID NO: 16851 - RNA, 21 nt, Artificial Sequence
  RNA Oligomer
ugcuagaaagcacaacccugg

SEQ ID NO: 16852 - RNA, 21 nt, Artificial Sequence
  RNA Oligomer
aauggccaguguguuaaggcc

SEQ ID NO: 16853 - RNA, 21 nt, Artificial Sequence
  RNA Oligomer
auggccaguguguuaaggccu

SEQ ID NO: 16854 - RNA, 21 nt, Artificial Sequence
  RNA Oligomer
uuaaggccuaaauccuggagu

SEQ ID NO: 16855 - RNA, 21 nt, Artificial Sequence
  RNA Oligomer
augaggauucaaugaggacuc

SEQ ID NO: 16856 - RNA, 21 nt, Artificial Sequence
  RNA Oligomer
uuucucucaucuucuggaguc

SEQ ID NO: 16857 - RNA, 21 nt, Artificial Sequence
  RNA Oligomer
ugugguuuccaaacaucucuc

SEQ ID NO: 16858 - RNA, 21 nt, Artificial Sequence
  RNA Oligomer
aaccacaaggaaaggaaaaug

SEQ ID NO: 16859 - RNA, 21 nt, Artificial Sequence
  RNA Oligomer
aacccuuuggaaguugaacuu

SEQ ID NO: 16860 - RNA, 21 nt, Artificial Sequence
  RNA Oligomer
uuccugugacuuuggaacuga

SEQ ID NO: 16861 - RNA, 21 nt, Artificial Sequence
  RNA Oligomer
cauugccuaguuuucuugcac

SEQ ID NO: 16862 - RNA, 21 nt, Artificial Sequence
  RNA Oligomer
cuggaacauaagaauggccag

SEQ ID NO: 16863 - RNA, 21 nt, Artificial Sequence
  RNA Oligomer
uaaauccuggaguugaggcaa

SEQ ID NO: 16864 - RNA, 21 nt, Artificial Sequence
  RNA Oligomer
guugaggcaaagaugcacuug

SEQ ID NO: 16865 - RNA, 21 nt, Artificial Sequence
  RNA Oligomer
ugaggcaaagaugcacuugcc

SEQ ID NO: 16866 - RNA, 21 nt, Artificial Sequence
  RNA Oligomer
gaggauucaaugaggacuccc

SEQ ID NO: 16867 - RNA, 21 nt, Artificial Sequence
  RNA Oligomer
uuccuucuuuuaucuguugga

SEQ ID NO: 16868 - RNA, 21 nt, Artificial Sequence
  RNA Oligomer
uaaagagguuucucucaucuu

SEQ ID NO: 16869 - RNA, 21 nt, Artificial Sequence
  RNA Oligomer
ucucaucuucuggaguccucc

SEQ ID NO: 16870 - RNA, 21 nt, Artificial Sequence
  RNA Oligomer
ugacagugacugauuccagcg

SEQ ID NO: 16871 - RNA, 21 nt, Artificial Sequence
  RNA Oligomer
auagacaguagccagcguccu

SEQ ID NO: 16872 - RNA, 21 nt, Artificial Sequence
  RNA Oligomer
cuccacugacugugguuucca

SEQ ID NO: 16873 - RNA, 21 nt, Artificial Sequence
  RNA Oligomer
accacaaggaaaggaaaaugg

SEQ ID NO: 16874 - RNA, 21 nt, Artificial Sequence
  RNA Oligomer
uggauuuuguguuaacgcugg

SEQ ID NO: 16875 - RNA, 21 nt, Artificial Sequence
  RNA Oligomer
guguuaacgcugggagaauuc

SEQ ID NO: 16876 - RNA, 21 nt, Artificial Sequence
  RNA Oligomer
uccugguuuuuuguagaaucc

SEQ ID NO: 16877 - RNA, 21 nt, Artificial Sequence
  RNA Oligomer
agaauccagaugaaaggcggg

SEQ ID NO: 16878 - RNA, 21 nt, Artificial Sequence
  RNA Oligomer
ucuggaacauaagaauggcca

SEQ ID NO: 16879 - RNA, 21 nt, Artificial Sequence
  RNA Oligomer
auccuggaguugaggcaaaga

SEQ ID NO: 16880 - RNA, 21 nt, Artificial Sequence
  RNA Oligomer
cuggaguugaggcaaagaugc

SEQ ID NO: 16881 - RNA, 21 nt, Artificial Sequence
  RNA Oligomer
cugcugggauucuagagguac

SEQ ID NO: 16882 - RNA, 21 nt, Artificial Sequence
  RNA Oligomer
uccaauggcuucaggguuuug

SEQ ID NO: 16883 - RNA, 21 nt, Artificial Sequence
  RNA Oligomer
uuuaucuguuggauaaagagg

SEQ ID NO: 16884 - RNA, 21 nt, Artificial Sequence
  RNA Oligomer
augcugcuucucguucuugag

SEQ ID NO: 16885 - RNA, 21 nt, Artificial Sequence
  RNA Oligomer
accucggcuuuugugauggac

SEQ ID NO: 16886 - RNA, 21 nt, Artificial Sequence
  RNA Oligomer
ucggcuuuugugauggacacc

SEQ ID NO: 16887 - RNA, 21 nt, Artificial Sequence
  RNA Oligomer
auucugacagguuaggaauac

SEQ ID NO: 16888 - RNA, 21 nt, Artificial Sequence
  RNA Oligomer
uaauagacaguagccagcguc

SEQ ID NO: 16889 - RNA, 21 nt, Artificial Sequence
  RNA Oligomer
aaacaucucuccacugacugu

SEQ ID NO: 16890 - RNA, 21 nt, Artificial Sequence
  RNA Oligomer
cugacugugguuuucaaccac

SEQ ID NO: 16891 - RNA, 21 nt, Artificial Sequence
  RNA Oligomer
guuuucaaccacaaggaaagg

SEQ ID NO: 16892 - RNA, 21 nt, Artificial Sequence
  RNA Oligomer
gaccuaagacauugaguggag

SEQ ID NO: 16893 - RNA, 21 nt, Artificial Sequence
  RNA Oligomer
gaaguugaacuuucugcuuuc

SEQ ID NO: 16894 - RNA, 21 nt, Artificial Sequence
  RNA Oligomer
ggauuuuguguuaacgcuggg

SEQ ID NO: 16895 - RNA, 21 nt, Artificial Sequence
  RNA Oligomer
acucuuagaaaccagaucuga

SEQ ID NO: 16896 - RNA, 21 nt, Artificial Sequence
  RNA Oligomer
cauauaaaagucacaucagug

SEQ ID NO: 16897 - RNA, 21 nt, Artificial Sequence
  RNA Oligomer
aauuucuggacauaacagcau

SEQ ID NO: 16898 - RNA, 21 nt, Artificial Sequence
  RNA Oligomer
ugcugcugggauucuagaggu

SEQ ID NO: 16899 - RNA, 21 nt, Artificial Sequence
  RNA Oligomer
uaucuguuggauaaagagguu

SEQ ID NO: 16900 - RNA, 21 nt, Artificial Sequence
  RNA Oligomer
gacugugguuuccaaacaucu

SEQ ID NO: 16901 - RNA, 21 nt, Artificial Sequence
  RNA Oligomer
aacaucucuccacugacugug

SEQ ID NO: 16902 - RNA, 21 nt, Artificial Sequence
  RNA Oligomer
ucuuuggcucuuccagccuag

SEQ ID NO: 16903 - RNA, 21 nt, Artificial Sequence
  RNA Oligomer
uggaaguugaacuuucugcuu

SEQ ID NO: 16904 - RNA, 21 nt, Artificial Sequence
  RNA Oligomer
cugaguuugcaacagaggacc

SEQ ID NO: 16905 - RNA, 21 nt, Artificial Sequence
  RNA Oligomer
acgcugggagaauucuguccu

SEQ ID NO: 16906 - RNA, 21 nt, Artificial Sequence
  RNA Oligomer
cuucuggccaccugaauaucu

SEQ ID NO: 16907 - RNA, 21 nt, Artificial Sequence
  RNA Oligomer
ucggaagaguacauugccuag

SEQ ID NO: 16908 - RNA, 21 nt, Artificial Sequence
  RNA Oligomer
ccaucuggaacauaagaaugg

SEQ ID NO: 16909 - RNA, 21 nt, Artificial Sequence
  RNA Oligomer
uguuaaggccuaaauccugga

SEQ ID NO: 16910 - RNA, 21 nt, Artificial Sequence
  RNA Oligomer
ucucugcugcugggauucuag

SEQ ID NO: 16911 - RNA, 21 nt, Artificial Sequence
  RNA Oligomer
uuaucuguuggauaaagaggu

SEQ ID NO: 16912 - RNA, 21 nt, Artificial Sequence
  RNA Oligomer
cuguuggauaaagagguuucu

SEQ ID NO: 16913 - RNA, 21 nt, Artificial Sequence
  RNA Oligomer
uguuggauaaagagguuucuc

SEQ ID NO: 16914 - RNA, 21 nt, Artificial Sequence
  RNA Oligomer
uuggauaaagagguuucucuc

SEQ ID NO: 16915 - RNA, 21 nt, Artificial Sequence
  RNA Oligomer
cugacagguuaggaauacuag

SEQ ID NO: 16916 - RNA, 21 nt, Artificial Sequence
  RNA Oligomer
uuguggccagugugagugacu

SEQ ID NO: 16917 - RNA, 21 nt, Artificial Sequence
  RNA Oligomer
agugugagugacuucucacag

SEQ ID NO: 16918 - RNA, 21 nt, Artificial Sequence
  RNA Oligomer
uucuggauggcaaaccucagc

SEQ ID NO: 16919 - RNA, 21 nt, Artificial Sequence
  RNA Oligomer
uauucuuuggcucuuccagcc

SEQ ID NO: 16920 - RNA, 21 nt, Artificial Sequence
  RNA Oligomer
auucuuuggcucuuccagccu

SEQ ID NO: 16921 - RNA, 21 nt, Artificial Sequence
  RNA Oligomer
aagacauugaguggagagucc

SEQ ID NO: 16922 - RNA, 21 nt, Artificial Sequence
  RNA Oligomer
auccugguuuuuuguagaauc

SEQ ID NO: 16923 - RNA, 21 nt, Artificial Sequence
  RNA Oligomer
aucuguuggauaaagagguuu

SEQ ID NO: 16924 - RNA, 21 nt, Artificial Sequence
  RNA Oligomer
ucuguuggauaaagagguuuc

SEQ ID NO: 16925 - RNA, 21 nt, Artificial Sequence
  RNA Oligomer
uguauaucaaaugcugcuucu

SEQ ID NO: 16926 - RNA, 21 nt, Artificial Sequence
  RNA Oligomer
uucugacagguuaggaauacu

SEQ ID NO: 16927 - RNA, 21 nt, Artificial Sequence
  RNA Oligomer
ugugagugacuucucacagcu

SEQ ID NO: 16928 - RNA, 21 nt, Artificial Sequence
  RNA Oligomer
gugagugacuucucacagcug

SEQ ID NO: 16929 - RNA, 21 nt, Artificial Sequence
  RNA Oligomer
ucuggauggcaaaccucagcu

SEQ ID NO: 16930 - RNA, 21 nt, Artificial Sequence
  RNA Oligomer
auauucuuuggcucuuccagc

SEQ ID NO: 16931 - RNA, 21 nt, Artificial Sequence
  RNA Oligomer
acccuuuggaaguugaacuuu

SEQ ID NO: 16932 - RNA, 21 nt, Artificial Sequence
  RNA Oligomer
caccugaauaucuugagauac

SEQ ID NO: 16933 - RNA, 21 nt, Artificial Sequence
  RNA Oligomer
ucucucaucuucuggaguccu

SEQ ID NO: 16934 - RNA, 21 nt, Artificial Sequence
  RNA Oligomer
uucugagcccggacaauacac

SEQ ID NO: 16935 - RNA, 21 nt, Artificial Sequence
  RNA Oligomer
guauaucaaaugcugcuucuc

SEQ ID NO: 16936 - RNA, 21 nt, Artificial Sequence
  RNA Oligomer
acagugacugauuccagcgca

SEQ ID NO: 16937 - RNA, 21 nt, Artificial Sequence
  RNA Oligomer
aggugcuuguucuggauggca

SEQ ID NO: 16938 - RNA, 21 nt, Artificial Sequence
  RNA Oligomer
aacacucugagaauuucacag

SEQ ID NO: 16939 - RNA, 21 nt, Artificial Sequence
  RNA Oligomer
uggagaguccuaacccuuugg

SEQ ID NO: 16940 - RNA, 21 nt, Artificial Sequence
  RNA Oligomer
uuucuuccugugacuuuggaa

SEQ ID NO: 16941 - RNA, 21 nt, Artificial Sequence
  RNA Oligomer
acacucugagaauuucacaga

SEQ ID NO: 16942 - RNA, 21 nt, Artificial Sequence
  RNA Oligomer
cuuguucuggauggcaaaccu

SEQ ID NO: 16943 - RNA, 21 nt, Artificial Sequence
  RNA Oligomer
ugugguuuucaaccacaagga

SEQ ID NO: 16944 - RNA, 21 nt, Artificial Sequence
  RNA Oligomer
aauauucuuuggcucuuccag

SEQ ID NO: 16945 - RNA, 21 nt, Artificial Sequence
  RNA Oligomer
guccuaacccuuuggaaguug

SEQ ID NO: 16946 - RNA, 21 nt, Artificial Sequence
  RNA Oligomer
acaauuucuggacauaacagc

SEQ ID NO: 16947 - RNA, 21 nt, Artificial Sequence
  RNA Oligomer
ugacagguuaggaauacuagg

SEQ ID NO: 16948 - RNA, 21 nt, Artificial Sequence
  RNA Oligomer
ccacaaggaaaggaaaaugga

SEQ ID NO: 16949 - RNA, 21 nt, Artificial Sequence
  RNA Oligomer
ggaauauucuuuggcucuucc

SEQ ID NO: 16950 - RNA, 21 nt, Artificial Sequence
  RNA Oligomer
agacauugaguggagaguccu

SEQ ID NO: 16951 - RNA, 21 nt, Artificial Sequence
  RNA Oligomer
uccuaacccuuuggaaguuga

SEQ ID NO: 16952 - RNA, 21 nt, Artificial Sequence
  RNA Oligomer
uggauaaagagguuucucuca

SEQ ID NO: 16953 - RNA, 21 nt, Artificial Sequence
  RNA Oligomer
aauaagguacaaaugcaaggc

SEQ ID NO: 16954 - RNA, 21 nt, Artificial Sequence
  RNA Oligomer
ccugcuucauaucucucccuu

SEQ ID NO: 16955 - RNA, 21 nt, Artificial Sequence
  RNA Oligomer
cccugcuucauaucucucccu

SEQ ID NO: 16956 - RNA, 21 nt, Artificial Sequence
  RNA Oligomer
ccuuugauauuauguggcuuu

SEQ ID NO: 16957 - RNA, 21 nt, Artificial Sequence
  RNA Oligomer
ugccuugcauuuguaccuuau

SEQ ID NO: 16958 - RNA, 21 nt, Artificial Sequence
  RNA Oligomer
cgacauaguauggaaguauuu

SEQ ID NO: 16959 - RNA, 21 nt, Artificial Sequence
  RNA Oligomer
gcuuuuauccacuggcauuuu

SEQ ID NO: 16960 - RNA, 21 nt, Artificial Sequence
  RNA Oligomer
ucaaucaaccugcacuucaua

SEQ ID NO: 16961 - RNA, 21 nt, Artificial Sequence
  RNA Oligomer
gaccaucuccuaucuuuuauu

SEQ ID NO: 16962 - RNA, 21 nt, Artificial Sequence
  RNA Oligomer
agccuugcacuccugaauuuu

SEQ ID NO: 16963 - RNA, 21 nt, Artificial Sequence
  RNA Oligomer
uccuuugauauuauguggcuu

SEQ ID NO: 16964 - RNA, 21 nt, Artificial Sequence
  RNA Oligomer
gcacuucauaucuagauuucu

SEQ ID NO: 16965 - RNA, 21 nt, Artificial Sequence
  RNA Oligomer
ggacaucaucaccuuggaaau

SEQ ID NO: 16966 - RNA, 21 nt, Artificial Sequence
  RNA Oligomer
caagagaaacugcagaauuuu

SEQ ID NO: 16967 - RNA, 21 nt, Artificial Sequence
  RNA Oligomer
gccuugcacuccugaauuuua

SEQ ID NO: 16968 - RNA, 21 nt, Artificial Sequence
  RNA Oligomer
ggccuucauuaaauguuuguu

SEQ ID NO: 16969 - RNA, 21 nt, Artificial Sequence
  RNA Oligomer
cccuagacucuguaaccaccu

SEQ ID NO: 16970 - RNA, 21 nt, Artificial Sequence
  RNA Oligomer
ccaucuccuaucuuuuauuuc

SEQ ID NO: 16971 - RNA, 21 nt, Artificial Sequence
  RNA Oligomer
gccugacaagugaaguuguaa

SEQ ID NO: 16972 - RNA, 21 nt, Artificial Sequence
  RNA Oligomer
ccuugcacuccugaauuuuau

SEQ ID NO: 16973 - RNA, 21 nt, Artificial Sequence
  RNA Oligomer
guacuuuguuuuuccaugugu

SEQ ID NO: 16974 - RNA, 21 nt, Artificial Sequence
  RNA Oligomer
ccucauuaaauggugauuucu

SEQ ID NO: 16975 - RNA, 21 nt, Artificial Sequence
  RNA Oligomer
cugcacuucauaucuagauuu

SEQ ID NO: 16976 - RNA, 21 nt, Artificial Sequence
  RNA Oligomer
ccugcacuucauaucuagauu

SEQ ID NO: 16977 - RNA, 21 nt, Artificial Sequence
  RNA Oligomer
accuuauugaucuuugcccau

SEQ ID NO: 16978 - RNA, 21 nt, Artificial Sequence
  RNA Oligomer
gcccaucaucucugccuuuga

SEQ ID NO: 16979 - RNA, 21 nt, Artificial Sequence
  RNA Oligomer
gcacuuaucaaggaucgggaa

SEQ ID NO: 16980 - RNA, 21 nt, Artificial Sequence
  RNA Oligomer
gcaaaaugcuaggccuguagu

SEQ ID NO: 16981 - RNA, 21 nt, Artificial Sequence
  RNA Oligomer
uccauguguuuugcuuuuauc

SEQ ID NO: 16982 - RNA, 21 nt, Artificial Sequence
  RNA Oligomer
gcuacaauccuaccuuuugau

SEQ ID NO: 16983 - RNA, 21 nt, Artificial Sequence
  RNA Oligomer
gggccuucauuaaauguuugu

SEQ ID NO: 16984 - RNA, 21 nt, Artificial Sequence
  RNA Oligomer
ggugguguccuucuuccucaa

SEQ ID NO: 16985 - RNA, 21 nt, Artificial Sequence
  RNA Oligomer
acuccucaacuugcugccuaa

SEQ ID NO: 16986 - RNA, 21 nt, Artificial Sequence
  RNA Oligomer
cuccuuugauauuauguggcu

SEQ ID NO: 16987 - RNA, 21 nt, Artificial Sequence
  RNA Oligomer
ggaucauguaaaugcucaaag

SEQ ID NO: 16988 - RNA, 21 nt, Artificial Sequence
  RNA Oligomer
gcauuuguaccuuauugaucu

SEQ ID NO: 16989 - RNA, 21 nt, Artificial Sequence
  RNA Oligomer
cuugcauuuguaccuuauuga

SEQ ID NO: 16990 - RNA, 21 nt, Artificial Sequence
  RNA Oligomer
acauuaucuuuuggcucugaa

SEQ ID NO: 16991 - RNA, 21 nt, Artificial Sequence
  RNA Oligomer
gcuuuuguagauggcacuuua

SEQ ID NO: 16992 - RNA, 21 nt, Artificial Sequence
  RNA Oligomer
gcuguuguugagcgaauuguu

SEQ ID NO: 16993 - RNA, 21 nt, Artificial Sequence
  RNA Oligomer
ggcuaugacguccauguucua

SEQ ID NO: 16994 - RNA, 21 nt, Artificial Sequence
  RNA Oligomer
ugcuuuuauccacuggcauuu

SEQ ID NO: 16995 - RNA, 21 nt, Artificial Sequence
  RNA Oligomer
ccauguguuuugcuuuuaucc

SEQ ID NO: 16996 - RNA, 21 nt, Artificial Sequence
  RNA Oligomer
gccuucauuaaauguuuguug

SEQ ID NO: 16997 - RNA, 21 nt, Artificial Sequence
  RNA Oligomer
caggaucauguaaaugcucaa

SEQ ID NO: 16998 - RNA, 21 nt, Artificial Sequence
  RNA Oligomer
ucauucaaucaaccugcacuu

SEQ ID NO: 16999 - RNA, 21 nt, Artificial Sequence
  RNA Oligomer
ccuugcauuuguaccuuauug

SEQ ID NO: 17000 - RNA, 21 nt, Artificial Sequence
  RNA Oligomer
ccaggaauguuucagcugcag

SEQ ID NO: 17001 - RNA, 21 nt, Artificial Sequence
  RNA Oligomer
gccaggaauguuucagcugca

SEQ ID NO: 17002 - RNA, 21 nt, Artificial Sequence
  RNA Oligomer
cgcaggauauugggagugugu

SEQ ID NO: 17003 - RNA, 21 nt, Artificial Sequence
  RNA Oligomer
gccaggauuuuguauugccau

SEQ ID NO: 17004 - RNA, 21 nt, Artificial Sequence
  RNA Oligomer
ucgacauaguauggaaguauu

SEQ ID NO: 17005 - RNA, 21 nt, Artificial Sequence
  RNA Oligomer
gucgacauaguauggaaguau

SEQ ID NO: 17006 - RNA, 21 nt, Artificial Sequence
  RNA Oligomer
gcauuuuuagcuccuugaaga

SEQ ID NO: 17007 - RNA, 21 nt, Artificial Sequence
  RNA Oligomer
ccuuagcuacaauccuaccuu

SEQ ID NO: 17008 - RNA, 21 nt, Artificial Sequence
  RNA Oligomer
ccuuguuuguuuuauucacca

SEQ ID NO: 17009 - RNA, 21 nt, Artificial Sequence
  RNA Oligomer
cccuugaaccucauuaaaugg

SEQ ID NO: 17010 - RNA, 21 nt, Artificial Sequence
  RNA Oligomer
cuuuuauuucagugccauaca

SEQ ID NO: 17011 - RNA, 21 nt, Artificial Sequence
  RNA Oligomer
aggaucauguaaaugcucaaa

SEQ ID NO: 17012 - RNA, 21 nt, Artificial Sequence
  RNA Oligomer
ugcacuucauaucuagauuuc

SEQ ID NO: 17013 - RNA, 21 nt, Artificial Sequence
  RNA Oligomer
caaucaaccugcacuucauau

SEQ ID NO: 17014 - RNA, 21 nt, Artificial Sequence
  RNA Oligomer
ccacuuucauucaaucaaccu

SEQ ID NO: 17015 - RNA, 21 nt, Artificial Sequence
  RNA Oligomer
cuagacucuguaaccaccucu

SEQ ID NO: 17016 - RNA, 21 nt, Artificial Sequence
  RNA Oligomer
agaagcaaacaugacuagaga

SEQ ID NO: 17017 - RNA, 21 nt, Artificial Sequence
  RNA Oligomer
cugaagaagcaaacaugacua

SEQ ID NO: 17018 - RNA, 21 nt, Artificial Sequence
  RNA Oligomer
uccuccgcccuuuuuguccua

SEQ ID NO: 17019 - RNA, 21 nt, Artificial Sequence
  RNA Oligomer
ggauauugggaguguguggca

SEQ ID NO: 17020 - RNA, 21 nt, Artificial Sequence
  RNA Oligomer
agcgaauuguuagaacaucuu

SEQ ID NO: 17021 - RNA, 21 nt, Artificial Sequence
  RNA Oligomer
cgacaugcugguuaaggugaa

SEQ ID NO: 17022 - RNA, 21 nt, Artificial Sequence
  RNA Oligomer
ggaaguauuugagagagagaa

SEQ ID NO: 17023 - RNA, 21 nt, Artificial Sequence
  RNA Oligomer
caaaaugcuaggccuguagua

SEQ ID NO: 17024 - RNA, 21 nt, Artificial Sequence
  RNA Oligomer
cuuuuauccacuggcauuuuu

SEQ ID NO: 17025 - RNA, 21 nt, Artificial Sequence
  RNA Oligomer
gcuucuaauuuugugcucuuu

SEQ ID NO: 17026 - RNA, 21 nt, Artificial Sequence
  RNA Oligomer
caaccugcacuucauaucuag

SEQ ID NO: 17027 - RNA, 21 nt, Artificial Sequence
  RNA Oligomer
uccuuuucugugaagcccuuu

SEQ ID NO: 17028 - RNA, 21 nt, Artificial Sequence
  RNA Oligomer
ugaugccgguaaagaaaaguu

SEQ ID NO: 17029 - RNA, 21 nt, Artificial Sequence
  RNA Oligomer
ccacugccaggauuuuguauu

SEQ ID NO: 17030 - RNA, 21 nt, Artificial Sequence
  RNA Oligomer
gaaguauuugagagagagaac

SEQ ID NO: 17031 - RNA, 21 nt, Artificial Sequence
  RNA Oligomer
gggucgacauaguauggaagu

SEQ ID NO: 17032 - RNA, 21 nt, Artificial Sequence
  RNA Oligomer
guagucaaggugcucaauaaa

SEQ ID NO: 17033 - RNA, 21 nt, Artificial Sequence
  RNA Oligomer
guaguagucaaggugcucaau

SEQ ID NO: 17034 - RNA, 21 nt, Artificial Sequence
  RNA Oligomer
uuagcuacaauccuaccuuuu

SEQ ID NO: 17035 - RNA, 21 nt, Artificial Sequence
  RNA Oligomer
gugggccuucauuaaauguuu

SEQ ID NO: 17036 - RNA, 21 nt, Artificial Sequence
  RNA Oligomer
uggugauuucuugcuaagcuc

SEQ ID NO: 17037 - RNA, 21 nt, Artificial Sequence
  RNA Oligomer
cccuucugcuuucuauuaccc

SEQ ID NO: 17038 - RNA, 21 nt, Artificial Sequence
  RNA Oligomer
gaacccuucugcuuucuauua

SEQ ID NO: 17039 - RNA, 21 nt, Artificial Sequence
  RNA Oligomer
gccauacauguuauuguuuuc

SEQ ID NO: 17040 - RNA, 21 nt, Artificial Sequence
  RNA Oligomer
ucaaccugcacuucauaucua

SEQ ID NO: 17041 - RNA, 21 nt, Artificial Sequence
  RNA Oligomer
cuauucccacuuucauucaau

SEQ ID NO: 17042 - RNA, 21 nt, Artificial Sequence
  RNA Oligomer
acaugacuagagacgcaccuu

SEQ ID NO: 17043 - RNA, 21 nt, Artificial Sequence
  RNA Oligomer
gaagcaaacaugacuagagac

SEQ ID NO: 17044 - RNA, 21 nt, Artificial Sequence
  RNA Oligomer
gaagaagcaaacaugacuaga

SEQ ID NO: 17045 - RNA, 21 nt, Artificial Sequence
  RNA Oligomer
agacauuaucuuuuggcucug

SEQ ID NO: 17046 - RNA, 21 nt, Artificial Sequence
  RNA Oligomer
cuccgcccuuuuuguccuaga

SEQ ID NO: 17047 - RNA, 21 nt, Artificial Sequence
  RNA Oligomer
uuaguuaagaugucugagaga

SEQ ID NO: 17048 - RNA, 21 nt, Artificial Sequence
  RNA Oligomer
ggaugcacgguuucuguucug

SEQ ID NO: 17049 - RNA, 21 nt, Artificial Sequence
  RNA Oligomer
gugaacgcacuuaucaaggau

SEQ ID NO: 17050 - RNA, 21 nt, Artificial Sequence
  RNA Oligomer
gugaccagacugcacaggaaa

SEQ ID NO: 17051 - RNA, 21 nt, Artificial Sequence
  RNA Oligomer
uguacuuuguuuuuccaugug

SEQ ID NO: 17052 - RNA, 21 nt, Artificial Sequence
  RNA Oligomer
accuuguuuguuuuauucacc

SEQ ID NO: 17053 - RNA, 21 nt, Artificial Sequence
  RNA Oligomer
gugguguccuucuuccucaag

SEQ ID NO: 17054 - RNA, 21 nt, Artificial Sequence
  RNA Oligomer
ccucucagcuucuaauuuugu

SEQ ID NO: 17055 - RNA, 21 nt, Artificial Sequence
  RNA Oligomer
gugccauacauguuauuguuu

SEQ ID NO: 17056 - RNA, 21 nt, Artificial Sequence
  RNA Oligomer
gaucauguaaaugcucaaaga

SEQ ID NO: 17057 - RNA, 21 nt, Artificial Sequence
  RNA Oligomer
cccuuacuauucccacuuuca

SEQ ID NO: 17058 - RNA, 21 nt, Artificial Sequence
  RNA Oligomer
guuguuucucugagcuuuguu

SEQ ID NO: 17059 - RNA, 21 nt, Artificial Sequence
  RNA Oligomer
cauggaagucucaaagaucuu

SEQ ID NO: 17060 - RNA, 21 nt, Artificial Sequence
  RNA Oligomer
ugaagaagcaaacaugacuag

SEQ ID NO: 17061 - RNA, 21 nt, Artificial Sequence
  RNA Oligomer
gacauuaucuuuuggcucuga

SEQ ID NO: 17062 - RNA, 21 nt, Artificial Sequence
  RNA Oligomer
ccuuuuuguccuagagugaga

SEQ ID NO: 17063 - RNA, 21 nt, Artificial Sequence
  RNA Oligomer
acauuaguuaagaugucugag

SEQ ID NO: 17064 - RNA, 21 nt, Artificial Sequence
  RNA Oligomer
cagcuuuuguagauggcacuu

SEQ ID NO: 17065 - RNA, 21 nt, Artificial Sequence
  RNA Oligomer
ccugacaagugaaguuguaaa

SEQ ID NO: 17066 - RNA, 21 nt, Artificial Sequence
  RNA Oligomer
agccugacaagugaaguugua

SEQ ID NO: 17067 - RNA, 21 nt, Artificial Sequence
  RNA Oligomer
aggagaugucugaauacugca

SEQ ID NO: 17068 - RNA, 21 nt, Artificial Sequence
  RNA Oligomer
cgcacuuaucaaggaucggga

SEQ ID NO: 17069 - RNA, 21 nt, Artificial Sequence
  RNA Oligomer
ccuacagaacaaaccaaaaau

SEQ ID NO: 17070 - RNA, 21 nt, Artificial Sequence
  RNA Oligomer
gccuacagaacaaaccaaaaa

SEQ ID NO: 17071 - RNA, 21 nt, Artificial Sequence
  RNA Oligomer
acgcaggauauugggagugug

SEQ ID NO: 17072 - RNA, 21 nt, Artificial Sequence
  RNA Oligomer
uggaaguauuugagagagaga

SEQ ID NO: 17073 - RNA, 21 nt, Artificial Sequence
  RNA Oligomer
ggucgacauaguauggaagua

SEQ ID NO: 17074 - RNA, 21 nt, Artificial Sequence
  RNA Oligomer
cuuagcuacaauccuaccuuu

SEQ ID NO: 17075 - RNA, 21 nt, Artificial Sequence
  RNA Oligomer
ugggccuucauuaaauguuug

SEQ ID NO: 17076 - RNA, 21 nt, Artificial Sequence
  RNA Oligomer
accaucauguaccaagugcuu

SEQ ID NO: 17077 - RNA, 21 nt, Artificial Sequence
  RNA Oligomer
gcagaaaccuuguuuguuuua

SEQ ID NO: 17078 - RNA, 21 nt, Artificial Sequence
  RNA Oligomer
acccuucugcuuucuauuacc

SEQ ID NO: 17079 - RNA, 21 nt, Artificial Sequence
  RNA Oligomer
ucugucuagaauccugcuuua

SEQ ID NO: 17080 - RNA, 21 nt, Artificial Sequence
  RNA Oligomer
accugcacuucauaucuagau

SEQ ID NO: 17081 - RNA, 21 nt, Artificial Sequence
  RNA Oligomer
ccauggaagucucaaagaucu

SEQ ID NO: 17082 - RNA, 21 nt, Artificial Sequence
  RNA Oligomer
uuauugaucuuugcccaugga

SEQ ID NO: 17083 - RNA, 21 nt, Artificial Sequence
  RNA Oligomer
gcaaacaugacuagagacgca

SEQ ID NO: 17084 - RNA, 21 nt, Artificial Sequence
  RNA Oligomer
uuguaaacacagugugguuau

SEQ ID NO: 17085 - RNA, 21 nt, Artificial Sequence
  RNA Oligomer
aguuguaaacacagugugguu

SEQ ID NO: 17086 - RNA, 21 nt, Artificial Sequence
  RNA Oligomer
gagcgaauuguuagaacaucu

SEQ ID NO: 17087 - RNA, 21 nt, Artificial Sequence
  RNA Oligomer
gaucuucaggaugcacgguuu

SEQ ID NO: 17088 - RNA, 21 nt, Artificial Sequence
  RNA Oligomer
ggagaugucugaauacugcag

SEQ ID NO: 17089 - RNA, 21 nt, Artificial Sequence
  RNA Oligomer
cuguuguugagcgaauuguua

SEQ ID NO: 17090 - RNA, 21 nt, Artificial Sequence
  RNA Oligomer
gugaugccgguaaagaaaagu

SEQ ID NO: 17091 - RNA, 21 nt, Artificial Sequence
  RNA Oligomer
agagugaugccgguaaagaaa

SEQ ID NO: 17092 - RNA, 21 nt, Artificial Sequence
  RNA Oligomer
gaggagagugaugccgguaaa

SEQ ID NO: 17093 - RNA, 21 nt, Artificial Sequence
  RNA Oligomer
ggcaugcauccucaucaucag

SEQ ID NO: 17094 - RNA, 21 nt, Artificial Sequence
  RNA Oligomer
ggauuuuguauugccaucggg

SEQ ID NO: 17095 - RNA, 21 nt, Artificial Sequence
  RNA Oligomer
ccaggauuuuguauugccauc

SEQ ID NO: 17096 - RNA, 21 nt, Artificial Sequence
  RNA Oligomer
ugccaggauuuuguauugcca

SEQ ID NO: 17097 - RNA, 21 nt, Artificial Sequence
  RNA Oligomer
cacugccaggauuuuguauug

SEQ ID NO: 17098 - RNA, 21 nt, Artificial Sequence
  RNA Oligomer
uugggucgacauaguauggaa

SEQ ID NO: 17099 - RNA, 21 nt, Artificial Sequence
  RNA Oligomer
uguaguagucaaggugcucaa

SEQ ID NO: 17100 - RNA, 21 nt, Artificial Sequence
  RNA Oligomer
agcuacaauccuaccuuuuga

SEQ ID NO: 17101 - RNA, 21 nt, Artificial Sequence
  RNA Oligomer
caaccuuagcuacaauccuac

SEQ ID NO: 17102 - RNA, 21 nt, Artificial Sequence
  RNA Oligomer
gcacauagugggccuucauua

SEQ ID NO: 17103 - RNA, 21 nt, Artificial Sequence
  RNA Oligomer
ggcuguaaaugagggcagaaa

SEQ ID NO: 17104 - RNA, 21 nt, Artificial Sequence
  RNA Oligomer
aggcuguaaaugagggcagaa

SEQ ID NO: 17105 - RNA, 21 nt, Artificial Sequence
  RNA Oligomer
gcucaaagauguaauguaguu

SEQ ID NO: 17106 - RNA, 21 nt, Artificial Sequence
  RNA Oligomer
cugucuagaauccugcuuuac

SEQ ID NO: 17107 - RNA, 21 nt, Artificial Sequence
  RNA Oligomer
cccacuuucauucaaucaacc

SEQ ID NO: 17108 - RNA, 21 nt, Artificial Sequence
  RNA Oligomer
ucccacuuucauucaaucaac

SEQ ID NO: 17109 - RNA, 21 nt, Artificial Sequence
  RNA Oligomer
cucccuuacuauucccacuuu

SEQ ID NO: 17110 - RNA, 21 nt, Artificial Sequence
  RNA Oligomer
ucucugagcuuuguuacugaa

SEQ ID NO: 17111 - RNA, 21 nt, Artificial Sequence
  RNA Oligomer
agcuuuuguagauggcacuuu

SEQ ID NO: 17112 - RNA, 21 nt, Artificial Sequence
  RNA Oligomer
ugaaguuguaaacacagugug

SEQ ID NO: 17113 - RNA, 21 nt, Artificial Sequence
  RNA Oligomer
gugaaguuguaaacacagugu

SEQ ID NO: 17114 - RNA, 21 nt, Artificial Sequence
  RNA Oligomer
ggaggugugauagagccuuug

SEQ ID NO: 17115 - RNA, 21 nt, Artificial Sequence
  RNA Oligomer
gacaugcugguuaaggugaac

SEQ ID NO: 17116 - RNA, 21 nt, Artificial Sequence
  RNA Oligomer
ugagcgggcuugugauaugca

SEQ ID NO: 17117 - RNA, 21 nt, Artificial Sequence
  RNA Oligomer
gcaggauauugggagugugug

SEQ ID NO: 17118 - RNA, 21 nt, Artificial Sequence
  RNA Oligomer
gagugaugccgguaaagaaaa

SEQ ID NO: 17119 - RNA, 21 nt, Artificial Sequence
  RNA Oligomer
cguggagaugagacugaucgu

SEQ ID NO: 17120 - RNA, 21 nt, Artificial Sequence
  RNA Oligomer
ugaccagacugcacaggaaau

SEQ ID NO: 17121 - RNA, 21 nt, Artificial Sequence
  RNA Oligomer
gacgcaggauauugggagugu

SEQ ID NO: 17122 - RNA, 21 nt, Artificial Sequence
  RNA Oligomer
ugggucgacauaguauggaag

SEQ ID NO: 17123 - RNA, 21 nt, Artificial Sequence
  RNA Oligomer
gcuguaaaugagggcagaaac

SEQ ID NO: 17124 - RNA, 21 nt, Artificial Sequence
  RNA Oligomer
ccauucuuucuuccuccaguc

SEQ ID NO: 17125 - RNA, 21 nt, Artificial Sequence
  RNA Oligomer
guaauguaguucuuuguuccu

SEQ ID NO: 17126 - RNA, 21 nt, Artificial Sequence
  RNA Oligomer
ugcugccaccaaaucugucua

SEQ ID NO: 17127 - RNA, 21 nt, Artificial Sequence
  RNA Oligomer
agcaucagagaaggccaggaa

SEQ ID NO: 17128 - RNA, 21 nt, Artificial Sequence
  RNA Oligomer
cugagcuuuguuacugaaaug

SEQ ID NO: 17129 - RNA, 21 nt, Artificial Sequence
  RNA Oligomer
caaacaugacuagagacgcac

SEQ ID NO: 17130 - RNA, 21 nt, Artificial Sequence
  RNA Oligomer
cauuaucuuuuggcucugaag

SEQ ID NO: 17131 - RNA, 21 nt, Artificial Sequence
  RNA Oligomer
cuuuuguagauggcacuuuag

SEQ ID NO: 17132 - RNA, 21 nt, Artificial Sequence
  RNA Oligomer
gagccugacaagugaaguugu

SEQ ID NO: 17133 - RNA, 21 nt, Artificial Sequence
  RNA Oligomer
agagccugacaagugaaguug

SEQ ID NO: 17134 - RNA, 21 nt, Artificial Sequence
  RNA Oligomer
ugaucuucaggaugcacgguu

SEQ ID NO: 17135 - RNA, 21 nt, Artificial Sequence
  RNA Oligomer
aggaggugugauagagccuuu

SEQ ID NO: 17136 - RNA, 21 nt, Artificial Sequence
  RNA Oligomer
uuaucaaggaucgggaagguu

SEQ ID NO: 17137 - RNA, 21 nt, Artificial Sequence
  RNA Oligomer
gagagugaugccgguaaagaa

SEQ ID NO: 17138 - RNA, 21 nt, Artificial Sequence
  RNA Oligomer
ggagagugaugccgguaaaga

SEQ ID NO: 17139 - RNA, 21 nt, Artificial Sequence
  RNA Oligomer
aucuaugguguggaugggaaa

SEQ ID NO: 17140 - RNA, 21 nt, Artificial Sequence
  RNA Oligomer
gcacuccugaauuuuaucaaa

SEQ ID NO: 17141 - RNA, 21 nt, Artificial Sequence
  RNA Oligomer
guugaauaaaagagggaagaa

SEQ ID NO: 17142 - RNA, 21 nt, Artificial Sequence
  RNA Oligomer
gcuuuugaugccuucugugaa

SEQ ID NO: 17143 - RNA, 21 nt, Artificial Sequence
  RNA Oligomer
ccuugguuuaugagaacuggu

SEQ ID NO: 17144 - RNA, 21 nt, Artificial Sequence
  RNA Oligomer
caccuugguuuaugagaacug

SEQ ID NO: 17145 - RNA, 21 nt, Artificial Sequence
  RNA Oligomer
guaaacucuucaccuugguuu

SEQ ID NO: 17146 - RNA, 21 nt, Artificial Sequence
  RNA Oligomer
ucuuucuuccuccagucuguu

SEQ ID NO: 17147 - RNA, 21 nt, Artificial Sequence
  RNA Oligomer
guaguucuuuguuccugcuuu

SEQ ID NO: 17148 - RNA, 21 nt, Artificial Sequence
  RNA Oligomer
uguaguucuuuguuccugcuu

SEQ ID NO: 17149 - RNA, 21 nt, Artificial Sequence
  RNA Oligomer
cucaaagauguaauguaguuc

SEQ ID NO: 17150 - RNA, 21 nt, Artificial Sequence
  RNA Oligomer
ugcucaaagauguaauguagu

SEQ ID NO: 17151 - RNA, 21 nt, Artificial Sequence
  RNA Oligomer
ccaaaucugucuagaauccug

SEQ ID NO: 17152 - RNA, 21 nt, Artificial Sequence
  RNA Oligomer
ucccuuacuauucccacuuuc

SEQ ID NO: 17153 - RNA, 21 nt, Artificial Sequence
  RNA Oligomer
ugagcuuuguuacugaaauga

SEQ ID NO: 17154 - RNA, 21 nt, Artificial Sequence
  RNA Oligomer
aaggacacucuuggcucguuu

SEQ ID NO: 17155 - RNA, 21 nt, Artificial Sequence
  RNA Oligomer
auucauauccuccgcccuuuu

SEQ ID NO: 17156 - RNA, 21 nt, Artificial Sequence
  RNA Oligomer
gaagagccugacaagugaagu

SEQ ID NO: 17157 - RNA, 21 nt, Artificial Sequence
  RNA Oligomer
ggugugauagagccuuugauc

SEQ ID NO: 17158 - RNA, 21 nt, Artificial Sequence
  RNA Oligomer
ugaacgcacuuaucaaggauc

SEQ ID NO: 17159 - RNA, 21 nt, Artificial Sequence
  RNA Oligomer
aaguguuuucugagcgggcuu

SEQ ID NO: 17160 - RNA, 21 nt, Artificial Sequence
  RNA Oligomer
ggagagaaagaacuggaauuu

SEQ ID NO: 17161 - RNA, 21 nt, Artificial Sequence
  RNA Oligomer
uuauucaccaucauguaccaa

SEQ ID NO: 17162 - RNA, 21 nt, Artificial Sequence
  RNA Oligomer
ucaccacaucuugucuuuucc

SEQ ID NO: 17163 - RNA, 21 nt, Artificial Sequence
  RNA Oligomer
gucccugagcagucuacuucu

SEQ ID NO: 17164 - RNA, 21 nt, Artificial Sequence
  RNA Oligomer
ucuaauuuugugcucuuuccu

SEQ ID NO: 17165 - RNA, 21 nt, Artificial Sequence
  RNA Oligomer
cuucuaauuuugugcucuuuc

SEQ ID NO: 17166 - RNA, 21 nt, Artificial Sequence
  RNA Oligomer
gcuuaucugaaacuucccaac

SEQ ID NO: 17167 - RNA, 21 nt, Artificial Sequence
  RNA Oligomer
aucugucuagaauccugcuuu

SEQ ID NO: 17168 - RNA, 21 nt, Artificial Sequence
  RNA Oligomer
ccuuacuauucccacuuucau

SEQ ID NO: 17169 - RNA, 21 nt, Artificial Sequence
  RNA Oligomer
ucucccuuacuauucccacuu

SEQ ID NO: 17170 - RNA, 21 nt, Artificial Sequence
  RNA Oligomer
gagcuuuguuacugaaaugag

SEQ ID NO: 17171 - RNA, 21 nt, Artificial Sequence
  RNA Oligomer
aggacacucuuggcucguuug

SEQ ID NO: 17172 - RNA, 21 nt, Artificial Sequence
  RNA Oligomer
gaaggacacucuuggcucguu

SEQ ID NO: 17173 - RNA, 21 nt, Artificial Sequence
  RNA Oligomer
ucauucauauccuccgcccuu

SEQ ID NO: 17174 - RNA, 21 nt, Artificial Sequence
  RNA Oligomer
uugaagagccugacaagugaa

SEQ ID NO: 17175 - RNA, 21 nt, Artificial Sequence
  RNA Oligomer
gaggugugauagagccuuuga

SEQ ID NO: 17176 - RNA, 21 nt, Artificial Sequence
  RNA Oligomer
guaaagaaaaguugccgaaga

SEQ ID NO: 17177 - RNA, 21 nt, Artificial Sequence
  RNA Oligomer
aggagagugaugccgguaaag

SEQ ID NO: 17178 - RNA, 21 nt, Artificial Sequence
  RNA Oligomer
cuacagaacaaaccaaaaaug

SEQ ID NO: 17179 - RNA, 21 nt, Artificial Sequence
  RNA Oligomer
gcuaugacguccauguucuau

SEQ ID NO: 17180 - RNA, 21 nt, Artificial Sequence
  RNA Oligomer
guauuugagagagagaaccuu

SEQ ID NO: 17181 - RNA, 21 nt, Artificial Sequence
  RNA Oligomer
aguagucaaggugcucaauaa

SEQ ID NO: 17182 - RNA, 21 nt, Artificial Sequence
  RNA Oligomer
acauagugggccuucauuaaa

SEQ ID NO: 17183 - RNA, 21 nt, Artificial Sequence
  RNA Oligomer
cacauagugggccuucauuaa

SEQ ID NO: 17184 - RNA, 21 nt, Artificial Sequence
  RNA Oligomer
ccaucauguaccaagugcuug

SEQ ID NO: 17185 - RNA, 21 nt, Artificial Sequence
  RNA Oligomer
caggcuguaaaugagggcaga

SEQ ID NO: 17186 - RNA, 21 nt, Artificial Sequence
  RNA Oligomer
cugcuuucucuuucaguauua

SEQ ID NO: 17187 - RNA, 21 nt, Artificial Sequence
  RNA Oligomer
uugagcgaauuguuagaacau

SEQ ID NO: 17188 - RNA, 21 nt, Artificial Sequence
  RNA Oligomer
aggugugauagagccuuugau

SEQ ID NO: 17189 - RNA, 21 nt, Artificial Sequence
  RNA Oligomer
guauggaaguauuugagagag

SEQ ID NO: 17190 - RNA, 21 nt, Artificial Sequence
  RNA Oligomer
ggucuccucucagcuucuaau

SEQ ID NO: 17191 - RNA, 21 nt, Artificial Sequence
  RNA Oligomer
uaguucuuuguuccugcuuuc

SEQ ID NO: 17192 - RNA, 21 nt, Artificial Sequence
  RNA Oligomer
cccauggaagucucaaagauc

SEQ ID NO: 17193 - RNA, 21 nt, Artificial Sequence
  RNA Oligomer
gguguccaaauuuaauguaga

SEQ ID NO: 17194 - RNA, 21 nt, Artificial Sequence
  RNA Oligomer
ggaauguuucagcugcaguug

SEQ ID NO: 17195 - RNA, 21 nt, Artificial Sequence
  RNA Oligomer
acaggaggugugauagagccu

SEQ ID NO: 17196 - RNA, 21 nt, Artificial Sequence
  RNA Oligomer
acuggagagaaagaacuggaa

SEQ ID NO: 17197 - RNA, 21 nt, Artificial Sequence
  RNA Oligomer
ugaauaaaagagggaagaagg

SEQ ID NO: 17198 - RNA, 21 nt, Artificial Sequence
  RNA Oligomer
guguuucccuagacucuguaa

SEQ ID NO: 17199 - RNA, 21 nt, Artificial Sequence
  RNA Oligomer
ggcacuuuagugauugcuuuu

SEQ ID NO: 17200 - RNA, 21 nt, Artificial Sequence
  RNA Oligomer
ccaaaaauguucuucauccag

SEQ ID NO: 17201 - RNA, 21 nt, Artificial Sequence
  RNA Oligomer
ccuggccaggauuugguuguu

SEQ ID NO: 17202 - RNA, 21 nt, Artificial Sequence
  RNA Oligomer
gaaaccuuuaucccugcuuau

SEQ ID NO: 17203 - RNA, 21 nt, Artificial Sequence
  RNA Oligomer
ugacaagugaaguuguaaaca

SEQ ID NO: 17204 - RNA, 21 nt, Artificial Sequence
  RNA Oligomer
cugacaagugaaguuguaaac

SEQ ID NO: 17205 - RNA, 21 nt, Artificial Sequence
  RNA Oligomer
ccagccuugguuggaccuauu

SEQ ID NO: 17206 - RNA, 21 nt, Artificial Sequence
  RNA Oligomer
ccagcuccaagagguuuuuca

SEQ ID NO: 17207 - RNA, 21 nt, Artificial Sequence
  RNA Oligomer
acaggaaaugcaagagaaacu

SEQ ID NO: 17208 - RNA, 21 nt, Artificial Sequence
  RNA Oligomer
caucaucaggaaacucuaaaa

SEQ ID NO: 17209 - RNA, 21 nt, Artificial Sequence
  RNA Oligomer
cacuccugaauuuuaucaaac

SEQ ID NO: 17210 - RNA, 21 nt, Artificial Sequence
  RNA Oligomer
ugcacuccugaauuuuaucaa

SEQ ID NO: 17211 - RNA, 21 nt, Artificial Sequence
  RNA Oligomer
gucaaggugcucaauaaauau

SEQ ID NO: 17212 - RNA, 21 nt, Artificial Sequence
  RNA Oligomer
uguguuucccuagacucugua

SEQ ID NO: 17213 - RNA, 21 nt, Artificial Sequence
  RNA Oligomer
acccaguggaaggacacucuu

SEQ ID NO: 17214 - RNA, 21 nt, Artificial Sequence
  RNA Oligomer
agguguccaaauuuaauguag

SEQ ID NO: 17215 - RNA, 21 nt, Artificial Sequence
  RNA Oligomer
caggaauguuucagcugcagu

SEQ ID NO: 17216 - RNA, 21 nt, Artificial Sequence
  RNA Oligomer
acagcuguuguugagcgaauu

SEQ ID NO: 17217 - RNA, 21 nt, Artificial Sequence
  RNA Oligomer
cgguaaagaaaaguugccgaa

SEQ ID NO: 17218 - RNA, 21 nt, Artificial Sequence
  RNA Oligomer
gaaccucauuaaauggugauu

SEQ ID NO: 17219 - RNA, 21 nt, Artificial Sequence
  RNA Oligomer
agaaaccuuuaucccugcuua

SEQ ID NO: 17220 - RNA, 21 nt, Artificial Sequence
  RNA Oligomer
cuagaaaccuuuaucccugcu

SEQ ID NO: 17221 - RNA, 21 nt, Artificial Sequence
  RNA Oligomer
ugcccauggaagucucaaaga

SEQ ID NO: 17222 - RNA, 21 nt, Artificial Sequence
  RNA Oligomer
gaagguguccaaauuuaaugu

SEQ ID NO: 17223 - RNA, 21 nt, Artificial Sequence
  RNA Oligomer
aggaauguuucagcugcaguu

SEQ ID NO: 17224 - RNA, 21 nt, Artificial Sequence
  RNA Oligomer
gccagcuccuuuucugugaag

SEQ ID NO: 17225 - RNA, 21 nt, Artificial Sequence
  RNA Oligomer
agccuacagaacaaaccaaaa

SEQ ID NO: 17226 - RNA, 21 nt, Artificial Sequence
  RNA Oligomer
caacugcccaagccuacagaa

SEQ ID NO: 17227 - RNA, 21 nt, Artificial Sequence
  RNA Oligomer
cuccugaauuuuaucaaacac

SEQ ID NO: 17228 - RNA, 21 nt, Artificial Sequence
  RNA Oligomer
ugcauccucaucaucaggaaa

SEQ ID NO: 17229 - RNA, 21 nt, Artificial Sequence
  RNA Oligomer
gugagauaacuuccuucacau

SEQ ID NO: 17230 - RNA, 21 nt, Artificial Sequence
  RNA Oligomer
ugaaccucauuaaauggugau

SEQ ID NO: 17231 - RNA, 21 nt, Artificial Sequence
  RNA Oligomer
gcuuuacaggaucauguaaau

SEQ ID NO: 17232 - RNA, 21 nt, Artificial Sequence
  RNA Oligomer
gaaugguguguuucccuagac

SEQ ID NO: 17233 - RNA, 21 nt, Artificial Sequence
  RNA Oligomer
ugguuguuucucugagcuuug

SEQ ID NO: 17234 - RNA, 21 nt, Artificial Sequence
  RNA Oligomer
cguugguuguuucucugagcu

SEQ ID NO: 17235 - RNA, 21 nt, Artificial Sequence
  RNA Oligomer
gcccuuuuuguccuagaguga

SEQ ID NO: 17236 - RNA, 21 nt, Artificial Sequence
  RNA Oligomer
ggaaucucccagacuuguuuc

SEQ ID NO: 17237 - RNA, 21 nt, Artificial Sequence
  RNA Oligomer
caagccuacagaacaaaccaa

SEQ ID NO: 17238 - RNA, 21 nt, Artificial Sequence
  RNA Oligomer
gcaagagaaacugcagaauuu

SEQ ID NO: 17239 - RNA, 21 nt, Artificial Sequence
  RNA Oligomer
gagagaaagaacuggaauuuc

SEQ ID NO: 17240 - RNA, 21 nt, Artificial Sequence
  RNA Oligomer
cuggagagaaagaacuggaau

SEQ ID NO: 17241 - RNA, 21 nt, Artificial Sequence
  RNA Oligomer
ggcagaaaccuuguuuguuuu

SEQ ID NO: 17242 - RNA, 21 nt, Artificial Sequence
  RNA Oligomer
cucauugcauuuauugcaguu

SEQ ID NO: 17243 - RNA, 21 nt, Artificial Sequence
  RNA Oligomer
gguguccuucuuccucaaguc

SEQ ID NO: 17244 - RNA, 21 nt, Artificial Sequence
  RNA Oligomer
gucuccucucagcuucuaauu

SEQ ID NO: 17245 - RNA, 21 nt, Artificial Sequence
  RNA Oligomer
ccaccaaaucugucuagaauc

SEQ ID NO: 17246 - RNA, 21 nt, Artificial Sequence
  RNA Oligomer
guugguuguuucucugagcuu

SEQ ID NO: 17247 - RNA, 21 nt, Artificial Sequence
  RNA Oligomer
cgcccuuuuuguccuagagug

SEQ ID NO: 17248 - RNA, 21 nt, Artificial Sequence
  RNA Oligomer
agagaccaucuccuaucuuuu

SEQ ID NO: 17249 - RNA, 21 nt, Artificial Sequence
  RNA Oligomer
uuaagaugucugagagaccau

SEQ ID NO: 17250 - RNA, 21 nt, Artificial Sequence
  RNA Oligomer
ggaccuauugccaggaauguu

SEQ ID NO: 17251 - RNA, 21 nt, Artificial Sequence
  RNA Oligomer
agagccuuugaucuucaggau

SEQ ID NO: 17252 - RNA, 21 nt, Artificial Sequence
  RNA Oligomer
caaacgagguuccugguacau

SEQ ID NO: 17253 - RNA, 21 nt, Artificial Sequence
  RNA Oligomer
ggugcuagccaaacagcuguu

SEQ ID NO: 17254 - RNA, 21 nt, Artificial Sequence
  RNA Oligomer
ccaagccuacagaacaaacca

SEQ ID NO: 17255 - RNA, 21 nt, Artificial Sequence
  RNA Oligomer
gcucuuugacaacgccaacug

SEQ ID NO: 17256 - RNA, 21 nt, Artificial Sequence
  RNA Oligomer
gaaacucuaaaaaagaaccga

SEQ ID NO: 17257 - RNA, 21 nt, Artificial Sequence
  RNA Oligomer
gaagccuugcacuccugaauu

SEQ ID NO: 17258 - RNA, 21 nt, Artificial Sequence
  RNA Oligomer
gggugccaaauaaaugcucau

SEQ ID NO: 17259 - RNA, 21 nt, Artificial Sequence
  RNA Oligomer
caugugugagauaacuuccuu

SEQ ID NO: 17260 - RNA, 21 nt, Artificial Sequence
  RNA Oligomer
agucuacuucugugucuguca

SEQ ID NO: 17261 - RNA, 21 nt, Artificial Sequence
  RNA Oligomer
cuccucucagcuucuaauuuu

SEQ ID NO: 17262 - RNA, 21 nt, Artificial Sequence
  RNA Oligomer
cucuuucaguauuaaacucuc

SEQ ID NO: 17263 - RNA, 21 nt, Artificial Sequence
  RNA Oligomer
gccaccaaaucugucuagaau

SEQ ID NO: 17264 - RNA, 21 nt, Artificial Sequence
  RNA Oligomer
ugccaccaaaucugucuagaa

SEQ ID NO: 17265 - RNA, 21 nt, Artificial Sequence
  RNA Oligomer
ccgcccuuuuuguccuagagu

SEQ ID NO: 17266 - RNA, 21 nt, Artificial Sequence
  RNA Oligomer
agaccaucuccuaucuuuuau

SEQ ID NO: 17267 - RNA, 21 nt, Artificial Sequence
  RNA Oligomer
cugguuaaggugaacgcacuu

SEQ ID NO: 17268 - RNA, 21 nt, Artificial Sequence
  RNA Oligomer
aggcucuugcucaaguguuuu

SEQ ID NO: 17269 - RNA, 21 nt, Artificial Sequence
  RNA Oligomer
ccaaacgagguuccugguaca

SEQ ID NO: 17270 - RNA, 21 nt, Artificial Sequence
  RNA Oligomer
cucuucaagcuuuugggcuau

SEQ ID NO: 17271 - RNA, 21 nt, Artificial Sequence
  RNA Oligomer
uggagagaaagaacuggaauu

SEQ ID NO: 17272 - RNA, 21 nt, Artificial Sequence
  RNA Oligomer
ccucaucaucaggaaacucua

SEQ ID NO: 17273 - RNA, 21 nt, Artificial Sequence
  RNA Oligomer
ugagauaacuuccuucacauc

SEQ ID NO: 17274 - RNA, 21 nt, Artificial Sequence
  RNA Oligomer
guguccuucuuccucaagucu

SEQ ID NO: 17275 - RNA, 21 nt, Artificial Sequence
  RNA Oligomer
ucaggugguguccuucuuccu

SEQ ID NO: 17276 - RNA, 21 nt, Artificial Sequence
  RNA Oligomer
accucauuaaauggugauuuc

SEQ ID NO: 17277 - RNA, 21 nt, Artificial Sequence
  RNA Oligomer
guggaacuccucaacuugcug

SEQ ID NO: 17278 - RNA, 21 nt, Artificial Sequence
  RNA Oligomer
ggccaggauuugguuguuuaa

SEQ ID NO: 17279 - RNA, 21 nt, Artificial Sequence
  RNA Oligomer
cuguucucacauaacagagua

SEQ ID NO: 17280 - RNA, 21 nt, Artificial Sequence
  RNA Oligomer
gaauguggaacuccucaacuu

SEQ ID NO: 17281 - RNA, 21 nt, Artificial Sequence
  RNA Oligomer
guuuucaaccuagaaaccuuu

SEQ ID NO: 17282 - RNA, 21 nt, Artificial Sequence
  RNA Oligomer
ccugcuuuacaggaucaugua

SEQ ID NO: 17283 - RNA, 21 nt, Artificial Sequence
  RNA Oligomer
gugggcaguuucagccagaau

SEQ ID NO: 17284 - RNA, 21 nt, Artificial Sequence
  RNA Oligomer
agaucuuucguugguuguuuc

SEQ ID NO: 17285 - RNA, 21 nt, Artificial Sequence
  RNA Oligomer
guagacauuaucuuuuggcuc

SEQ ID NO: 17286 - RNA, 21 nt, Artificial Sequence
  RNA Oligomer
ccaucaucucugccuuugagu

SEQ ID NO: 17287 - RNA, 21 nt, Artificial Sequence
  RNA Oligomer
cagcuguuguugagcgaauug

SEQ ID NO: 17288 - RNA, 21 nt, Artificial Sequence
  RNA Oligomer
cuagccaaacagcuguuguug

SEQ ID NO: 17289 - RNA, 21 nt, Artificial Sequence
  RNA Oligomer
gcuagccaaacagcuguuguu

SEQ ID NO: 17290 - RNA, 21 nt, Artificial Sequence
  RNA Oligomer
accaaaaauguucuucaucca

SEQ ID NO: 17291 - RNA, 21 nt, Artificial Sequence
  RNA Oligomer
ugcaagagaaacugcagaauu

SEQ ID NO: 17292 - RNA, 21 nt, Artificial Sequence
  RNA Oligomer
caggaaacucuaaaaaagaac

SEQ ID NO: 17293 - RNA, 21 nt, Artificial Sequence
  RNA Oligomer
agucaaggugcucaauaaaua

SEQ ID NO: 17294 - RNA, 21 nt, Artificial Sequence
  RNA Oligomer
cuacaauccuaccuuuugaua

SEQ ID NO: 17295 - RNA, 21 nt, Artificial Sequence
  RNA Oligomer
cuuccucaagucuugacaauu

SEQ ID NO: 17296 - RNA, 21 nt, Artificial Sequence
  RNA Oligomer
cccaagcuuuugaugccuucu

SEQ ID NO: 17297 - RNA, 21 nt, Artificial Sequence
  RNA Oligomer
gacucaggugguguccuucuu

SEQ ID NO: 17298 - RNA, 21 nt, Artificial Sequence
  RNA Oligomer
agaacccuucugcuuucuauu

SEQ ID NO: 17299 - RNA, 21 nt, Artificial Sequence
  RNA Oligomer
agaauguggaacuccucaacu

SEQ ID NO: 17300 - RNA, 21 nt, Artificial Sequence
  RNA Oligomer
cagaauguggaacuccucaac

SEQ ID NO: 17301 - RNA, 21 nt, Artificial Sequence
  RNA Oligomer
ccagaauguggaacuccucaa

SEQ ID NO: 17302 - RNA, 21 nt, Artificial Sequence
  RNA Oligomer
uccugcuuucucuuucaguau

SEQ ID NO: 17303 - RNA, 21 nt, Artificial Sequence
  RNA Oligomer
uugccuugcauuuguaccuua

SEQ ID NO: 17304 - RNA, 21 nt, Artificial Sequence
  RNA Oligomer
ugagagaccaucuccuaucuu

SEQ ID NO: 17305 - RNA, 21 nt, Artificial Sequence
  RNA Oligomer
guagauggcacuuuagugauu

SEQ ID NO: 17306 - RNA, 21 nt, Artificial Sequence
  RNA Oligomer
gguuggaccuauugccaggaa

SEQ ID NO: 17307 - RNA, 21 nt, Artificial Sequence
  RNA Oligomer
gccuuugaucuucaggaugca

SEQ ID NO: 17308 - RNA, 21 nt, Artificial Sequence
  RNA Oligomer
guuaugcuccuggcacagaau

SEQ ID NO: 17309 - RNA, 21 nt, Artificial Sequence
  RNA Oligomer
aagccuacagaacaaaccaaa

SEQ ID NO: 17310 - RNA, 21 nt, Artificial Sequence
  RNA Oligomer
cugcagaauuuugcacaguua

SEQ ID NO: 17311 - RNA, 21 nt, Artificial Sequence
  RNA Oligomer
acugcagaauuuugcacaguu

SEQ ID NO: 17312 - RNA, 21 nt, Artificial Sequence
  RNA Oligomer
gaaacugcagaauuuugcaca

SEQ ID NO: 17313 - RNA, 21 nt, Artificial Sequence
  RNA Oligomer
ggaaacucuaaaaaagaaccg

SEQ ID NO: 17314 - RNA, 21 nt, Artificial Sequence
  RNA Oligomer
gauguggaccacaguacucua

SEQ ID NO: 17315 - RNA, 21 nt, Artificial Sequence
  RNA Oligomer
ggauguggaccacaguacucu

SEQ ID NO: 17316 - RNA, 21 nt, Artificial Sequence
  RNA Oligomer
gguguugagcaaugugcacuu

SEQ ID NO: 17317 - RNA, 21 nt, Artificial Sequence
  RNA Oligomer
ucaucaucaggaaacucuaaa

SEQ ID NO: 17318 - RNA, 21 nt, Artificial Sequence
  RNA Oligomer
cuagcacugguguugagcaau

SEQ ID NO: 17319 - RNA, 21 nt, Artificial Sequence
  RNA Oligomer
ggugccaaauaaaugcucaua

SEQ ID NO: 17320 - RNA, 21 nt, Artificial Sequence
  RNA Oligomer
aggccuguaguagucaaggug

SEQ ID NO: 17321 - RNA, 21 nt, Artificial Sequence
  RNA Oligomer
gugugagauaacuuccuucac

SEQ ID NO: 17322 - RNA, 21 nt, Artificial Sequence
  RNA Oligomer
gggcagaaaccuuguuuguuu

SEQ ID NO: 17323 - RNA, 21 nt, Artificial Sequence
  RNA Oligomer
ccucauugcauuuauugcagu

SEQ ID NO: 17324 - RNA, 21 nt, Artificial Sequence
  RNA Oligomer
cuccucaacuugcugccuaag

SEQ ID NO: 17325 - RNA, 21 nt, Artificial Sequence
  RNA Oligomer
cugcuuagaacccuucugcuu

SEQ ID NO: 17326 - RNA, 21 nt, Artificial Sequence
  RNA Oligomer
acaccuggccaggauuugguu

SEQ ID NO: 17327 - RNA, 21 nt, Artificial Sequence
  RNA Oligomer
ucccugcuuaucugaaacuuc

SEQ ID NO: 17328 - RNA, 21 nt, Artificial Sequence
  RNA Oligomer
uagaaaccuuuaucccugcuu

SEQ ID NO: 17329 - RNA, 21 nt, Artificial Sequence
  RNA Oligomer
agccagaauguggaacuccuc

SEQ ID NO: 17330 - RNA, 21 nt, Artificial Sequence
  RNA Oligomer
gggcaguuucagccagaaugu

SEQ ID NO: 17331 - RNA, 21 nt, Artificial Sequence
  RNA Oligomer
gaagaaugguguguuucccua

SEQ ID NO: 17332 - RNA, 21 nt, Artificial Sequence
  RNA Oligomer
ugucugagagaccaucuccua

SEQ ID NO: 17333 - RNA, 21 nt, Artificial Sequence
  RNA Oligomer
uggcacuuuagugauugcuuu

SEQ ID NO: 17334 - RNA, 21 nt, Artificial Sequence
  RNA Oligomer
ccagcuuuuguagauggcacu

SEQ ID NO: 17335 - RNA, 21 nt, Artificial Sequence
  RNA Oligomer
caguuccagcuuuuguagaug

SEQ ID NO: 17336 - RNA, 21 nt, Artificial Sequence
  RNA Oligomer
gaccuauugccaggaauguuu

SEQ ID NO: 17337 - RNA, 21 nt, Artificial Sequence
  RNA Oligomer
gagccuuugaucuucaggaug

SEQ ID NO: 17338 - RNA, 21 nt, Artificial Sequence
  RNA Oligomer
gguuaugcuccuggcacagaa

SEQ ID NO: 17339 - RNA, 21 nt, Artificial Sequence
  RNA Oligomer
gaggcucuugcucaaguguuu

SEQ ID NO: 17340 - RNA, 21 nt, Artificial Sequence
  RNA Oligomer
gguaaagaaaaguugccgaag

SEQ ID NO: 17341 - RNA, 21 nt, Artificial Sequence
  RNA Oligomer
ggguugaccaacaagauggaa

SEQ ID NO: 17342 - RNA, 21 nt, Artificial Sequence
  RNA Oligomer
aaccgaguggugcuagccaaa

SEQ ID NO: 17343 - RNA, 21 nt, Artificial Sequence
  RNA Oligomer
ugcacaggaaaugcaagagaa

SEQ ID NO: 17344 - RNA, 21 nt, Artificial Sequence
  RNA Oligomer
caguacucuagucacccucuu

SEQ ID NO: 17345 - RNA, 21 nt, Artificial Sequence
  RNA Oligomer
acaguacucuagucacccucu

SEQ ID NO: 17346 - RNA, 21 nt, Artificial Sequence
  RNA Oligomer
cacaguacucuagucacccuc

SEQ ID NO: 17347 - RNA, 21 nt, Artificial Sequence
  RNA Oligomer
ggaccacaguacucuagucac

SEQ ID NO: 17348 - RNA, 21 nt, Artificial Sequence
  RNA Oligomer
ccugaauuuuaucaaacacac

SEQ ID NO: 17349 - RNA, 21 nt, Artificial Sequence
  RNA Oligomer
cgggugccaaauaaaugcuca

SEQ ID NO: 17350 - RNA, 21 nt, Artificial Sequence
  RNA Oligomer
ugccuuugggucgacauagua

SEQ ID NO: 17351 - RNA, 21 nt, Artificial Sequence
  RNA Oligomer
agcaaaaugcuaggccuguag

SEQ ID NO: 17352 - RNA, 21 nt, Artificial Sequence
  RNA Oligomer
gagggcagaaaccuuguuugu

SEQ ID NO: 17353 - RNA, 21 nt, Artificial Sequence
  RNA Oligomer
ccucaacuugcugccuaagag

SEQ ID NO: 17354 - RNA, 21 nt, Artificial Sequence
  RNA Oligomer
gguuuaugagaacugguucuu

SEQ ID NO: 17355 - RNA, 21 nt, Artificial Sequence
  RNA Oligomer
aucccugcuuaucugaaacuu

SEQ ID NO: 17356 - RNA, 21 nt, Artificial Sequence
  RNA Oligomer
gccagaauguggaacuccuca

SEQ ID NO: 17357 - RNA, 21 nt, Artificial Sequence
  RNA Oligomer
ugcuuuacaggaucauguaaa

SEQ ID NO: 17358 - RNA, 21 nt, Artificial Sequence
  RNA Oligomer
gcuuccuagcuuaucucccug

SEQ ID NO: 17359 - RNA, 21 nt, Artificial Sequence
  RNA Oligomer
uagaaaagcuuccuagcuuau

SEQ ID NO: 17360 - RNA, 21 nt, Artificial Sequence
  RNA Oligomer
cuagaaaagcuuccuagcuua

SEQ ID NO: 17361 - RNA, 21 nt, Artificial Sequence
  RNA Oligomer
caccuuggaaaugagggagcu

SEQ ID NO: 17362 - RNA, 21 nt, Artificial Sequence
  RNA Oligomer
ggaagaaugguguguuucccu

SEQ ID NO: 17363 - RNA, 21 nt, Artificial Sequence
  RNA Oligomer
gaucuuucguugguuguuucu

SEQ ID NO: 17364 - RNA, 21 nt, Artificial Sequence
  RNA Oligomer
aguuuggaagguguccaaauu

SEQ ID NO: 17365 - RNA, 21 nt, Artificial Sequence
  RNA Oligomer
uccgcccuuuuuguccuagag

SEQ ID NO: 17366 - RNA, 21 nt, Artificial Sequence
  RNA Oligomer
gagaccaucuccuaucuuuua

SEQ ID NO: 17367 - RNA, 21 nt, Artificial Sequence
  RNA Oligomer
gcacuuuagugauugcuuuua

SEQ ID NO: 17368 - RNA, 21 nt, Artificial Sequence
  RNA Oligomer
uguagauggcacuuuagugau

SEQ ID NO: 17369 - RNA, 21 nt, Artificial Sequence
  RNA Oligomer
guuggaccuauugccaggaau

SEQ ID NO: 17370 - RNA, 21 nt, Artificial Sequence
  RNA Oligomer
gcgaauuguuagaacaucuuc

SEQ ID NO: 17371 - RNA, 21 nt, Artificial Sequence
  RNA Oligomer
ugugcccaucaucucugccuu

SEQ ID NO: 17372 - RNA, 21 nt, Artificial Sequence
  RNA Oligomer
ugauaugcacguggccgacau

SEQ ID NO: 17373 - RNA, 21 nt, Artificial Sequence
  RNA Oligomer
ggaacaccaaacgagguuccu

SEQ ID NO: 17374 - RNA, 21 nt, Artificial Sequence
  RNA Oligomer
ccgguaaagaaaaguugccga

SEQ ID NO: 17375 - RNA, 21 nt, Artificial Sequence
  RNA Oligomer
gagaaacugcagaauuuugca

SEQ ID NO: 17376 - RNA, 21 nt, Artificial Sequence
  RNA Oligomer
ccauguucuaugugaccagac

SEQ ID NO: 17377 - RNA, 21 nt, Artificial Sequence
  RNA Oligomer
gcacuucacuggagagaaaga

SEQ ID NO: 17378 - RNA, 21 nt, Artificial Sequence
  RNA Oligomer
cucaucaucaggaaacucuaa

SEQ ID NO: 17379 - RNA, 21 nt, Artificial Sequence
  RNA Oligomer
ugaagccuugcacuccugaau

SEQ ID NO: 17380 - RNA, 21 nt, Artificial Sequence
  RNA Oligomer
uccugccuuugggucgacaua

SEQ ID NO: 17381 - RNA, 21 nt, Artificial Sequence
  RNA Oligomer
cccuagcaaaaugcuaggccu

SEQ ID NO: 17382 - RNA, 21 nt, Artificial Sequence
  RNA Oligomer
ggcauuuuuagcuccuugaag

SEQ ID NO: 17383 - RNA, 21 nt, Artificial Sequence
  RNA Oligomer
guguuuugcuuuuauccacug

SEQ ID NO: 17384 - RNA, 21 nt, Artificial Sequence
  RNA Oligomer
ccaaccuuagcuacaauccua

SEQ ID NO: 17385 - RNA, 21 nt, Artificial Sequence
  RNA Oligomer
agggcagaaaccuuguuuguu

SEQ ID NO: 17386 - RNA, 21 nt, Artificial Sequence
  RNA Oligomer
ugagggcagaaaccuuguuug

SEQ ID NO: 17387 - RNA, 21 nt, Artificial Sequence
  RNA Oligomer
guaaaugagggcagaaaccuu

SEQ ID NO: 17388 - RNA, 21 nt, Artificial Sequence
  RNA Oligomer
ccaagcuuuugaugccuucug

SEQ ID NO: 17389 - RNA, 21 nt, Artificial Sequence
  RNA Oligomer
agcuucuaauuuugugcucuu

SEQ ID NO: 17390 - RNA, 21 nt, Artificial Sequence
  RNA Oligomer
uccucucagcuucuaauuuug

SEQ ID NO: 17391 - RNA, 21 nt, Artificial Sequence
  RNA Oligomer
uggccaggauuugguuguuua

SEQ ID NO: 17392 - RNA, 21 nt, Artificial Sequence
  RNA Oligomer
cucacauaacagaguaguuuu

SEQ ID NO: 17393 - RNA, 21 nt, Artificial Sequence
  RNA Oligomer
ccuccagucuguucucacaua

SEQ ID NO: 17394 - RNA, 21 nt, Artificial Sequence
  RNA Oligomer
aguuucagccagaauguggaa

SEQ ID NO: 17395 - RNA, 21 nt, Artificial Sequence
  RNA Oligomer
cugcuuuacaggaucauguaa

SEQ ID NO: 17396 - RNA, 21 nt, Artificial Sequence
  RNA Oligomer
auggcacuuuagugauugcuu

SEQ ID NO: 17397 - RNA, 21 nt, Artificial Sequence
  RNA Oligomer
ccuugguuggaccuauugcca

SEQ ID NO: 17398 - RNA, 21 nt, Artificial Sequence
  RNA Oligomer
gguuaaggugaacgcacuuau

SEQ ID NO: 17399 - RNA, 21 nt, Artificial Sequence
  RNA Oligomer
cucuugcucaaguguuuucug

SEQ ID NO: 17400 - RNA, 21 nt, Artificial Sequence
  RNA Oligomer
caagauggaaagaaccacgca

SEQ ID NO: 17401 - RNA, 21 nt, Artificial Sequence
  RNA Oligomer
gaccaacaagauggaaagaac

SEQ ID NO: 17402 - RNA, 21 nt, Artificial Sequence
  RNA Oligomer
augcaagagaaacugcagaau

SEQ ID NO: 17403 - RNA, 21 nt, Artificial Sequence
  RNA Oligomer
cuaaaaaagaaccgaguggug

SEQ ID NO: 17404 - RNA, 21 nt, Artificial Sequence
  RNA Oligomer
gcacaggaaaugcaagagaaa

SEQ ID NO: 17405 - RNA, 21 nt, Artificial Sequence
  RNA Oligomer
ccacaguacucuagucacccu

SEQ ID NO: 17406 - RNA, 21 nt, Artificial Sequence
  RNA Oligomer
gaacuggaauuucgcucugga

SEQ ID NO: 17407 - RNA, 21 nt, Artificial Sequence
  RNA Oligomer
caaugugcacuucacuggaga

SEQ ID NO: 17408 - RNA, 21 nt, Artificial Sequence
  RNA Oligomer
ccuagcacugguguugagcaa

SEQ ID NO: 17409 - RNA, 21 nt, Artificial Sequence
  RNA Oligomer
augcauccucaucaucaggaa

SEQ ID NO: 17410 - RNA, 21 nt, Artificial Sequence
  RNA Oligomer
ucccacugccaggauuuugua

SEQ ID NO: 17411 - RNA, 21 nt, Artificial Sequence
  RNA Oligomer
gccuuugggucgacauaguau

SEQ ID NO: 17412 - RNA, 21 nt, Artificial Sequence
  RNA Oligomer
ccuguaguagucaaggugcuc

SEQ ID NO: 17413 - RNA, 21 nt, Artificial Sequence
  RNA Oligomer
ucccauggucccuagcaaaau

SEQ ID NO: 17414 - RNA, 21 nt, Artificial Sequence
  RNA Oligomer
uguguuuugcuuuuauccacu

SEQ ID NO: 17415 - RNA, 21 nt, Artificial Sequence
  RNA Oligomer
cccuaccaggcuguaaaugag

SEQ ID NO: 17416 - RNA, 21 nt, Artificial Sequence
  RNA Oligomer
cuucagucccugagcagucua

SEQ ID NO: 17417 - RNA, 21 nt, Artificial Sequence
  RNA Oligomer
uggucuccucucagcuucuaa

SEQ ID NO: 17418 - RNA, 21 nt, Artificial Sequence
  RNA Oligomer
ccaggauuugguuguuuaaau

SEQ ID NO: 17419 - RNA, 21 nt, Artificial Sequence
  RNA Oligomer
cuggccaggauuugguuguuu

SEQ ID NO: 17420 - RNA, 21 nt, Artificial Sequence
  RNA Oligomer
uucucacauaacagaguaguu

SEQ ID NO: 17421 - RNA, 21 nt, Artificial Sequence
  RNA Oligomer
agugggcaguuucagccagaa

SEQ ID NO: 17422 - RNA, 21 nt, Artificial Sequence
  RNA Oligomer
cucugagcuuuguuacugaaa

SEQ ID NO: 17423 - RNA, 21 nt, Artificial Sequence
  RNA Oligomer
uuggaagguguccaaauuuaa

SEQ ID NO: 17424 - RNA, 21 nt, Artificial Sequence
  RNA Oligomer
guuuggaagguguccaaauuu

SEQ ID NO: 17425 - RNA, 21 nt, Artificial Sequence
  RNA Oligomer
cccuuuuuguccuagagugag

SEQ ID NO: 17426 - RNA, 21 nt, Artificial Sequence
  RNA Oligomer
gagagaccaucuccuaucuuu

SEQ ID NO: 17427 - RNA, 21 nt, Artificial Sequence
  RNA Oligomer
ccagcuccuuuucugugaagc

SEQ ID NO: 17428 - RNA, 21 nt, Artificial Sequence
  RNA Oligomer
cccaucaucucugccuuugag

SEQ ID NO: 17429 - RNA, 21 nt, Artificial Sequence
  RNA Oligomer
acagaauuccaccggugcaag

SEQ ID NO: 17430 - RNA, 21 nt, Artificial Sequence
  RNA Oligomer
cacagaauuccaccggugcaa

SEQ ID NO: 17431 - RNA, 21 nt, Artificial Sequence
  RNA Oligomer
ugguuaaggugaacgcacuua

SEQ ID NO: 17432 - RNA, 21 nt, Artificial Sequence
  RNA Oligomer
cgaggcucuugcucaaguguu

SEQ ID NO: 17433 - RNA, 21 nt, Artificial Sequence
  RNA Oligomer
acaccaaacgagguuccuggu

SEQ ID NO: 17434 - RNA, 21 nt, Artificial Sequence
  RNA Oligomer
ugcggaacaccaaacgagguu

SEQ ID NO: 17435 - RNA, 21 nt, Artificial Sequence
  RNA Oligomer
uggaccacaguacucuaguca

SEQ ID NO: 17436 - RNA, 21 nt, Artificial Sequence
  RNA Oligomer
cacuucacuggagagaaagaa

SEQ ID NO: 17437 - RNA, 21 nt, Artificial Sequence
  RNA Oligomer
guguugagcaaugugcacuuc

SEQ ID NO: 17438 - RNA, 21 nt, Artificial Sequence
  RNA Oligomer
gcacugguguugagcaaugug

SEQ ID NO: 17439 - RNA, 21 nt, Artificial Sequence
  RNA Oligomer
gcauccucaucaucaggaaac

SEQ ID NO: 17440 - RNA, 21 nt, Artificial Sequence
  RNA Oligomer
gcaugcauccucaucaucagg

SEQ ID NO: 17441 - RNA, 21 nt, Artificial Sequence
  RNA Oligomer
gccaucgggugccaaauaaau

SEQ ID NO: 17442 - RNA, 21 nt, Artificial Sequence
  RNA Oligomer
ggaagaaggcaagccaaccuu

SEQ ID NO: 17443 - RNA, 21 nt, Artificial Sequence
  RNA Oligomer
agagggaagaaggcaagccaa

SEQ ID NO: 17444 - RNA, 21 nt, Artificial Sequence
  RNA Oligomer
cccucauugcauuuauugcag

SEQ ID NO: 17445 - RNA, 21 nt, Artificial Sequence
  RNA Oligomer
cugagcagucuacuucugugu

SEQ ID NO: 17446 - RNA, 21 nt, Artificial Sequence
  RNA Oligomer
cccugagcagucuacuucugu

SEQ ID NO: 17447 - RNA, 21 nt, Artificial Sequence
  RNA Oligomer
caagcuuuugaugccuucugu

SEQ ID NO: 17448 - RNA, 21 nt, Artificial Sequence
  RNA Oligomer
uccuucuuccucaagucuuga

SEQ ID NO: 17449 - RNA, 21 nt, Artificial Sequence
  RNA Oligomer
guggucuccucucagcuucua

SEQ ID NO: 17450 - RNA, 21 nt, Artificial Sequence
  RNA Oligomer
ugagaacugguucuugccuuc

SEQ ID NO: 17451 - RNA, 21 nt, Artificial Sequence
  RNA Oligomer
uuagaacccuucugcuuucua

SEQ ID NO: 17452 - RNA, 21 nt, Artificial Sequence
  RNA Oligomer
ccugcuuaucugaaacuuccc

SEQ ID NO: 17453 - RNA, 21 nt, Artificial Sequence
  RNA Oligomer
aauaagguacaaaugcaaggc

SEQ ID NO: 17454 - RNA, 21 nt, Artificial Sequence
  RNA Oligomer
aagggagagauaugaagcagg

SEQ ID NO: 17455 - RNA, 21 nt, Artificial Sequence
  RNA Oligomer
agggagagauaugaagcaggg

SEQ ID NO: 17456 - RNA, 21 nt, Artificial Sequence
  RNA Oligomer
aaagccacauaauaucaaagg

SEQ ID NO: 17457 - RNA, 21 nt, Artificial Sequence
  RNA Oligomer
auaagguacaaaugcaaggca

SEQ ID NO: 17458 - RNA, 21 nt, Artificial Sequence
  RNA Oligomer
aaauacuuccauacuaugucg

SEQ ID NO: 17459 - RNA, 21 nt, Artificial Sequence
  RNA Oligomer
aaaaugccaguggauaaaagc

SEQ ID NO: 17460 - RNA, 21 nt, Artificial Sequence
  RNA Oligomer
uaugaagugcagguugauuga

SEQ ID NO: 17461 - RNA, 21 nt, Artificial Sequence
  RNA Oligomer
aauaaaagauaggagaugguc

SEQ ID NO: 17462 - RNA, 21 nt, Artificial Sequence
  RNA Oligomer
aaaauucaggagugcaaggcu

SEQ ID NO: 17463 - RNA, 21 nt, Artificial Sequence
  RNA Oligomer
aagccacauaauaucaaagga

SEQ ID NO: 17464 - RNA, 21 nt, Artificial Sequence
  RNA Oligomer
agaaaucuagauaugaagugc

SEQ ID NO: 17465 - RNA, 21 nt, Artificial Sequence
  RNA Oligomer
auuuccaaggugaugaugucc

SEQ ID NO: 17466 - RNA, 21 nt, Artificial Sequence
  RNA Oligomer
aaaauucugcaguuucucuug

SEQ ID NO: 17467 - RNA, 21 nt, Artificial Sequence
  RNA Oligomer
uaaaauucaggagugcaaggc

SEQ ID NO: 17468 - RNA, 21 nt, Artificial Sequence
  RNA Oligomer
aacaaacauuuaaugaaggcc

SEQ ID NO: 17469 - RNA, 21 nt, Artificial Sequence
  RNA Oligomer
aggugguuacagagucuaggg

SEQ ID NO: 17470 - RNA, 21 nt, Artificial Sequence
  RNA Oligomer
gaaauaaaagauaggagaugg

SEQ ID NO: 17471 - RNA, 21 nt, Artificial Sequence
  RNA Oligomer
uuacaacuucacuugucaggc

SEQ ID NO: 17472 - RNA, 21 nt, Artificial Sequence
  RNA Oligomer
auaaaauucaggagugcaagg

SEQ ID NO: 17473 - RNA, 21 nt, Artificial Sequence
  RNA Oligomer
acacauggaaaaacaaaguac

SEQ ID NO: 17474 - RNA, 21 nt, Artificial Sequence
  RNA Oligomer
agaaaucaccauuuaaugagg

SEQ ID NO: 17475 - RNA, 21 nt, Artificial Sequence
  RNA Oligomer
aaaucuagauaugaagugcag

SEQ ID NO: 17476 - RNA, 21 nt, Artificial Sequence
  RNA Oligomer
aaucuagauaugaagugcagg

SEQ ID NO: 17477 - RNA, 21 nt, Artificial Sequence
  RNA Oligomer
augggcaaagaucaauaaggu

SEQ ID NO: 17478 - RNA, 21 nt, Artificial Sequence
  RNA Oligomer
ucaaaggcagagaugaugggc

SEQ ID NO: 17479 - RNA, 21 nt, Artificial Sequence
  RNA Oligomer
uucccgauccuugauaagugc

SEQ ID NO: 17480 - RNA, 21 nt, Artificial Sequence
  RNA Oligomer
acuacaggccuagcauuuugc

SEQ ID NO: 17481 - RNA, 21 nt, Artificial Sequence
  RNA Oligomer
gauaaaagcaaaacacaugga

SEQ ID NO: 17482 - RNA, 21 nt, Artificial Sequence
  RNA Oligomer
aucaaaagguaggauuguagc

SEQ ID NO: 17483 - RNA, 21 nt, Artificial Sequence
  RNA Oligomer
acaaacauuuaaugaaggccc

SEQ ID NO: 17484 - RNA, 21 nt, Artificial Sequence
  RNA Oligomer
uugaggaagaaggacaccacc

SEQ ID NO: 17485 - RNA, 21 nt, Artificial Sequence
  RNA Oligomer
uuaggcagcaaguugaggagu

SEQ ID NO: 17486 - RNA, 21 nt, Artificial Sequence
  RNA Oligomer
agccacauaauaucaaaggag

SEQ ID NO: 17487 - RNA, 21 nt, Artificial Sequence
  RNA Oligomer
cuuugagcauuuacaugaucc

SEQ ID NO: 17488 - RNA, 21 nt, Artificial Sequence
  RNA Oligomer
agaucaauaagguacaaaugc

SEQ ID NO: 17489 - RNA, 21 nt, Artificial Sequence
  RNA Oligomer
ucaauaagguacaaaugcaag

SEQ ID NO: 17490 - RNA, 21 nt, Artificial Sequence
  RNA Oligomer
uucagagccaaaagauaaugu

SEQ ID NO: 17491 - RNA, 21 nt, Artificial Sequence
  RNA Oligomer
uaaagugccaucuacaaaagc

SEQ ID NO: 17492 - RNA, 21 nt, Artificial Sequence
  RNA Oligomer
aacaauucgcucaacaacagc

SEQ ID NO: 17493 - RNA, 21 nt, Artificial Sequence
  RNA Oligomer
uagaacauggacgucauagcc

SEQ ID NO: 17494 - RNA, 21 nt, Artificial Sequence
  RNA Oligomer
aaaugccaguggauaaaagca

SEQ ID NO: 17495 - RNA, 21 nt, Artificial Sequence
  RNA Oligomer
ggauaaaagcaaaacacaugg

SEQ ID NO: 17496 - RNA, 21 nt, Artificial Sequence
  RNA Oligomer
caacaaacauuuaaugaaggc

SEQ ID NO: 17497 - RNA, 21 nt, Artificial Sequence
  RNA Oligomer
uugagcauuuacaugauccug

SEQ ID NO: 17498 - RNA, 21 nt, Artificial Sequence
  RNA Oligomer
aagugcagguugauugaauga

SEQ ID NO: 17499 - RNA, 21 nt, Artificial Sequence
  RNA Oligomer
caauaagguacaaaugcaagg

SEQ ID NO: 17500 - RNA, 21 nt, Artificial Sequence
  RNA Oligomer
cugcagcugaaacauuccugg

SEQ ID NO: 17501 - RNA, 21 nt, Artificial Sequence
  RNA Oligomer
ugcagcugaaacauuccuggc

SEQ ID NO: 17502 - RNA, 21 nt, Artificial Sequence
  RNA Oligomer
acacacucccaauauccugcg

SEQ ID NO: 17503 - RNA, 21 nt, Artificial Sequence
  RNA Oligomer
auggcaauacaaaauccuggc

SEQ ID NO: 17504 - RNA, 21 nt, Artificial Sequence
  RNA Oligomer
aauacuuccauacuaugucga

SEQ ID NO: 17505 - RNA, 21 nt, Artificial Sequence
  RNA Oligomer
auacuuccauacuaugucgac

SEQ ID NO: 17506 - RNA, 21 nt, Artificial Sequence
  RNA Oligomer
ucuucaaggagcuaaaaaugc

SEQ ID NO: 17507 - RNA, 21 nt, Artificial Sequence
  RNA Oligomer
aagguaggauuguagcuaagg

SEQ ID NO: 17508 - RNA, 21 nt, Artificial Sequence
  RNA Oligomer
uggugaauaaaacaaacaagg

SEQ ID NO: 17509 - RNA, 21 nt, Artificial Sequence
  RNA Oligomer
ccauuuaaugagguucaaggg

SEQ ID NO: 17510 - RNA, 21 nt, Artificial Sequence
  RNA Oligomer
uguauggcacugaaauaaaag

SEQ ID NO: 17511 - RNA, 21 nt, Artificial Sequence
  RNA Oligomer
uuugagcauuuacaugauccu

SEQ ID NO: 17512 - RNA, 21 nt, Artificial Sequence
  RNA Oligomer
gaaaucuagauaugaagugca

SEQ ID NO: 17513 - RNA, 21 nt, Artificial Sequence
  RNA Oligomer
auaugaagugcagguugauug

SEQ ID NO: 17514 - RNA, 21 nt, Artificial Sequence
  RNA Oligomer
agguugauugaaugaaagugg

SEQ ID NO: 17515 - RNA, 21 nt, Artificial Sequence
  RNA Oligomer
agaggugguuacagagucuag

SEQ ID NO: 17516 - RNA, 21 nt, Artificial Sequence
  RNA Oligomer
ucucuagucauguuugcuucu

SEQ ID NO: 17517 - RNA, 21 nt, Artificial Sequence
  RNA Oligomer
uagucauguuugcuucuucag

SEQ ID NO: 17518 - RNA, 21 nt, Artificial Sequence
  RNA Oligomer
uaggacaaaaagggcggagga

SEQ ID NO: 17519 - RNA, 21 nt, Artificial Sequence
  RNA Oligomer
ugccacacacucccaauaucc

SEQ ID NO: 17520 - RNA, 21 nt, Artificial Sequence
  RNA Oligomer
aagauguucuaacaauucgcu

SEQ ID NO: 17521 - RNA, 21 nt, Artificial Sequence
  RNA Oligomer
uucaccuuaaccagcaugucg

SEQ ID NO: 17522 - RNA, 21 nt, Artificial Sequence
  RNA Oligomer
uucucucucucaaauacuucc

SEQ ID NO: 17523 - RNA, 21 nt, Artificial Sequence
  RNA Oligomer
uacuacaggccuagcauuuug

SEQ ID NO: 17524 - RNA, 21 nt, Artificial Sequence
  RNA Oligomer
aaaaaugccaguggauaaaag

SEQ ID NO: 17525 - RNA, 21 nt, Artificial Sequence
  RNA Oligomer
aaagagcacaaaauuagaagc

SEQ ID NO: 17526 - RNA, 21 nt, Artificial Sequence
  RNA Oligomer
cuagauaugaagugcagguug

SEQ ID NO: 17527 - RNA, 21 nt, Artificial Sequence
  RNA Oligomer
aaagggcuucacagaaaagga

SEQ ID NO: 17528 - RNA, 21 nt, Artificial Sequence
  RNA Oligomer
aacuuuucuuuaccggcauca

SEQ ID NO: 17529 - RNA, 21 nt, Artificial Sequence
  RNA Oligomer
aauacaaaauccuggcagugg

SEQ ID NO: 17530 - RNA, 21 nt, Artificial Sequence
  RNA Oligomer
guucucucucucaaauacuuc

SEQ ID NO: 17531 - RNA, 21 nt, Artificial Sequence
  RNA Oligomer
acuuccauacuaugucgaccc

SEQ ID NO: 17532 - RNA, 21 nt, Artificial Sequence
  RNA Oligomer
uuuauugagcaccuugacuac

SEQ ID NO: 17533 - RNA, 21 nt, Artificial Sequence
  RNA Oligomer
auugagcaccuugacuacuac

SEQ ID NO: 17534 - RNA, 21 nt, Artificial Sequence
  RNA Oligomer
aaaagguaggauuguagcuaa

SEQ ID NO: 17535 - RNA, 21 nt, Artificial Sequence
  RNA Oligomer
aaacauuuaaugaaggcccac

SEQ ID NO: 17536 - RNA, 21 nt, Artificial Sequence
  RNA Oligomer
gagcuuagcaagaaaucacca

SEQ ID NO: 17537 - RNA, 21 nt, Artificial Sequence
  RNA Oligomer
ggguaauagaaagcagaaggg

SEQ ID NO: 17538 - RNA, 21 nt, Artificial Sequence
  RNA Oligomer
uaauagaaagcagaaggguuc

SEQ ID NO: 17539 - RNA, 21 nt, Artificial Sequence
  RNA Oligomer
gaaaacaauaacauguauggc

SEQ ID NO: 17540 - RNA, 21 nt, Artificial Sequence
  RNA Oligomer
uagauaugaagugcagguuga

SEQ ID NO: 17541 - RNA, 21 nt, Artificial Sequence
  RNA Oligomer
auugaaugaaagugggaauag

SEQ ID NO: 17542 - RNA, 21 nt, Artificial Sequence
  RNA Oligomer
aaggugcgucucuagucaugu

SEQ ID NO: 17543 - RNA, 21 nt, Artificial Sequence
  RNA Oligomer
gucucuagucauguuugcuuc

SEQ ID NO: 17544 - RNA, 21 nt, Artificial Sequence
  RNA Oligomer
ucuagucauguuugcuucuuc

SEQ ID NO: 17545 - RNA, 21 nt, Artificial Sequence
  RNA Oligomer
cagagccaaaagauaaugucu

SEQ ID NO: 17546 - RNA, 21 nt, Artificial Sequence
  RNA Oligomer
ucuaggacaaaaagggcggag

SEQ ID NO: 17547 - RNA, 21 nt, Artificial Sequence
  RNA Oligomer
ucucucagacaucuuaacuaa

SEQ ID NO: 17548 - RNA, 21 nt, Artificial Sequence
  RNA Oligomer
cagaacagaaaccgugcaucc

SEQ ID NO: 17549 - RNA, 21 nt, Artificial Sequence
  RNA Oligomer
auccuugauaagugcguucac

SEQ ID NO: 17550 - RNA, 21 nt, Artificial Sequence
  RNA Oligomer
uuuccugugcagucuggucac

SEQ ID NO: 17551 - RNA, 21 nt, Artificial Sequence
  RNA Oligomer
cacauggaaaaacaaaguaca

SEQ ID NO: 17552 - RNA, 21 nt, Artificial Sequence
  RNA Oligomer
ggugaauaaaacaaacaaggu

SEQ ID NO: 17553 - RNA, 21 nt, Artificial Sequence
  RNA Oligomer
cuugaggaagaaggacaccac

SEQ ID NO: 17554 - RNA, 21 nt, Artificial Sequence
  RNA Oligomer
acaaaauuagaagcugagagg

SEQ ID NO: 17555 - RNA, 21 nt, Artificial Sequence
  RNA Oligomer
aaacaauaacauguauggcac

SEQ ID NO: 17556 - RNA, 21 nt, Artificial Sequence
  RNA Oligomer
ucuuugagcauuuacaugauc

SEQ ID NO: 17557 - RNA, 21 nt, Artificial Sequence
  RNA Oligomer
ugaaagugggaauaguaaggg

SEQ ID NO: 17558 - RNA, 21 nt, Artificial Sequence
  RNA Oligomer
aacaaagcucagagaaacaac

SEQ ID NO: 17559 - RNA, 21 nt, Artificial Sequence
  RNA Oligomer
aagaucuuugagacuuccaug

SEQ ID NO: 17560 - RNA, 21 nt, Artificial Sequence
  RNA Oligomer
cuagucauguuugcuucuuca

SEQ ID NO: 17561 - RNA, 21 nt, Artificial Sequence
  RNA Oligomer
ucagagccaaaagauaauguc

SEQ ID NO: 17562 - RNA, 21 nt, Artificial Sequence
  RNA Oligomer
ucucacucuaggacaaaaagg

SEQ ID NO: 17563 - RNA, 21 nt, Artificial Sequence
  RNA Oligomer
cucagacaucuuaacuaaugu

SEQ ID NO: 17564 - RNA, 21 nt, Artificial Sequence
  RNA Oligomer
aagugccaucuacaaaagcug

SEQ ID NO: 17565 - RNA, 21 nt, Artificial Sequence
  RNA Oligomer
uuuacaacuucacuugucagg

SEQ ID NO: 17566 - RNA, 21 nt, Artificial Sequence
  RNA Oligomer
uacaacuucacuugucaggcu

SEQ ID NO: 17567 - RNA, 21 nt, Artificial Sequence
  RNA Oligomer
ugcaguauucagacaucuccu

SEQ ID NO: 17568 - RNA, 21 nt, Artificial Sequence
  RNA Oligomer
ucccgauccuugauaagugcg

SEQ ID NO: 17569 - RNA, 21 nt, Artificial Sequence
  RNA Oligomer
auuuuugguuuguucuguagg

SEQ ID NO: 17570 - RNA, 21 nt, Artificial Sequence
  RNA Oligomer
uuuuugguuuguucuguaggc

SEQ ID NO: 17571 - RNA, 21 nt, Artificial Sequence
  RNA Oligomer
cacacucccaauauccugcgu

SEQ ID NO: 17572 - RNA, 21 nt, Artificial Sequence
  RNA Oligomer
ucucucucucaaauacuucca

SEQ ID NO: 17573 - RNA, 21 nt, Artificial Sequence
  RNA Oligomer
uacuuccauacuaugucgacc

SEQ ID NO: 17574 - RNA, 21 nt, Artificial Sequence
  RNA Oligomer
aaagguaggauuguagcuaag

SEQ ID NO: 17575 - RNA, 21 nt, Artificial Sequence
  RNA Oligomer
caaacauuuaaugaaggccca

SEQ ID NO: 17576 - RNA, 21 nt, Artificial Sequence
  RNA Oligomer
aagcacuugguacaugauggu

SEQ ID NO: 17577 - RNA, 21 nt, Artificial Sequence
  RNA Oligomer
uaaaacaaacaagguuucugc

SEQ ID NO: 17578 - RNA, 21 nt, Artificial Sequence
  RNA Oligomer
gguaauagaaagcagaagggu

SEQ ID NO: 17579 - RNA, 21 nt, Artificial Sequence
  RNA Oligomer
uaaagcaggauucuagacaga

SEQ ID NO: 17580 - RNA, 21 nt, Artificial Sequence
  RNA Oligomer
aucuagauaugaagugcaggu

SEQ ID NO: 17581 - RNA, 21 nt, Artificial Sequence
  RNA Oligomer
agaucuuugagacuuccaugg

SEQ ID NO: 17582 - RNA, 21 nt, Artificial Sequence
  RNA Oligomer
uccaugggcaaagaucaauaa

SEQ ID NO: 17583 - RNA, 21 nt, Artificial Sequence
  RNA Oligomer
ugcgucucuagucauguuugc

SEQ ID NO: 17584 - RNA, 21 nt, Artificial Sequence
  RNA Oligomer
auaaccacacuguguuuacaa

SEQ ID NO: 17585 - RNA, 21 nt, Artificial Sequence
  RNA Oligomer
aaccacacuguguuuacaacu

SEQ ID NO: 17586 - RNA, 21 nt, Artificial Sequence
  RNA Oligomer
agauguucuaacaauucgcuc

SEQ ID NO: 17587 - RNA, 21 nt, Artificial Sequence
  RNA Oligomer
aaaccgugcauccugaagauc

SEQ ID NO: 17588 - RNA, 21 nt, Artificial Sequence
  RNA Oligomer
cugcaguauucagacaucucc

SEQ ID NO: 17589 - RNA, 21 nt, Artificial Sequence
  RNA Oligomer
uaacaauucgcucaacaacag

SEQ ID NO: 17590 - RNA, 21 nt, Artificial Sequence
  RNA Oligomer
acuuuucuuuaccggcaucac

SEQ ID NO: 17591 - RNA, 21 nt, Artificial Sequence
  RNA Oligomer
uuucuuuaccggcaucacucu

SEQ ID NO: 17592 - RNA, 21 nt, Artificial Sequence
  RNA Oligomer
uuuaccggcaucacucuccuc

SEQ ID NO: 17593 - RNA, 21 nt, Artificial Sequence
  RNA Oligomer
cugaugaugaggaugcaugcc

SEQ ID NO: 17594 - RNA, 21 nt, Artificial Sequence
  RNA Oligomer
cccgauggcaauacaaaaucc

SEQ ID NO: 17595 - RNA, 21 nt, Artificial Sequence
  RNA Oligomer
gauggcaauacaaaauccugg

SEQ ID NO: 17596 - RNA, 21 nt, Artificial Sequence
  RNA Oligomer
uggcaauacaaaauccuggca

SEQ ID NO: 17597 - RNA, 21 nt, Artificial Sequence
  RNA Oligomer
caauacaaaauccuggcagug

SEQ ID NO: 17598 - RNA, 21 nt, Artificial Sequence
  RNA Oligomer
uuccauacuaugucgacccaa

SEQ ID NO: 17599 - RNA, 21 nt, Artificial Sequence
  RNA Oligomer
uugagcaccuugacuacuaca

SEQ ID NO: 17600 - RNA, 21 nt, Artificial Sequence
  RNA Oligomer
ucaaaagguaggauuguagcu

SEQ ID NO: 17601 - RNA, 21 nt, Artificial Sequence
  RNA Oligomer
guaggauuguagcuaagguug

SEQ ID NO: 17602 - RNA, 21 nt, Artificial Sequence
  RNA Oligomer
uaaugaaggcccacuaugugc

SEQ ID NO: 17603 - RNA, 21 nt, Artificial Sequence
  RNA Oligomer
uuucugcccucauuuacagcc

SEQ ID NO: 17604 - RNA, 21 nt, Artificial Sequence
  RNA Oligomer
uucugcccucauuuacagccu

SEQ ID NO: 17605 - RNA, 21 nt, Artificial Sequence
  RNA Oligomer
aacuacauuacaucuuugagc

SEQ ID NO: 17606 - RNA, 21 nt, Artificial Sequence
  RNA Oligomer
guaaagcaggauucuagacag

SEQ ID NO: 17607 - RNA, 21 nt, Artificial Sequence
  RNA Oligomer
gguugauugaaugaaaguggg

SEQ ID NO: 17608 - RNA, 21 nt, Artificial Sequence
  RNA Oligomer
guugauugaaugaaaguggga

SEQ ID NO: 17609 - RNA, 21 nt, Artificial Sequence
  RNA Oligomer
aaagugggaauaguaagggag

SEQ ID NO: 17610 - RNA, 21 nt, Artificial Sequence
  RNA Oligomer
uucaguaacaaagcucagaga

SEQ ID NO: 17611 - RNA, 21 nt, Artificial Sequence
  RNA Oligomer
aaagugccaucuacaaaagcu

SEQ ID NO: 17612 - RNA, 21 nt, Artificial Sequence
  RNA Oligomer
cacacuguguuuacaacuuca

SEQ ID NO: 17613 - RNA, 21 nt, Artificial Sequence
  RNA Oligomer
acacuguguuuacaacuucac

SEQ ID NO: 17614 - RNA, 21 nt, Artificial Sequence
  RNA Oligomer
caaaggcucuaucacaccucc

SEQ ID NO: 17615 - RNA, 21 nt, Artificial Sequence
  RNA Oligomer
guucaccuuaaccagcauguc

SEQ ID NO: 17616 - RNA, 21 nt, Artificial Sequence
  RNA Oligomer
ugcauaucacaagcccgcuca

SEQ ID NO: 17617 - RNA, 21 nt, Artificial Sequence
  RNA Oligomer
cacacacucccaauauccugc

SEQ ID NO: 17618 - RNA, 21 nt, Artificial Sequence
  RNA Oligomer
uuuucuuuaccggcaucacuc

SEQ ID NO: 17619 - RNA, 21 nt, Artificial Sequence
  RNA Oligomer
acgaucagucucaucuccacg

SEQ ID NO: 17620 - RNA, 21 nt, Artificial Sequence
  RNA Oligomer
auuuccugugcagucugguca

SEQ ID NO: 17621 - RNA, 21 nt, Artificial Sequence
  RNA Oligomer
acacucccaauauccugcguc

SEQ ID NO: 17622 - RNA, 21 nt, Artificial Sequence
  RNA Oligomer
cuuccauacuaugucgaccca

SEQ ID NO: 17623 - RNA, 21 nt, Artificial Sequence
  RNA Oligomer
guuucugcccucauuuacagc

SEQ ID NO: 17624 - RNA, 21 nt, Artificial Sequence
  RNA Oligomer
gacuggaggaagaaagaaugg

SEQ ID NO: 17625 - RNA, 21 nt, Artificial Sequence
  RNA Oligomer
aggaacaaagaacuacauuac

SEQ ID NO: 17626 - RNA, 21 nt, Artificial Sequence
  RNA Oligomer
uagacagauuugguggcagca

SEQ ID NO: 17627 - RNA, 21 nt, Artificial Sequence
  RNA Oligomer
uuccuggccuucucugaugcu

SEQ ID NO: 17628 - RNA, 21 nt, Artificial Sequence
  RNA Oligomer
cauuucaguaacaaagcucag

SEQ ID NO: 17629 - RNA, 21 nt, Artificial Sequence
  RNA Oligomer
gugcgucucuagucauguuug

SEQ ID NO: 17630 - RNA, 21 nt, Artificial Sequence
  RNA Oligomer
cuucagagccaaaagauaaug

SEQ ID NO: 17631 - RNA, 21 nt, Artificial Sequence
  RNA Oligomer
cuaaagugccaucuacaaaag

SEQ ID NO: 17632 - RNA, 21 nt, Artificial Sequence
  RNA Oligomer
acaacuucacuugucaggcuc

SEQ ID NO: 17633 - RNA, 21 nt, Artificial Sequence
  RNA Oligomer
caacuucacuugucaggcucu

SEQ ID NO: 17634 - RNA, 21 nt, Artificial Sequence
  RNA Oligomer
aaccgugcauccugaagauca

SEQ ID NO: 17635 - RNA, 21 nt, Artificial Sequence
  RNA Oligomer
aaaggcucuaucacaccuccu

SEQ ID NO: 17636 - RNA, 21 nt, Artificial Sequence
  RNA Oligomer
aaccuucccgauccuugauaa

SEQ ID NO: 17637 - RNA, 21 nt, Artificial Sequence
  RNA Oligomer
uucuuuaccggcaucacucuc

SEQ ID NO: 17638 - RNA, 21 nt, Artificial Sequence
  RNA Oligomer
ucuuuaccggcaucacucucc

SEQ ID NO: 17639 - RNA, 21 nt, Artificial Sequence
  RNA Oligomer
uuucccauccacaccauagau

SEQ ID NO: 17640 - RNA, 21 nt, Artificial Sequence
  RNA Oligomer
uuugauaaaauucaggagugc

SEQ ID NO: 17641 - RNA, 21 nt, Artificial Sequence
  RNA Oligomer
uucuucccucuuuuauucaac

SEQ ID NO: 17642 - RNA, 21 nt, Artificial Sequence
  RNA Oligomer
uucacagaaggcaucaaaagc

SEQ ID NO: 17643 - RNA, 21 nt, Artificial Sequence
  RNA Oligomer
accaguucucauaaaccaagg

SEQ ID NO: 17644 - RNA, 21 nt, Artificial Sequence
  RNA Oligomer
caguucucauaaaccaaggug

SEQ ID NO: 17645 - RNA, 21 nt, Artificial Sequence
  RNA Oligomer
aaaccaaggugaagaguuuac

SEQ ID NO: 17646 - RNA, 21 nt, Artificial Sequence
  RNA Oligomer
aacagacuggaggaagaaaga

SEQ ID NO: 17647 - RNA, 21 nt, Artificial Sequence
  RNA Oligomer
aaagcaggaacaaagaacuac

SEQ ID NO: 17648 - RNA, 21 nt, Artificial Sequence
  RNA Oligomer
aagcaggaacaaagaacuaca

SEQ ID NO: 17649 - RNA, 21 nt, Artificial Sequence
  RNA Oligomer
gaacuacauuacaucuuugag

SEQ ID NO: 17650 - RNA, 21 nt, Artificial Sequence
  RNA Oligomer
acuacauuacaucuuugagca

SEQ ID NO: 17651 - RNA, 21 nt, Artificial Sequence
  RNA Oligomer
caggauucuagacagauuugg

SEQ ID NO: 17652 - RNA, 21 nt, Artificial Sequence
  RNA Oligomer
gaaagugggaauaguaaggga

SEQ ID NO: 17653 - RNA, 21 nt, Artificial Sequence
  RNA Oligomer
ucauuucaguaacaaagcuca

SEQ ID NO: 17654 - RNA, 21 nt, Artificial Sequence
  RNA Oligomer
aaacgagccaagaguguccuu

SEQ ID NO: 17655 - RNA, 21 nt, Artificial Sequence
  RNA Oligomer
aaaagggcggaggauaugaau

SEQ ID NO: 17656 - RNA, 21 nt, Artificial Sequence
  RNA Oligomer
acuucacuugucaggcucuuc

SEQ ID NO: 17657 - RNA, 21 nt, Artificial Sequence
  RNA Oligomer
gaucaaaggcucuaucacacc

SEQ ID NO: 17658 - RNA, 21 nt, Artificial Sequence
  RNA Oligomer
gauccuugauaagugcguuca

SEQ ID NO: 17659 - RNA, 21 nt, Artificial Sequence
  RNA Oligomer
aagcccgcucagaaaacacuu

SEQ ID NO: 17660 - RNA, 21 nt, Artificial Sequence
  RNA Oligomer
aaauuccaguucuuucucucc

SEQ ID NO: 17661 - RNA, 21 nt, Artificial Sequence
  RNA Oligomer
uugguacaugauggugaauaa

SEQ ID NO: 17662 - RNA, 21 nt, Artificial Sequence
  RNA Oligomer
ggaaaagacaagaugugguga

SEQ ID NO: 17663 - RNA, 21 nt, Artificial Sequence
  RNA Oligomer
agaaguagacugcucagggac

SEQ ID NO: 17664 - RNA, 21 nt, Artificial Sequence
  RNA Oligomer
aggaaagagcacaaaauuaga

SEQ ID NO: 17665 - RNA, 21 nt, Artificial Sequence
  RNA Oligomer
gaaagagcacaaaauuagaag

SEQ ID NO: 17666 - RNA, 21 nt, Artificial Sequence
  RNA Oligomer
guugggaaguuucagauaagc

SEQ ID NO: 17667 - RNA, 21 nt, Artificial Sequence
  RNA Oligomer
aaagcaggauucuagacagau

SEQ ID NO: 17668 - RNA, 21 nt, Artificial Sequence
  RNA Oligomer
augaaagugggaauaguaagg

SEQ ID NO: 17669 - RNA, 21 nt, Artificial Sequence
  RNA Oligomer
aagugggaauaguaagggaga

SEQ ID NO: 17670 - RNA, 21 nt, Artificial Sequence
  RNA Oligomer
cucauuucaguaacaaagcuc

SEQ ID NO: 17671 - RNA, 21 nt, Artificial Sequence
  RNA Oligomer
caaacgagccaagaguguccu

SEQ ID NO: 17672 - RNA, 21 nt, Artificial Sequence
  RNA Oligomer
aacgagccaagaguguccuuc

SEQ ID NO: 17673 - RNA, 21 nt, Artificial Sequence
  RNA Oligomer
aagggcggaggauaugaauga

SEQ ID NO: 17674 - RNA, 21 nt, Artificial Sequence
  RNA Oligomer
uucacuugucaggcucuucaa

SEQ ID NO: 17675 - RNA, 21 nt, Artificial Sequence
  RNA Oligomer
ucaaaggcucuaucacaccuc

SEQ ID NO: 17676 - RNA, 21 nt, Artificial Sequence
  RNA Oligomer
ucuucggcaacuuuucuuuac

SEQ ID NO: 17677 - RNA, 21 nt, Artificial Sequence
  RNA Oligomer
cuuuaccggcaucacucuccu

SEQ ID NO: 17678 - RNA, 21 nt, Artificial Sequence
  RNA Oligomer
cauuuuugguuuguucuguag

SEQ ID NO: 17679 - RNA, 21 nt, Artificial Sequence
  RNA Oligomer
auagaacauggacgucauagc

SEQ ID NO: 17680 - RNA, 21 nt, Artificial Sequence
  RNA Oligomer
aagguucucucucucaaauac

SEQ ID NO: 17681 - RNA, 21 nt, Artificial Sequence
  RNA Oligomer
uuauugagcaccuugacuacu

SEQ ID NO: 17682 - RNA, 21 nt, Artificial Sequence
  RNA Oligomer
uuuaaugaaggcccacuaugu

SEQ ID NO: 17683 - RNA, 21 nt, Artificial Sequence
  RNA Oligomer
uuaaugaaggcccacuaugug

SEQ ID NO: 17684 - RNA, 21 nt, Artificial Sequence
  RNA Oligomer
caagcacuugguacaugaugg

SEQ ID NO: 17685 - RNA, 21 nt, Artificial Sequence
  RNA Oligomer
ucugcccucauuuacagccug

SEQ ID NO: 17686 - RNA, 21 nt, Artificial Sequence
  RNA Oligomer
uaauacugaaagagaaagcag

SEQ ID NO: 17687 - RNA, 21 nt, Artificial Sequence
  RNA Oligomer
auguucuaacaauucgcucaa

SEQ ID NO: 17688 - RNA, 21 nt, Artificial Sequence
  RNA Oligomer
aucaaaggcucuaucacaccu

SEQ ID NO: 17689 - RNA, 21 nt, Artificial Sequence
  RNA Oligomer
cucucucaaauacuuccauac

SEQ ID NO: 17690 - RNA, 21 nt, Artificial Sequence
  RNA Oligomer
auuagaagcugagaggagacc

SEQ ID NO: 17691 - RNA, 21 nt, Artificial Sequence
  RNA Oligomer
gaaagcaggaacaaagaacua

SEQ ID NO: 17692 - RNA, 21 nt, Artificial Sequence
  RNA Oligomer
gaucuuugagacuuccauggg

SEQ ID NO: 17693 - RNA, 21 nt, Artificial Sequence
  RNA Oligomer
ucuacauuaaauuuggacacc

SEQ ID NO: 17694 - RNA, 21 nt, Artificial Sequence
  RNA Oligomer
caacugcagcugaaacauucc

SEQ ID NO: 17695 - RNA, 21 nt, Artificial Sequence
  RNA Oligomer
aggcucuaucacaccuccugu

SEQ ID NO: 17696 - RNA, 21 nt, Artificial Sequence
  RNA Oligomer
uuccaguucuuucucuccagu

SEQ ID NO: 17697 - RNA, 21 nt, Artificial Sequence
  RNA Oligomer
ccuucuucccucuuuuauuca

SEQ ID NO: 17698 - RNA, 21 nt, Artificial Sequence
  RNA Oligomer
uuacagagucuagggaaacac

SEQ ID NO: 17699 - RNA, 21 nt, Artificial Sequence
  RNA Oligomer
aaaagcaaucacuaaagugcc

SEQ ID NO: 17700 - RNA, 21 nt, Artificial Sequence
  RNA Oligomer
cuggaugaagaacauuuuugg

SEQ ID NO: 17701 - RNA, 21 nt, Artificial Sequence
  RNA Oligomer
aacaaccaaauccuggccagg

SEQ ID NO: 17702 - RNA, 21 nt, Artificial Sequence
  RNA Oligomer
auaagcagggauaaagguuuc

SEQ ID NO: 17703 - RNA, 21 nt, Artificial Sequence
  RNA Oligomer
uguuuacaacuucacuuguca

SEQ ID NO: 17704 - RNA, 21 nt, Artificial Sequence
  RNA Oligomer
guuuacaacuucacuugucag

SEQ ID NO: 17705 - RNA, 21 nt, Artificial Sequence
  RNA Oligomer
aauagguccaaccaaggcugg

SEQ ID NO: 17706 - RNA, 21 nt, Artificial Sequence
  RNA Oligomer
ugaaaaaccucuuggagcugg

SEQ ID NO: 17707 - RNA, 21 nt, Artificial Sequence
  RNA Oligomer
aguuucucuugcauuuccugu

SEQ ID NO: 17708 - RNA, 21 nt, Artificial Sequence
  RNA Oligomer
uuuuagaguuuccugaugaug

SEQ ID NO: 17709 - RNA, 21 nt, Artificial Sequence
  RNA Oligomer
guuugauaaaauucaggagug

SEQ ID NO: 17710 - RNA, 21 nt, Artificial Sequence
  RNA Oligomer
uugauaaaauucaggagugca

SEQ ID NO: 17711 - RNA, 21 nt, Artificial Sequence
  RNA Oligomer
auauuuauugagcaccuugac

SEQ ID NO: 17712 - RNA, 21 nt, Artificial Sequence
  RNA Oligomer
uacagagucuagggaaacaca

SEQ ID NO: 17713 - RNA, 21 nt, Artificial Sequence
  RNA Oligomer
aagaguguccuuccacugggu

SEQ ID NO: 17714 - RNA, 21 nt, Artificial Sequence
  RNA Oligomer
cuacauuaaauuuggacaccu

SEQ ID NO: 17715 - RNA, 21 nt, Artificial Sequence
  RNA Oligomer
acugcagcugaaacauuccug

SEQ ID NO: 17716 - RNA, 21 nt, Artificial Sequence
  RNA Oligomer
aauucgcucaacaacagcugu

SEQ ID NO: 17717 - RNA, 21 nt, Artificial Sequence
  RNA Oligomer
uucggcaacuuuucuuuaccg

SEQ ID NO: 17718 - RNA, 21 nt, Artificial Sequence
  RNA Oligomer
aaucaccauuuaaugagguuc

SEQ ID NO: 17719 - RNA, 21 nt, Artificial Sequence
  RNA Oligomer
uaagcagggauaaagguuucu

SEQ ID NO: 17720 - RNA, 21 nt, Artificial Sequence
  RNA Oligomer
agcagggauaaagguuucuag

SEQ ID NO: 17721 - RNA, 21 nt, Artificial Sequence
  RNA Oligomer
ucuuugagacuuccaugggca

SEQ ID NO: 17722 - RNA, 21 nt, Artificial Sequence
  RNA Oligomer
acauuaaauuuggacaccuuc

SEQ ID NO: 17723 - RNA, 21 nt, Artificial Sequence
  RNA Oligomer
aacugcagcugaaacauuccu

SEQ ID NO: 17724 - RNA, 21 nt, Artificial Sequence
  RNA Oligomer
cuucacagaaaaggagcuggc

SEQ ID NO: 17725 - RNA, 21 nt, Artificial Sequence
  RNA Oligomer
uuuugguuuguucuguaggcu

SEQ ID NO: 17726 - RNA, 21 nt, Artificial Sequence
  RNA Oligomer
uucuguaggcuugggcaguug

SEQ ID NO: 17727 - RNA, 21 nt, Artificial Sequence
  RNA Oligomer
guguuugauaaaauucaggag

SEQ ID NO: 17728 - RNA, 21 nt, Artificial Sequence
  RNA Oligomer
uuuccugaugaugaggaugca

SEQ ID NO: 17729 - RNA, 21 nt, Artificial Sequence
  RNA Oligomer
augugaaggaaguuaucucac

SEQ ID NO: 17730 - RNA, 21 nt, Artificial Sequence
  RNA Oligomer
aucaccauuuaaugagguuca

SEQ ID NO: 17731 - RNA, 21 nt, Artificial Sequence
  RNA Oligomer
auuuacaugauccuguaaagc

SEQ ID NO: 17732 - RNA, 21 nt, Artificial Sequence
  RNA Oligomer
gucuagggaaacacaccauuc

SEQ ID NO: 17733 - RNA, 21 nt, Artificial Sequence
  RNA Oligomer
caaagcucagagaaacaacca

SEQ ID NO: 17734 - RNA, 21 nt, Artificial Sequence
  RNA Oligomer
agcucagagaaacaaccaacg

SEQ ID NO: 17735 - RNA, 21 nt, Artificial Sequence
  RNA Oligomer
ucacucuaggacaaaaagggc

SEQ ID NO: 17736 - RNA, 21 nt, Artificial Sequence
  RNA Oligomer
gaaacaagucugggagauucc

SEQ ID NO: 17737 - RNA, 21 nt, Artificial Sequence
  RNA Oligomer
uugguuuguucuguaggcuug

SEQ ID NO: 17738 - RNA, 21 nt, Artificial Sequence
  RNA Oligomer
aaauucugcaguuucucuugc

SEQ ID NO: 17739 - RNA, 21 nt, Artificial Sequence
  RNA Oligomer
gaaauuccaguucuuucucuc

SEQ ID NO: 17740 - RNA, 21 nt, Artificial Sequence
  RNA Oligomer
auuccaguucuuucucuccag

SEQ ID NO: 17741 - RNA, 21 nt, Artificial Sequence
  RNA Oligomer
aaaacaaacaagguuucugcc

SEQ ID NO: 17742 - RNA, 21 nt, Artificial Sequence
  RNA Oligomer
aacugcaauaaaugcaaugag

SEQ ID NO: 17743 - RNA, 21 nt, Artificial Sequence
  RNA Oligomer
gacuugaggaagaaggacacc

SEQ ID NO: 17744 - RNA, 21 nt, Artificial Sequence
  RNA Oligomer
aauuagaagcugagaggagac

SEQ ID NO: 17745 - RNA, 21 nt, Artificial Sequence
  RNA Oligomer
gauucuagacagauuuggugg

SEQ ID NO: 17746 - RNA, 21 nt, Artificial Sequence
  RNA Oligomer
aagcucagagaaacaaccaac

SEQ ID NO: 17747 - RNA, 21 nt, Artificial Sequence
  RNA Oligomer
cacucuaggacaaaaagggcg

SEQ ID NO: 17748 - RNA, 21 nt, Artificial Sequence
  RNA Oligomer
aaaagauaggagauggucucu

SEQ ID NO: 17749 - RNA, 21 nt, Artificial Sequence
  RNA Oligomer
auggucucucagacaucuuaa

SEQ ID NO: 17750 - RNA, 21 nt, Artificial Sequence
  RNA Oligomer
aacauuccuggcaauaggucc

SEQ ID NO: 17751 - RNA, 21 nt, Artificial Sequence
  RNA Oligomer
auccugaagaucaaaggcucu

SEQ ID NO: 17752 - RNA, 21 nt, Artificial Sequence
  RNA Oligomer
auguaccaggaaccucguuug

SEQ ID NO: 17753 - RNA, 21 nt, Artificial Sequence
  RNA Oligomer
aacagcuguuuggcuagcacc

SEQ ID NO: 17754 - RNA, 21 nt, Artificial Sequence
  RNA Oligomer
ugguuuguucuguaggcuugg

SEQ ID NO: 17755 - RNA, 21 nt, Artificial Sequence
  RNA Oligomer
caguuggcguugucaaagagc

SEQ ID NO: 17756 - RNA, 21 nt, Artificial Sequence
  RNA Oligomer
ucgguucuuuuuuagaguuuc

SEQ ID NO: 17757 - RNA, 21 nt, Artificial Sequence
  RNA Oligomer
aauucaggagugcaaggcuuc

SEQ ID NO: 17758 - RNA, 21 nt, Artificial Sequence
  RNA Oligomer
augagcauuuauuuggcaccc

SEQ ID NO: 17759 - RNA, 21 nt, Artificial Sequence
  RNA Oligomer
aaggaaguuaucucacacaug

SEQ ID NO: 17760 - RNA, 21 nt, Artificial Sequence
  RNA Oligomer
ugacagacacagaaguagacu

SEQ ID NO: 17761 - RNA, 21 nt, Artificial Sequence
  RNA Oligomer
aaaauuagaagcugagaggag

SEQ ID NO: 17762 - RNA, 21 nt, Artificial Sequence
  RNA Oligomer
gagaguuuaauacugaaagag

SEQ ID NO: 17763 - RNA, 21 nt, Artificial Sequence
  RNA Oligomer
auucuagacagauuugguggc

SEQ ID NO: 17764 - RNA, 21 nt, Artificial Sequence
  RNA Oligomer
uucuagacagauuugguggca

SEQ ID NO: 17765 - RNA, 21 nt, Artificial Sequence
  RNA Oligomer
acucuaggacaaaaagggcgg

SEQ ID NO: 17766 - RNA, 21 nt, Artificial Sequence
  RNA Oligomer
auaaaagauaggagauggucu

SEQ ID NO: 17767 - RNA, 21 nt, Artificial Sequence
  RNA Oligomer
aagugcguucaccuuaaccag

SEQ ID NO: 17768 - RNA, 21 nt, Artificial Sequence
  RNA Oligomer
aaaacacuugagcaagagccu

SEQ ID NO: 17769 - RNA, 21 nt, Artificial Sequence
  RNA Oligomer
uguaccaggaaccucguuugg

SEQ ID NO: 17770 - RNA, 21 nt, Artificial Sequence
  RNA Oligomer
auagcccaaaagcuugaagag

SEQ ID NO: 17771 - RNA, 21 nt, Artificial Sequence
  RNA Oligomer
aauuccaguucuuucucucca

SEQ ID NO: 17772 - RNA, 21 nt, Artificial Sequence
  RNA Oligomer
uagaguuuccugaugaugagg

SEQ ID NO: 17773 - RNA, 21 nt, Artificial Sequence
  RNA Oligomer
gaugugaaggaaguuaucuca

SEQ ID NO: 17774 - RNA, 21 nt, Artificial Sequence
  RNA Oligomer
agacuugaggaagaaggacac

SEQ ID NO: 17775 - RNA, 21 nt, Artificial Sequence
  RNA Oligomer
aggaagaaggacaccaccuga

SEQ ID NO: 17776 - RNA, 21 nt, Artificial Sequence
  RNA Oligomer
gaaaucaccauuuaaugaggu

SEQ ID NO: 17777 - RNA, 21 nt, Artificial Sequence
  RNA Oligomer
cagcaaguugaggaguuccac

SEQ ID NO: 17778 - RNA, 21 nt, Artificial Sequence
  RNA Oligomer
uuaaacaaccaaauccuggcc

SEQ ID NO: 17779 - RNA, 21 nt, Artificial Sequence
  RNA Oligomer
uacucuguuaugugagaacag

SEQ ID NO: 17780 - RNA, 21 nt, Artificial Sequence
  RNA Oligomer
aaguugaggaguuccacauuc

SEQ ID NO: 17781 - RNA, 21 nt, Artificial Sequence
  RNA Oligomer
aaagguuucuagguugaaaac

SEQ ID NO: 17782 - RNA, 21 nt, Artificial Sequence
  RNA Oligomer
uacaugauccuguaaagcagg

SEQ ID NO: 17783 - RNA, 21 nt, Artificial Sequence
  RNA Oligomer
auucuggcugaaacugcccac

SEQ ID NO: 17784 - RNA, 21 nt, Artificial Sequence
  RNA Oligomer
gaaacaaccaacgaaagaucu

SEQ ID NO: 17785 - RNA, 21 nt, Artificial Sequence
  RNA Oligomer
gagccaaaagauaaugucuac

SEQ ID NO: 17786 - RNA, 21 nt, Artificial Sequence
  RNA Oligomer
acucaaaggcagagaugaugg

SEQ ID NO: 17787 - RNA, 21 nt, Artificial Sequence
  RNA Oligomer
caauucgcucaacaacagcug

SEQ ID NO: 17788 - RNA, 21 nt, Artificial Sequence
  RNA Oligomer
caacaacagcuguuuggcuag

SEQ ID NO: 17789 - RNA, 21 nt, Artificial Sequence
  RNA Oligomer
aacaacagcuguuuggcuagc

SEQ ID NO: 17790 - RNA, 21 nt, Artificial Sequence
  RNA Oligomer
uggaugaagaacauuuuuggu

SEQ ID NO: 17791 - RNA, 21 nt, Artificial Sequence
  RNA Oligomer
aauucugcaguuucucuugca

SEQ ID NO: 17792 - RNA, 21 nt, Artificial Sequence
  RNA Oligomer
guucuuuuuuagaguuuccug

SEQ ID NO: 17793 - RNA, 21 nt, Artificial Sequence
  RNA Oligomer
uauuuauugagcaccuugacu

SEQ ID NO: 17794 - RNA, 21 nt, Artificial Sequence
  RNA Oligomer
uaucaaaagguaggauuguag

SEQ ID NO: 17795 - RNA, 21 nt, Artificial Sequence
  RNA Oligomer
aauugucaagacuugaggaag

SEQ ID NO: 17796 - RNA, 21 nt, Artificial Sequence
  RNA Oligomer
agaaggcaucaaaagcuuggg

SEQ ID NO: 17797 - RNA, 21 nt, Artificial Sequence
  RNA Oligomer
aagaaggacaccaccugaguc

SEQ ID NO: 17798 - RNA, 21 nt, Artificial Sequence
  RNA Oligomer
aauagaaagcagaaggguucu

SEQ ID NO: 17799 - RNA, 21 nt, Artificial Sequence
  RNA Oligomer
aguugaggaguuccacauucu

SEQ ID NO: 17800 - RNA, 21 nt, Artificial Sequence
  RNA Oligomer
guugaggaguuccacauucug

SEQ ID NO: 17801 - RNA, 21 nt, Artificial Sequence
  RNA Oligomer
uugaggaguuccacauucugg

SEQ ID NO: 17802 - RNA, 21 nt, Artificial Sequence
  RNA Oligomer
auacugaaagagaaagcagga

SEQ ID NO: 17803 - RNA, 21 nt, Artificial Sequence
  RNA Oligomer
uaagguacaaaugcaaggcaa

SEQ ID NO: 17804 - RNA, 21 nt, Artificial Sequence
  RNA Oligomer
aagauaggagauggucucuca

SEQ ID NO: 17805 - RNA, 21 nt, Artificial Sequence
  RNA Oligomer
aaucacuaaagugccaucuac

SEQ ID NO: 17806 - RNA, 21 nt, Artificial Sequence
  RNA Oligomer
uuccuggcaauagguccaacc

SEQ ID NO: 17807 - RNA, 21 nt, Artificial Sequence
  RNA Oligomer
ugcauccugaagaucaaaggc

SEQ ID NO: 17808 - RNA, 21 nt, Artificial Sequence
  RNA Oligomer
auucugugccaggagcauaac

SEQ ID NO: 17809 - RNA, 21 nt, Artificial Sequence
  RNA Oligomer
uuugguuuguucuguaggcuu

SEQ ID NO: 17810 - RNA, 21 nt, Artificial Sequence
  RNA Oligomer
uaacugugcaaaauucugcag

SEQ ID NO: 17811 - RNA, 21 nt, Artificial Sequence
  RNA Oligomer
aacugugcaaaauucugcagu

SEQ ID NO: 17812 - RNA, 21 nt, Artificial Sequence
  RNA Oligomer
ugugcaaaauucugcaguuuc

SEQ ID NO: 17813 - RNA, 21 nt, Artificial Sequence
  RNA Oligomer
cgguucuuuuuuagaguuucc

SEQ ID NO: 17814 - RNA, 21 nt, Artificial Sequence
  RNA Oligomer
uagaguacugugguccacauc

SEQ ID NO: 17815 - RNA, 21 nt, Artificial Sequence
  RNA Oligomer
agaguacugugguccacaucc

SEQ ID NO: 17816 - RNA, 21 nt, Artificial Sequence
  RNA Oligomer
aagugcacauugcucaacacc

SEQ ID NO: 17817 - RNA, 21 nt, Artificial Sequence
  RNA Oligomer
uuuagaguuuccugaugauga

SEQ ID NO: 17818 - RNA, 21 nt, Artificial Sequence
  RNA Oligomer
auugcucaacaccagugcuag

SEQ ID NO: 17819 - RNA, 21 nt, Artificial Sequence
  RNA Oligomer
uaugagcauuuauuuggcacc

SEQ ID NO: 17820 - RNA, 21 nt, Artificial Sequence
  RNA Oligomer
caccuugacuacuacaggccu

SEQ ID NO: 17821 - RNA, 21 nt, Artificial Sequence
  RNA Oligomer
gugaaggaaguuaucucacac

SEQ ID NO: 17822 - RNA, 21 nt, Artificial Sequence
  RNA Oligomer
aaacaaacaagguuucugccc

SEQ ID NO: 17823 - RNA, 21 nt, Artificial Sequence
  RNA Oligomer
acugcaauaaaugcaaugagg

SEQ ID NO: 17824 - RNA, 21 nt, Artificial Sequence
  RNA Oligomer
cuuaggcagcaaguugaggag

SEQ ID NO: 17825 - RNA, 21 nt, Artificial Sequence
  RNA Oligomer
aagcagaaggguucuaagcag

SEQ ID NO: 17826 - RNA, 21 nt, Artificial Sequence
  RNA Oligomer
aaccaaauccuggccaggugu

SEQ ID NO: 17827 - RNA, 21 nt, Artificial Sequence
  RNA Oligomer
gaaguuucagauaagcaggga

SEQ ID NO: 17828 - RNA, 21 nt, Artificial Sequence
  RNA Oligomer
aagcagggauaaagguuucua

SEQ ID NO: 17829 - RNA, 21 nt, Artificial Sequence
  RNA Oligomer
gaggaguuccacauucuggcu

SEQ ID NO: 17830 - RNA, 21 nt, Artificial Sequence
  RNA Oligomer
acauucuggcugaaacugccc

SEQ ID NO: 17831 - RNA, 21 nt, Artificial Sequence
  RNA Oligomer
uagggaaacacaccauucuuc

SEQ ID NO: 17832 - RNA, 21 nt, Artificial Sequence
  RNA Oligomer
uaggagauggucucucagaca

SEQ ID NO: 17833 - RNA, 21 nt, Artificial Sequence
  RNA Oligomer
aaagcaaucacuaaagugcca

SEQ ID NO: 17834 - RNA, 21 nt, Artificial Sequence
  RNA Oligomer
agugccaucuacaaaagcugg

SEQ ID NO: 17835 - RNA, 21 nt, Artificial Sequence
  RNA Oligomer
caucuacaaaagcuggaacug

SEQ ID NO: 17836 - RNA, 21 nt, Artificial Sequence
  RNA Oligomer
aaacauuccuggcaauagguc

SEQ ID NO: 17837 - RNA, 21 nt, Artificial Sequence
  RNA Oligomer
cauccugaagaucaaaggcuc

SEQ ID NO: 17838 - RNA, 21 nt, Artificial Sequence
  RNA Oligomer
uucugugccaggagcauaacc

SEQ ID NO: 17839 - RNA, 21 nt, Artificial Sequence
  RNA Oligomer
aaacacuugagcaagagccuc

SEQ ID NO: 17840 - RNA, 21 nt, Artificial Sequence
  RNA Oligomer
cuucggcaacuuuucuuuacc

SEQ ID NO: 17841 - RNA, 21 nt, Artificial Sequence
  RNA Oligomer
uuccaucuuguuggucaaccc

SEQ ID NO: 17842 - RNA, 21 nt, Artificial Sequence
  RNA Oligomer
uuuggcuagcaccacucgguu

SEQ ID NO: 17843 - RNA, 21 nt, Artificial Sequence
  RNA Oligomer
uucucuugcauuuccugugca

SEQ ID NO: 17844 - RNA, 21 nt, Artificial Sequence
  RNA Oligomer
aagagggugacuagaguacug

SEQ ID NO: 17845 - RNA, 21 nt, Artificial Sequence
  RNA Oligomer
agagggugacuagaguacugu

SEQ ID NO: 17846 - RNA, 21 nt, Artificial Sequence
  RNA Oligomer
gagggugacuagaguacugug

SEQ ID NO: 17847 - RNA, 21 nt, Artificial Sequence
  RNA Oligomer
gugacuagaguacuguggucc

SEQ ID NO: 17848 - RNA, 21 nt, Artificial Sequence
  RNA Oligomer
guguguuugauaaaauucagg

SEQ ID NO: 17849 - RNA, 21 nt, Artificial Sequence
  RNA Oligomer
ugagcauuuauuuggcacccg

SEQ ID NO: 17850 - RNA, 21 nt, Artificial Sequence
  RNA Oligomer
uacuaugucgacccaaaggca

SEQ ID NO: 17851 - RNA, 21 nt, Artificial Sequence
  RNA Oligomer
cuacaggccuagcauuuugcu

SEQ ID NO: 17852 - RNA, 21 nt, Artificial Sequence
  RNA Oligomer
acaaacaagguuucugcccuc

SEQ ID NO: 17853 - RNA, 21 nt, Artificial Sequence
  RNA Oligomer
cucuuaggcagcaaguugagg

SEQ ID NO: 17854 - RNA, 21 nt, Artificial Sequence
  RNA Oligomer
aagaaccaguucucauaaacc

SEQ ID NO: 17855 - RNA, 21 nt, Artificial Sequence
  RNA Oligomer
aaguuucagauaagcagggau

SEQ ID NO: 17856 - RNA, 21 nt, Artificial Sequence
  RNA Oligomer
ugaggaguuccacauucuggc

SEQ ID NO: 17857 - RNA, 21 nt, Artificial Sequence
  RNA Oligomer
uuuacaugauccuguaaagca

SEQ ID NO: 17858 - RNA, 21 nt, Artificial Sequence
  RNA Oligomer
cagggagauaagcuaggaagc

SEQ ID NO: 17859 - RNA, 21 nt, Artificial Sequence
  RNA Oligomer
auaagcuaggaagcuuuucua

SEQ ID NO: 17860 - RNA, 21 nt, Artificial Sequence
  RNA Oligomer
uaagcuaggaagcuuuucuag

SEQ ID NO: 17861 - RNA, 21 nt, Artificial Sequence
  RNA Oligomer
agcucccucauuuccaaggug

SEQ ID NO: 17862 - RNA, 21 nt, Artificial Sequence
  RNA Oligomer
agggaaacacaccauucuucc

SEQ ID NO: 17863 - RNA, 21 nt, Artificial Sequence
  RNA Oligomer
agaaacaaccaacgaaagauc

SEQ ID NO: 17864 - RNA, 21 nt, Artificial Sequence
  RNA Oligomer
aauuuggacaccuuccaaacu

SEQ ID NO: 17865 - RNA, 21 nt, Artificial Sequence
  RNA Oligomer
cucuaggacaaaaagggcgga

SEQ ID NO: 17866 - RNA, 21 nt, Artificial Sequence
  RNA Oligomer
uaaaagauaggagauggucuc

SEQ ID NO: 17867 - RNA, 21 nt, Artificial Sequence
  RNA Oligomer
uaaaagcaaucacuaaagugc

SEQ ID NO: 17868 - RNA, 21 nt, Artificial Sequence
  RNA Oligomer
aucacuaaagugccaucuaca

SEQ ID NO: 17869 - RNA, 21 nt, Artificial Sequence
  RNA Oligomer
auuccuggcaauagguccaac

SEQ ID NO: 17870 - RNA, 21 nt, Artificial Sequence
  RNA Oligomer
gaagauguucuaacaauucgc

SEQ ID NO: 17871 - RNA, 21 nt, Artificial Sequence
  RNA Oligomer
aaggcagagaugaugggcaca

SEQ ID NO: 17872 - RNA, 21 nt, Artificial Sequence
  RNA Oligomer
augucggccacgugcauauca

SEQ ID NO: 17873 - RNA, 21 nt, Artificial Sequence
  RNA Oligomer
aggaaccucguuugguguucc

SEQ ID NO: 17874 - RNA, 21 nt, Artificial Sequence
  RNA Oligomer
ucggcaacuuuucuuuaccgg

SEQ ID NO: 17875 - RNA, 21 nt, Artificial Sequence
  RNA Oligomer
ugcaaaauucugcaguuucuc

SEQ ID NO: 17876 - RNA, 21 nt, Artificial Sequence
  RNA Oligomer
gucuggucacauagaacaugg

SEQ ID NO: 17877 - RNA, 21 nt, Artificial Sequence
  RNA Oligomer
ucuuucucuccagugaagugc

SEQ ID NO: 17878 - RNA, 21 nt, Artificial Sequence
  RNA Oligomer
uuagaguuuccugaugaugag

SEQ ID NO: 17879 - RNA, 21 nt, Artificial Sequence
  RNA Oligomer
auucaggagugcaaggcuuca

SEQ ID NO: 17880 - RNA, 21 nt, Artificial Sequence
  RNA Oligomer
uaugucgacccaaaggcagga

SEQ ID NO: 17881 - RNA, 21 nt, Artificial Sequence
  RNA Oligomer
aggccuagcauuuugcuaggg

SEQ ID NO: 17882 - RNA, 21 nt, Artificial Sequence
  RNA Oligomer
cuucaaggagcuaaaaaugcc

SEQ ID NO: 17883 - RNA, 21 nt, Artificial Sequence
  RNA Oligomer
caguggauaaaagcaaaacac

SEQ ID NO: 17884 - RNA, 21 nt, Artificial Sequence
  RNA Oligomer
uaggauuguagcuaagguugg

SEQ ID NO: 17885 - RNA, 21 nt, Artificial Sequence
  RNA Oligomer
aacaaacaagguuucugcccu

SEQ ID NO: 17886 - RNA, 21 nt, Artificial Sequence
  RNA Oligomer
caaacaagguuucugcccuca

SEQ ID NO: 17887 - RNA, 21 nt, Artificial Sequence
  RNA Oligomer
aagguuucugcccucauuuac

SEQ ID NO: 17888 - RNA, 21 nt, Artificial Sequence
  RNA Oligomer
cagaaggcaucaaaagcuugg

SEQ ID NO: 17889 - RNA, 21 nt, Artificial Sequence
  RNA Oligomer
aagagcacaaaauuagaagcu

SEQ ID NO: 17890 - RNA, 21 nt, Artificial Sequence
  RNA Oligomer
caaaauuagaagcugagagga

SEQ ID NO: 17891 - RNA, 21 nt, Artificial Sequence
  RNA Oligomer
uaaacaaccaaauccuggcca

SEQ ID NO: 17892 - RNA, 21 nt, Artificial Sequence
  RNA Oligomer
aaaacuacucuguuaugugag

SEQ ID NO: 17893 - RNA, 21 nt, Artificial Sequence
  RNA Oligomer
uaugugagaacagacuggagg

SEQ ID NO: 17894 - RNA, 21 nt, Artificial Sequence
  RNA Oligomer
uuccacauucuggcugaaacu

SEQ ID NO: 17895 - RNA, 21 nt, Artificial Sequence
  RNA Oligomer
uuacaugauccuguaaagcag

SEQ ID NO: 17896 - RNA, 21 nt, Artificial Sequence
  RNA Oligomer
aagcaaucacuaaagugccau

SEQ ID NO: 17897 - RNA, 21 nt, Artificial Sequence
  RNA Oligomer
uggcaauagguccaaccaagg

SEQ ID NO: 17898 - RNA, 21 nt, Artificial Sequence
  RNA Oligomer
auaagugcguucaccuuaacc

SEQ ID NO: 17899 - RNA, 21 nt, Artificial Sequence
  RNA Oligomer
cagaaaacacuugagcaagag

SEQ ID NO: 17900 - RNA, 21 nt, Artificial Sequence
  RNA Oligomer
ugcgugguucuuuccaucuug

SEQ ID NO: 17901 - RNA, 21 nt, Artificial Sequence
  RNA Oligomer
guucuuuccaucuuguugguc

SEQ ID NO: 17902 - RNA, 21 nt, Artificial Sequence
  RNA Oligomer
auucugcaguuucucuugcau

SEQ ID NO: 17903 - RNA, 21 nt, Artificial Sequence
  RNA Oligomer
caccacucgguucuuuuuuag

SEQ ID NO: 17904 - RNA, 21 nt, Artificial Sequence
  RNA Oligomer
uuucucuugcauuuccugugc

SEQ ID NO: 17905 - RNA, 21 nt, Artificial Sequence
  RNA Oligomer
agggugacuagaguacugugg

SEQ ID NO: 17906 - RNA, 21 nt, Artificial Sequence
  RNA Oligomer
uccagagcgaaauuccaguuc

SEQ ID NO: 17907 - RNA, 21 nt, Artificial Sequence
  RNA Oligomer
ucuccagugaagugcacauug

SEQ ID NO: 17908 - RNA, 21 nt, Artificial Sequence
  RNA Oligomer
uugcucaacaccagugcuagg

SEQ ID NO: 17909 - RNA, 21 nt, Artificial Sequence
  RNA Oligomer
uuccugaugaugaggaugcau

SEQ ID NO: 17910 - RNA, 21 nt, Artificial Sequence
  RNA Oligomer
uacaaaauccuggcaguggga

SEQ ID NO: 17911 - RNA, 21 nt, Artificial Sequence
  RNA Oligomer
auacuaugucgacccaaaggc

SEQ ID NO: 17912 - RNA, 21 nt, Artificial Sequence
  RNA Oligomer
gagcaccuugacuacuacagg

SEQ ID NO: 17913 - RNA, 21 nt, Artificial Sequence
  RNA Oligomer
auuuugcuagggaccauggga

SEQ ID NO: 17914 - RNA, 21 nt, Artificial Sequence
  RNA Oligomer
aguggauaaaagcaaaacaca

SEQ ID NO: 17915 - RNA, 21 nt, Artificial Sequence
  RNA Oligomer
cucauuuacagccugguaggg

SEQ ID NO: 17916 - RNA, 21 nt, Artificial Sequence
  RNA Oligomer
uagacugcucagggacugaag

SEQ ID NO: 17917 - RNA, 21 nt, Artificial Sequence
  RNA Oligomer
uuagaagcugagaggagacca

SEQ ID NO: 17918 - RNA, 21 nt, Artificial Sequence
  RNA Oligomer
auuuaaacaaccaaauccugg

SEQ ID NO: 17919 - RNA, 21 nt, Artificial Sequence
  RNA Oligomer
aaacaaccaaauccuggccag

SEQ ID NO: 17920 - RNA, 21 nt, Artificial Sequence
  RNA Oligomer
aacuacucuguuaugugagaa

SEQ ID NO: 17921 - RNA, 21 nt, Artificial Sequence
  RNA Oligomer
uucuggcugaaacugcccacu

SEQ ID NO: 17922 - RNA, 21 nt, Artificial Sequence
  RNA Oligomer
uuucaguaacaaagcucagag

SEQ ID NO: 17923 - RNA, 21 nt, Artificial Sequence
  RNA Oligomer
uuaaauuuggacaccuuccaa

SEQ ID NO: 17924 - RNA, 21 nt, Artificial Sequence
  RNA Oligomer
aaauuuggacaccuuccaaac

SEQ ID NO: 17925 - RNA, 21 nt, Artificial Sequence
  RNA Oligomer
cucacucuaggacaaaaaggg

SEQ ID NO: 17926 - RNA, 21 nt, Artificial Sequence
  RNA Oligomer
aaagauaggagauggucucuc

SEQ ID NO: 17927 - RNA, 21 nt, Artificial Sequence
  RNA Oligomer
gcuucacagaaaaggagcugg

SEQ ID NO: 17928 - RNA, 21 nt, Artificial Sequence
  RNA Oligomer
cucaaaggcagagaugauggg

SEQ ID NO: 17929 - RNA, 21 nt, Artificial Sequence
  RNA Oligomer
cuugcaccgguggaauucugu

SEQ ID NO: 17930 - RNA, 21 nt, Artificial Sequence
  RNA Oligomer
uugcaccgguggaauucugug

SEQ ID NO: 17931 - RNA, 21 nt, Artificial Sequence
  RNA Oligomer
uaagugcguucaccuuaacca

SEQ ID NO: 17932 - RNA, 21 nt, Artificial Sequence
  RNA Oligomer
aacacuugagcaagagccucg

SEQ ID NO: 17933 - RNA, 21 nt, Artificial Sequence
  RNA Oligomer
accaggaaccucguuuggugu

SEQ ID NO: 17934 - RNA, 21 nt, Artificial Sequence
  RNA Oligomer
aaccucguuugguguuccgca

SEQ ID NO: 17935 - RNA, 21 nt, Artificial Sequence
  RNA Oligomer
ugacuagaguacuguggucca

SEQ ID NO: 17936 - RNA, 21 nt, Artificial Sequence
  RNA Oligomer
uucuuucucuccagugaagug

SEQ ID NO: 17937 - RNA, 21 nt, Artificial Sequence
  RNA Oligomer
gaagugcacauugcucaacac

SEQ ID NO: 17938 - RNA, 21 nt, Artificial Sequence
  RNA Oligomer
cacauugcucaacaccagugc

SEQ ID NO: 17939 - RNA, 21 nt, Artificial Sequence
  RNA Oligomer
guuuccugaugaugaggaugc

SEQ ID NO: 17940 - RNA, 21 nt, Artificial Sequence
  RNA Oligomer
ccugaugaugaggaugcaugc

SEQ ID NO: 17941 - RNA, 21 nt, Artificial Sequence
  RNA Oligomer
auuuauuuggcacccgauggc

SEQ ID NO: 17942 - RNA, 21 nt, Artificial Sequence
  RNA Oligomer
aagguuggcuugccuucuucc

SEQ ID NO: 17943 - RNA, 21 nt, Artificial Sequence
  RNA Oligomer
uuggcuugccuucuucccucu

SEQ ID NO: 17944 - RNA, 21 nt, Artificial Sequence
  RNA Oligomer
cugcaauaaaugcaaugaggg

SEQ ID NO: 17945 - RNA, 21 nt, Artificial Sequence
  RNA Oligomer
acacagaaguagacugcucag

SEQ ID NO: 17946 - RNA, 21 nt, Artificial Sequence
  RNA Oligomer
acagaaguagacugcucaggg

SEQ ID NO: 17947 - RNA, 21 nt, Artificial Sequence
  RNA Oligomer
acagaaggcaucaaaagcuug

SEQ ID NO: 17948 - RNA, 21 nt, Artificial Sequence
  RNA Oligomer
ucaagacuugaggaagaagga

SEQ ID NO: 17949 - RNA, 21 nt, Artificial Sequence
  RNA Oligomer
uagaagcugagaggagaccac

SEQ ID NO: 17950 - RNA, 21 nt, Artificial Sequence
  RNA Oligomer
gaaggcaagaaccaguucuca

SEQ ID NO: 17951 - RNA, 21 nt, Artificial Sequence
  RNA Oligomer
uagaaagcagaaggguucuaa

SEQ ID NO: 17952 - RNA, 21 nt, Artificial Sequence
  RNA Oligomer
gggaaguuucagauaagcagg

SEQ ID NO: 17953 - RNA, 21 nt, Artificial Sequence
  RNA Oligomer
ccauacuuccuuagcuuauaa

SEQ ID NO: 17954 - RNA, 21 nt, Artificial Sequence
  RNA Oligomer
acacuauaccauacuuccuua

SEQ ID NO: 17955 - RNA, 21 nt, Artificial Sequence
  RNA Oligomer
ugggaugaaaaucaggcucuu

SEQ ID NO: 17956 - RNA, 21 nt, Artificial Sequence
  RNA Oligomer
cuauuacaacaaggagagcuu

SEQ ID NO: 17957 - RNA, 21 nt, Artificial Sequence
  RNA Oligomer
ccauuacacacgaguuauuuu

SEQ ID NO: 17958 - RNA, 21 nt, Artificial Sequence
  RNA Oligomer
ggcugggaauaaauuuuuauc

SEQ ID NO: 17959 - RNA, 21 nt, Artificial Sequence
  RNA Oligomer
gguguucauuucuauuacaac

SEQ ID NO: 17960 - RNA, 21 nt, Artificial Sequence
  RNA Oligomer
ccuucgcugcucuucugaaau

SEQ ID NO: 17961 - RNA, 21 nt, Artificial Sequence
  RNA Oligomer
cccuucgcugcucuucugaaa

SEQ ID NO: 17962 - RNA, 21 nt, Artificial Sequence
  RNA Oligomer
ccgaagagcaacaaguaucau

SEQ ID NO: 17963 - RNA, 21 nt, Artificial Sequence
  RNA Oligomer
agaaauuuccugacagccgaa

SEQ ID NO: 17964 - RNA, 21 nt, Artificial Sequence
  RNA Oligomer
cauguuuucaucgucuucuuu

SEQ ID NO: 17965 - RNA, 21 nt, Artificial Sequence
  RNA Oligomer
ccacaaacacaaccacugaau

SEQ ID NO: 17966 - RNA, 21 nt, Artificial Sequence
  RNA Oligomer
gagguguucauuucuauuaca

SEQ ID NO: 17967 - RNA, 21 nt, Artificial Sequence
  RNA Oligomer
gcugcucuucugaaaucuaua

SEQ ID NO: 17968 - RNA, 21 nt, Artificial Sequence
  RNA Oligomer
cucaauuuucuggcaaggaac

SEQ ID NO: 17969 - RNA, 21 nt, Artificial Sequence
  RNA Oligomer
gcgcauuucuucaaccuggaa

SEQ ID NO: 17970 - RNA, 21 nt, Artificial Sequence
  RNA Oligomer
ggagagcuucuagacuuugga

SEQ ID NO: 17971 - RNA, 21 nt, Artificial Sequence
  RNA Oligomer
caaggagagcuucuagacuuu

SEQ ID NO: 17972 - RNA, 21 nt, Artificial Sequence
  RNA Oligomer
agagguguucauuucuauuac

SEQ ID NO: 17973 - RNA, 21 nt, Artificial Sequence
  RNA Oligomer
gcaagagcuuuugagugguuu

SEQ ID NO: 17974 - RNA, 21 nt, Artificial Sequence
  RNA Oligomer
ucgcugcucuucugaaaucua

SEQ ID NO: 17975 - RNA, 21 nt, Artificial Sequence
  RNA Oligomer
gccgaagagcaacaaguauca

SEQ ID NO: 17976 - RNA, 21 nt, Artificial Sequence
  RNA Oligomer
cucucuggcuuuagucuugau

SEQ ID NO: 17977 - RNA, 21 nt, Artificial Sequence
  RNA Oligomer
cauucauaagaggaacaagua

SEQ ID NO: 17978 - RNA, 21 nt, Artificial Sequence
  RNA Oligomer
cacuauaccauacuuccuuag

SEQ ID NO: 17979 - RNA, 21 nt, Artificial Sequence
  RNA Oligomer
ucgaggacacuucaaaagaug

SEQ ID NO: 17980 - RNA, 21 nt, Artificial Sequence
  RNA Oligomer
ugacgugauuacaggcuuaaa

SEQ ID NO: 17981 - RNA, 21 nt, Artificial Sequence
  RNA Oligomer
cgcugcucuucugaaaucuau

SEQ ID NO: 17982 - RNA, 21 nt, Artificial Sequence
  RNA Oligomer
cccugacagauguauuucacu

SEQ ID NO: 17983 - RNA, 21 nt, Artificial Sequence
  RNA Oligomer
gcccugacagauguauuucac

SEQ ID NO: 17984 - RNA, 21 nt, Artificial Sequence
  RNA Oligomer
gaagagcaacaaguaucauga

SEQ ID NO: 17985 - RNA, 21 nt, Artificial Sequence
  RNA Oligomer
gaaagaauaauuagguucugg

SEQ ID NO: 17986 - RNA, 21 nt, Artificial Sequence
  RNA Oligomer
cuuguaugcaugugaaagaau

SEQ ID NO: 17987 - RNA, 21 nt, Artificial Sequence
  RNA Oligomer
cuaugaguuguucugguacac

SEQ ID NO: 17988 - RNA, 21 nt, Artificial Sequence
  RNA Oligomer
cuggcuuuagucuugaucaug

SEQ ID NO: 17989 - RNA, 21 nt, Artificial Sequence
  RNA Oligomer
ggaggaggcaauuagacaaaa

SEQ ID NO: 17990 - RNA, 21 nt, Artificial Sequence
  RNA Oligomer
gcacugugccugaauuuuaac

SEQ ID NO: 17991 - RNA, 21 nt, Artificial Sequence
  RNA Oligomer
cgaguuauuuuggguucaaca

SEQ ID NO: 17992 - RNA, 21 nt, Artificial Sequence
  RNA Oligomer
cacgaguuauuuuggguucaa

SEQ ID NO: 17993 - RNA, 21 nt, Artificial Sequence
  RNA Oligomer
gcccuuacuaacgacccaaca

SEQ ID NO: 17994 - RNA, 21 nt, Artificial Sequence
  RNA Oligomer
cauggcugggaauaaauuuuu

SEQ ID NO: 17995 - RNA, 21 nt, Artificial Sequence
  RNA Oligomer
gcagcaguauuggcguguucu

SEQ ID NO: 17996 - RNA, 21 nt, Artificial Sequence
  RNA Oligomer
ggacgaaaauacugacgugau

SEQ ID NO: 17997 - RNA, 21 nt, Artificial Sequence
  RNA Oligomer
cugggaugaaaaucaggcucu

SEQ ID NO: 17998 - RNA, 21 nt, Artificial Sequence
  RNA Oligomer
gaauaauuagguucuggcgau

SEQ ID NO: 17999 - RNA, 21 nt, Artificial Sequence
  RNA Oligomer
uggucuuguaugcaugugaaa

SEQ ID NO: 18000 - RNA, 21 nt, Artificial Sequence
  RNA Oligomer
gaggaggcaauuagacaaaaa

SEQ ID NO: 18001 - RNA, 21 nt, Artificial Sequence
  RNA Oligomer
gcaugcuaauucuaauaccug

SEQ ID NO: 18002 - RNA, 21 nt, Artificial Sequence
  RNA Oligomer
acacacgaguuauuuuggguu

SEQ ID NO: 18003 - RNA, 21 nt, Artificial Sequence
  RNA Oligomer
cccuuacuaacgacccaacau

SEQ ID NO: 18004 - RNA, 21 nt, Artificial Sequence
  RNA Oligomer
ucauggcugggaauaaauuuu

SEQ ID NO: 18005 - RNA, 21 nt, Artificial Sequence
  RNA Oligomer
cagcagcaguauuggcguguu

SEQ ID NO: 18006 - RNA, 21 nt, Artificial Sequence
  RNA Oligomer
aacaaugaguucaagcagauu

SEQ ID NO: 18007 - RNA, 21 nt, Artificial Sequence
  RNA Oligomer
cucuucacauagcuuuacacu

SEQ ID NO: 18008 - RNA, 21 nt, Artificial Sequence
  RNA Oligomer
gaagcugagcaagguguauuu

SEQ ID NO: 18009 - RNA, 21 nt, Artificial Sequence
  RNA Oligomer
ccugacagauguauuucacua

SEQ ID NO: 18010 - RNA, 21 nt, Artificial Sequence
  RNA Oligomer
aagagcaacaaguaucaugau

SEQ ID NO: 18011 - RNA, 21 nt, Artificial Sequence
  RNA Oligomer
cgaagagcaacaaguaucaug

SEQ ID NO: 18012 - RNA, 21 nt, Artificial Sequence
  RNA Oligomer
ucuuguaugcaugugaaagaa

SEQ ID NO: 18013 - RNA, 21 nt, Artificial Sequence
  RNA Oligomer
cucuggcuuuagucuugauca

SEQ ID NO: 18014 - RNA, 21 nt, Artificial Sequence
  RNA Oligomer
cacaaacacaaccacugaauu

SEQ ID NO: 18015 - RNA, 21 nt, Artificial Sequence
  RNA Oligomer
gcaauuagacaaaaaccucag

SEQ ID NO: 18016 - RNA, 21 nt, Artificial Sequence
  RNA Oligomer
cacguucuacugguaugaaga

SEQ ID NO: 18017 - RNA, 21 nt, Artificial Sequence
  RNA Oligomer
gacacguucuacugguaugaa

SEQ ID NO: 18018 - RNA, 21 nt, Artificial Sequence
  RNA Oligomer
cucauggcugggaauaaauuu

SEQ ID NO: 18019 - RNA, 21 nt, Artificial Sequence
  RNA Oligomer
ugggaacuggugaauaauaau

SEQ ID NO: 18020 - RNA, 21 nt, Artificial Sequence
  RNA Oligomer
caacaaggagagcuucuagac

SEQ ID NO: 18021 - RNA, 21 nt, Artificial Sequence
  RNA Oligomer
cagagguguucauuucuauua

SEQ ID NO: 18022 - RNA, 21 nt, Artificial Sequence
  RNA Oligomer
cguguucuucuguggaccuaa

SEQ ID NO: 18023 - RNA, 21 nt, Artificial Sequence
  RNA Oligomer
cugacgugauuacaggcuuaa

SEQ ID NO: 18024 - RNA, 21 nt, Artificial Sequence
  RNA Oligomer
acgaaaauacugacgugauua

SEQ ID NO: 18025 - RNA, 21 nt, Artificial Sequence
  RNA Oligomer
agcuuuacacugggacgaaaa

SEQ ID NO: 18026 - RNA, 21 nt, Artificial Sequence
  RNA Oligomer
cucuucugaaaucuauauggu

SEQ ID NO: 18027 - RNA, 21 nt, Artificial Sequence
  RNA Oligomer
ugcucuucugaaaucuauaug

SEQ ID NO: 18028 - RNA, 21 nt, Artificial Sequence
  RNA Oligomer
cugcucuucugaaaucuauau

SEQ ID NO: 18029 - RNA, 21 nt, Artificial Sequence
  RNA Oligomer
guggucuuguaugcaugugaa

SEQ ID NO: 18030 - RNA, 21 nt, Artificial Sequence
  RNA Oligomer
caacaucaccuucuguagaga

SEQ ID NO: 18031 - RNA, 21 nt, Artificial Sequence
  RNA Oligomer
cucucugcacaacaucaccuu

SEQ ID NO: 18032 - RNA, 21 nt, Artificial Sequence
  RNA Oligomer
caggugagggagaagaaauuu

SEQ ID NO: 18033 - RNA, 21 nt, Artificial Sequence
  RNA Oligomer
gacacaggugagggagaagaa

SEQ ID NO: 18034 - RNA, 21 nt, Artificial Sequence
  RNA Oligomer
acacgaguuauuuuggguuca

SEQ ID NO: 18035 - RNA, 21 nt, Artificial Sequence
  RNA Oligomer
ugacacguucuacugguauga

SEQ ID NO: 18036 - RNA, 21 nt, Artificial Sequence
  RNA Oligomer
agcagcaguauuggcguguuc

SEQ ID NO: 18037 - RNA, 21 nt, Artificial Sequence
  RNA Oligomer
auaauuagguucuggcgauuu

SEQ ID NO: 18038 - RNA, 21 nt, Artificial Sequence
  RNA Oligomer
uccuaugaguuguucugguac

SEQ ID NO: 18039 - RNA, 21 nt, Artificial Sequence
  RNA Oligomer
accacugaauugcuaaggaca

SEQ ID NO: 18040 - RNA, 21 nt, Artificial Sequence
  RNA Oligomer
gcauuucuucaaccuggaacg

SEQ ID NO: 18041 - RNA, 21 nt, Artificial Sequence
  RNA Oligomer
gggaacuggugaauaauaauu

SEQ ID NO: 18042 - RNA, 21 nt, Artificial Sequence
  RNA Oligomer
gccuguugauaugagcuccca

SEQ ID NO: 18043 - RNA, 21 nt, Artificial Sequence
  RNA Oligomer
guccaggcauuguguuuucaa

SEQ ID NO: 18044 - RNA, 21 nt, Artificial Sequence
  RNA Oligomer
gagcuucuagacuuuggaggu

SEQ ID NO: 18045 - RNA, 21 nt, Artificial Sequence
  RNA Oligomer
acaaggagagcuucuagacuu

SEQ ID NO: 18046 - RNA, 21 nt, Artificial Sequence
  RNA Oligomer
acuucaaaagaugugccacuu

SEQ ID NO: 18047 - RNA, 21 nt, Artificial Sequence
  RNA Oligomer
gcguguucuucuguggaccua

SEQ ID NO: 18048 - RNA, 21 nt, Artificial Sequence
  RNA Oligomer
gcaguauuggcguguucuucu

SEQ ID NO: 18049 - RNA, 21 nt, Artificial Sequence
  RNA Oligomer
cagcaguauuggcguguucuu

SEQ ID NO: 18050 - RNA, 21 nt, Artificial Sequence
  RNA Oligomer
cgaaaauacugacgugauuac

SEQ ID NO: 18051 - RNA, 21 nt, Artificial Sequence
  RNA Oligomer
caagagcuuuugagugguuug

SEQ ID NO: 18052 - RNA, 21 nt, Artificial Sequence
  RNA Oligomer
gggaugcaagagcuuuugagu

SEQ ID NO: 18053 - RNA, 21 nt, Artificial Sequence
  RNA Oligomer
ccgggaugcaagagcuuuuga

SEQ ID NO: 18054 - RNA, 21 nt, Artificial Sequence
  RNA Oligomer
caagguguauuucuacuggau

SEQ ID NO: 18055 - RNA, 21 nt, Artificial Sequence
  RNA Oligomer
gcugagcaagguguauuucua

SEQ ID NO: 18056 - RNA, 21 nt, Artificial Sequence
  RNA Oligomer
caagaaguugucauuaccaag

SEQ ID NO: 18057 - RNA, 21 nt, Artificial Sequence
  RNA Oligomer
acaagaaguugucauuaccaa

SEQ ID NO: 18058 - RNA, 21 nt, Artificial Sequence
  RNA Oligomer
acaggugagggagaagaaauu

SEQ ID NO: 18059 - RNA, 21 nt, Artificial Sequence
  RNA Oligomer
caaccacugaauugcuaagga

SEQ ID NO: 18060 - RNA, 21 nt, Artificial Sequence
  RNA Oligomer
cccacaaacacaaccacugaa

SEQ ID NO: 18061 - RNA, 21 nt, Artificial Sequence
  RNA Oligomer
caauuagacaaaaaccucaga

SEQ ID NO: 18062 - RNA, 21 nt, Artificial Sequence
  RNA Oligomer
aggaggcaauuagacaaaaac

SEQ ID NO: 18063 - RNA, 21 nt, Artificial Sequence
  RNA Oligomer
uggaggaggcaauuagacaaa

SEQ ID NO: 18064 - RNA, 21 nt, Artificial Sequence
  RNA Oligomer
ugcaugcuaauucuaauaccu

SEQ ID NO: 18065 - RNA, 21 nt, Artificial Sequence
  RNA Oligomer
acgaguuauuuuggguucaac

SEQ ID NO: 18066 - RNA, 21 nt, Artificial Sequence
  RNA Oligomer
cacacgaguuauuuuggguuc

SEQ ID NO: 18067 - RNA, 21 nt, Artificial Sequence
  RNA Oligomer
uguugauaugagcucccaguu

SEQ ID NO: 18068 - RNA, 21 nt, Artificial Sequence
  RNA Oligomer
caccauauuaguacucucaug

SEQ ID NO: 18069 - RNA, 21 nt, Artificial Sequence
  RNA Oligomer
gaaaauacugacgugauuaca

SEQ ID NO: 18070 - RNA, 21 nt, Artificial Sequence
  RNA Oligomer
agagcuuuugagugguuugcu

SEQ ID NO: 18071 - RNA, 21 nt, Artificial Sequence
  RNA Oligomer
gggugcuggauuuugaaugag

SEQ ID NO: 18072 - RNA, 21 nt, Artificial Sequence
  RNA Oligomer
cccuguggucuuguaugcaug

SEQ ID NO: 18073 - RNA, 21 nt, Artificial Sequence
  RNA Oligomer
gugaucucucuggcuuuaguc

SEQ ID NO: 18074 - RNA, 21 nt, Artificial Sequence
  RNA Oligomer
uggugaucucucuggcuuuag

SEQ ID NO: 18075 - RNA, 21 nt, Artificial Sequence
  RNA Oligomer
acacaggugagggagaagaaa

SEQ ID NO: 18076 - RNA, 21 nt, Artificial Sequence
  RNA Oligomer
cgcauuucuucaaccuggaac

SEQ ID NO: 18077 - RNA, 21 nt, Artificial Sequence
  RNA Oligomer
aaaccucagauuucacaaacu

SEQ ID NO: 18078 - RNA, 21 nt, Artificial Sequence
  RNA Oligomer
ccugaauuuuaacugcaugcu

SEQ ID NO: 18079 - RNA, 21 nt, Artificial Sequence
  RNA Oligomer
gccugaauuuuaacugcaugc

SEQ ID NO: 18080 - RNA, 21 nt, Artificial Sequence
  RNA Oligomer
ugccugaauuuuaacugcaug

SEQ ID NO: 18081 - RNA, 21 nt, Artificial Sequence
  RNA Oligomer
guaugaagaggaggagucuuu

SEQ ID NO: 18082 - RNA, 21 nt, Artificial Sequence
  RNA Oligomer
aguugggaacuggugaauaau

SEQ ID NO: 18083 - RNA, 21 nt, Artificial Sequence
  RNA Oligomer
gccacuuguauucaucagcug

SEQ ID NO: 18084 - RNA, 21 nt, Artificial Sequence
  RNA Oligomer
gacgaaaauacugacgugauu

SEQ ID NO: 18085 - RNA, 21 nt, Artificial Sequence
  RNA Oligomer
gggacgaaaauacugacguga

SEQ ID NO: 18086 - RNA, 21 nt, Artificial Sequence
  RNA Oligomer
gcuuuacacugggacgaaaau

SEQ ID NO: 18087 - RNA, 21 nt, Artificial Sequence
  RNA Oligomer
ugcugaucucuuacucucccu

SEQ ID NO: 18088 - RNA, 21 nt, Artificial Sequence
  RNA Oligomer
gguuugcugaucucuuacucu

SEQ ID NO: 18089 - RNA, 21 nt, Artificial Sequence
  RNA Oligomer
gcuuuugagugguuugcugau

SEQ ID NO: 18090 - RNA, 21 nt, Artificial Sequence
  RNA Oligomer
ggaagacuuuuucagcgugca

SEQ ID NO: 18091 - RNA, 21 nt, Artificial Sequence
  RNA Oligomer
agaaguugucauuaccaaggu

SEQ ID NO: 18092 - RNA, 21 nt, Artificial Sequence
  RNA Oligomer
gguucuggcgauuucaacaag

SEQ ID NO: 18093 - RNA, 21 nt, Artificial Sequence
  RNA Oligomer
agguucuggcgauuucaacaa

SEQ ID NO: 18094 - RNA, 21 nt, Artificial Sequence
  RNA Oligomer
gcccuguggucuuguaugcau

SEQ ID NO: 18095 - RNA, 21 nt, Artificial Sequence
  RNA Oligomer
cucggcuuggaaauggauuuu

SEQ ID NO: 18096 - RNA, 21 nt, Artificial Sequence
  RNA Oligomer
cagucucucucugcacaacau

SEQ ID NO: 18097 - RNA, 21 nt, Artificial Sequence
  RNA Oligomer
cuggugaucucucuggcuuua

SEQ ID NO: 18098 - RNA, 21 nt, Artificial Sequence
  RNA Oligomer
ucuggugaucucucuggcuuu

SEQ ID NO: 18099 - RNA, 21 nt, Artificial Sequence
  RNA Oligomer
cacaggugagggagaagaaau

SEQ ID NO: 18100 - RNA, 21 nt, Artificial Sequence
  RNA Oligomer
ugcuaauucuaauaccuguca

SEQ ID NO: 18101 - RNA, 21 nt, Artificial Sequence
  RNA Oligomer
ugguaugaagaggaggagucu

SEQ ID NO: 18102 - RNA, 21 nt, Artificial Sequence
  RNA Oligomer
cuucaaaagaugugccacuug

SEQ ID NO: 18103 - RNA, 21 nt, Artificial Sequence
  RNA Oligomer
guguucuucuguggaccuaaa

SEQ ID NO: 18104 - RNA, 21 nt, Artificial Sequence
  RNA Oligomer
gcugaucucuuacucucccug

SEQ ID NO: 18105 - RNA, 21 nt, Artificial Sequence
  RNA Oligomer
cuggauuuugaaugagggucu

SEQ ID NO: 18106 - RNA, 21 nt, Artificial Sequence
  RNA Oligomer
gaaguugucauuaccaaggug

SEQ ID NO: 18107 - RNA, 21 nt, Artificial Sequence
  RNA Oligomer
ccuucuguagagaccgcuaug

SEQ ID NO: 18108 - RNA, 21 nt, Artificial Sequence
  RNA Oligomer
acaggccuccuaugaguuguu

SEQ ID NO: 18109 - RNA, 21 nt, Artificial Sequence
  RNA Oligomer
ggugaucucucuggcuuuagu

SEQ ID NO: 18110 - RNA, 21 nt, Artificial Sequence
  RNA Oligomer
caaguauuugcugcagaggac

SEQ ID NO: 18111 - RNA, 21 nt, Artificial Sequence
  RNA Oligomer
gguaugaagaggaggagucuu

SEQ ID NO: 18112 - RNA, 21 nt, Artificial Sequence
  RNA Oligomer
cuguuuauugacacguucuac

SEQ ID NO: 18113 - RNA, 21 nt, Artificial Sequence
  RNA Oligomer
uccaggcauuguguuuucaau

SEQ ID NO: 18114 - RNA, 21 nt, Artificial Sequence
  RNA Oligomer
caaguccaggcauuguguuuu

SEQ ID NO: 18115 - RNA, 21 nt, Artificial Sequence
  RNA Oligomer
ucaaguccaggcauuguguuu

SEQ ID NO: 18116 - RNA, 21 nt, Artificial Sequence
  RNA Oligomer
ggucaaguccaggcauugugu

SEQ ID NO: 18117 - RNA, 21 nt, Artificial Sequence
  RNA Oligomer
ugggacgaaaauacugacgug

SEQ ID NO: 18118 - RNA, 21 nt, Artificial Sequence
  RNA Oligomer
cgggaugcaagagcuuuugag

SEQ ID NO: 18119 - RNA, 21 nt, Artificial Sequence
  RNA Oligomer
ugaagcugagcaagguguauu

SEQ ID NO: 18120 - RNA, 21 nt, Artificial Sequence
  RNA Oligomer
ccuguggucuuguaugcaugu

SEQ ID NO: 18121 - RNA, 21 nt, Artificial Sequence
  RNA Oligomer
ugacagccgaagagcaacaag

SEQ ID NO: 18122 - RNA, 21 nt, Artificial Sequence
  RNA Oligomer
ccucggcuuggaaauggauuu

SEQ ID NO: 18123 - RNA, 21 nt, Artificial Sequence
  RNA Oligomer
gcacaacaucaccuucuguag

SEQ ID NO: 18124 - RNA, 21 nt, Artificial Sequence
  RNA Oligomer
caaaagaugugccacuuguau

SEQ ID NO: 18125 - RNA, 21 nt, Artificial Sequence
  RNA Oligomer
acugaagcugagcaaggugua

SEQ ID NO: 18126 - RNA, 21 nt, Artificial Sequence
  RNA Oligomer
ugcuggauuuugaaugagggu

SEQ ID NO: 18127 - RNA, 21 nt, Artificial Sequence
  RNA Oligomer
ugaaugagggucucuccacca

SEQ ID NO: 18128 - RNA, 21 nt, Artificial Sequence
  RNA Oligomer
aagguguauuucuacuggauu

SEQ ID NO: 18129 - RNA, 21 nt, Artificial Sequence
  RNA Oligomer
ccauguuuucaucgucuucuu

SEQ ID NO: 18130 - RNA, 21 nt, Artificial Sequence
  RNA Oligomer
ggaggagucuuuccauuacac

SEQ ID NO: 18131 - RNA, 21 nt, Artificial Sequence
  RNA Oligomer
ucuguuuauugacacguucua

SEQ ID NO: 18132 - RNA, 21 nt, Artificial Sequence
  RNA Oligomer
agaugugccacuuguauucau

SEQ ID NO: 18133 - RNA, 21 nt, Artificial Sequence
  RNA Oligomer
caacuggaacaaugaguucaa

SEQ ID NO: 18134 - RNA, 21 nt, Artificial Sequence
  RNA Oligomer
caggcucuucacauagcuuua

SEQ ID NO: 18135 - RNA, 21 nt, Artificial Sequence
  RNA Oligomer
uucuacuggauuugccgggau

SEQ ID NO: 18136 - RNA, 21 nt, Artificial Sequence
  RNA Oligomer
uuacuagggaagcccuuacua

SEQ ID NO: 18137 - RNA, 21 nt, Artificial Sequence
  RNA Oligomer
acaccauguuuucaucgucuu

SEQ ID NO: 18138 - RNA, 21 nt, Artificial Sequence
  RNA Oligomer
cacauagcuuuacacugggac

SEQ ID NO: 18139 - RNA, 21 nt, Artificial Sequence
  RNA Oligomer
ugaaaaagcguggcuuuaaaa

SEQ ID NO: 18140 - RNA, 21 nt, Artificial Sequence
  RNA Oligomer
acagccgaagagcaacaagua

SEQ ID NO: 18141 - RNA, 21 nt, Artificial Sequence
  RNA Oligomer
cggcuuggaaauggauuuuag

SEQ ID NO: 18142 - RNA, 21 nt, Artificial Sequence
  RNA Oligomer
cugcacaacaucaccuucugu

SEQ ID NO: 18143 - RNA, 21 nt, Artificial Sequence
  RNA Oligomer
agaggaggagucuuuccauua

SEQ ID NO: 18144 - RNA, 21 nt, Artificial Sequence
  RNA Oligomer
gcccaacuggaacaaugaguu

SEQ ID NO: 18145 - RNA, 21 nt, Artificial Sequence
  RNA Oligomer
gggaugaaaaucaggcucuuc

SEQ ID NO: 18146 - RNA, 21 nt, Artificial Sequence
  RNA Oligomer
acaaaugcagugaggcacaga

SEQ ID NO: 18147 - RNA, 21 nt, Artificial Sequence
  RNA Oligomer
ggaacugcccugacagaugua

SEQ ID NO: 18148 - RNA, 21 nt, Artificial Sequence
  RNA Oligomer
agacuuuuucagcgugcacau

SEQ ID NO: 18149 - RNA, 21 nt, Artificial Sequence
  RNA Oligomer
ccaggaagacuuuuucagcgu

SEQ ID NO: 18150 - RNA, 21 nt, Artificial Sequence
  RNA Oligomer
ugaguuguucugguacacaca

SEQ ID NO: 18151 - RNA, 21 nt, Artificial Sequence
  RNA Oligomer
cccuaacgagagcuaccucaa

SEQ ID NO: 18152 - RNA, 21 nt, Artificial Sequence
  RNA Oligomer
gaggagucuuuccauuacaca

SEQ ID NO: 18153 - RNA, 21 nt, Artificial Sequence
  RNA Oligomer
acaguacacuauaccauacuu

SEQ ID NO: 18154 - RNA, 21 nt, Artificial Sequence
  RNA Oligomer
gcauuguguuuucaaucaagu

SEQ ID NO: 18155 - RNA, 21 nt, Artificial Sequence
  RNA Oligomer
ccagagguguucauuucuauu

SEQ ID NO: 18156 - RNA, 21 nt, Artificial Sequence
  RNA Oligomer
gaggcccaacuggaacaauga

SEQ ID NO: 18157 - RNA, 21 nt, Artificial Sequence
  RNA Oligomer
ucaggcucuucacauagcuuu

SEQ ID NO: 18158 - RNA, 21 nt, Artificial Sequence
  RNA Oligomer
gaaaaucaggcucuucacaua

SEQ ID NO: 18159 - RNA, 21 nt, Artificial Sequence
  RNA Oligomer
gagugguuugcugaucucuua

SEQ ID NO: 18160 - RNA, 21 nt, Artificial Sequence
  RNA Oligomer
gcaagguguauuucuacugga

SEQ ID NO: 18161 - RNA, 21 nt, Artificial Sequence
  RNA Oligomer
ugcacaacaucaccuucugua

SEQ ID NO: 18162 - RNA, 21 nt, Artificial Sequence
  RNA Oligomer
gccaaacccaagacagucucu

SEQ ID NO: 18163 - RNA, 21 nt, Artificial Sequence
  RNA Oligomer
ggcuuuagucuugaucaugac

SEQ ID NO: 18164 - RNA, 21 nt, Artificial Sequence
  RNA Oligomer
ucuuuccauuacacacgaguu

SEQ ID NO: 18165 - RNA, 21 nt, Artificial Sequence
  RNA Oligomer
gucuuuccauuacacacgagu

SEQ ID NO: 18166 - RNA, 21 nt, Artificial Sequence
  RNA Oligomer
aggaggagucuuuccauuaca

SEQ ID NO: 18167 - RNA, 21 nt, Artificial Sequence
  RNA Oligomer
ugaacaguacacuauaccaua

SEQ ID NO: 18168 - RNA, 21 nt, Artificial Sequence
  RNA Oligomer
cccagagguguucauuucuau

SEQ ID NO: 18169 - RNA, 21 nt, Artificial Sequence
  RNA Oligomer
gaacaaugaguucaagcagau

SEQ ID NO: 18170 - RNA, 21 nt, Artificial Sequence
  RNA Oligomer
ggcccaacuggaacaaugagu

SEQ ID NO: 18171 - RNA, 21 nt, Artificial Sequence
  RNA Oligomer
ggcucuucacauagcuuuaca

SEQ ID NO: 18172 - RNA, 21 nt, Artificial Sequence
  RNA Oligomer
ugaaaaucaggcucuucacau

SEQ ID NO: 18173 - RNA, 21 nt, Artificial Sequence
  RNA Oligomer
ggaugaaaaucaggcucuuca

SEQ ID NO: 18174 - RNA, 21 nt, Artificial Sequence
  RNA Oligomer
ugguuugcugaucucuuacuc

SEQ ID NO: 18175 - RNA, 21 nt, Artificial Sequence
  RNA Oligomer
acagauguauuucacuaccca

SEQ ID NO: 18176 - RNA, 21 nt, Artificial Sequence
  RNA Oligomer
ggaguccuggaacuucacaug

SEQ ID NO: 18177 - RNA, 21 nt, Artificial Sequence
  RNA Oligomer
ggcuuggaaauggauuuuagg

SEQ ID NO: 18178 - RNA, 21 nt, Artificial Sequence
  RNA Oligomer
ucggcuuggaaauggauuuua

SEQ ID NO: 18179 - RNA, 21 nt, Artificial Sequence
  RNA Oligomer
ucugguacacacaccauguuu

SEQ ID NO: 18180 - RNA, 21 nt, Artificial Sequence
  RNA Oligomer
caaaaaccucagauuucacaa

SEQ ID NO: 18181 - RNA, 21 nt, Artificial Sequence
  RNA Oligomer
uccauuacacacgaguuauuu

SEQ ID NO: 18182 - RNA, 21 nt, Artificial Sequence
  RNA Oligomer
gaagaggaggagucuuuccau

SEQ ID NO: 18183 - RNA, 21 nt, Artificial Sequence
  RNA Oligomer
ggcauuguguuuucaaucaag

SEQ ID NO: 18184 - RNA, 21 nt, Artificial Sequence
  RNA Oligomer
aggcauuguguuuucaaucaa

SEQ ID NO: 18185 - RNA, 21 nt, Artificial Sequence
  RNA Oligomer
cgaggacacuucaaaagaugu

SEQ ID NO: 18186 - RNA, 21 nt, Artificial Sequence
  RNA Oligomer
ccaccauauuaguacucucau

SEQ ID NO: 18187 - RNA, 21 nt, Artificial Sequence
  RNA Oligomer
gauuacaggcuuaaagcagaa

SEQ ID NO: 18188 - RNA, 21 nt, Artificial Sequence
  RNA Oligomer
ucuuaccggcugggaugaaaa

SEQ ID NO: 18189 - RNA, 21 nt, Artificial Sequence
  RNA Oligomer
guauuucacuacccagugugu

SEQ ID NO: 18190 - RNA, 21 nt, Artificial Sequence
  RNA Oligomer
ccuggaacuucacaugaaaaa

SEQ ID NO: 18191 - RNA, 21 nt, Artificial Sequence
  RNA Oligomer
gccucaauuuucuggcaagga

SEQ ID NO: 18192 - RNA, 21 nt, Artificial Sequence
  RNA Oligomer
cuucuuucucagccuggccau

SEQ ID NO: 18193 - RNA, 21 nt, Artificial Sequence
  RNA Oligomer
cacaccauguuuucaucgucu

SEQ ID NO: 18194 - RNA, 21 nt, Artificial Sequence
  RNA Oligomer
ccgcacugugccugaauuuua

SEQ ID NO: 18195 - RNA, 21 nt, Artificial Sequence
  RNA Oligomer
auaccauacuuccuuagcuua

SEQ ID NO: 18196 - RNA, 21 nt, Artificial Sequence
  RNA Oligomer
cuucuagacuuuggaggucaa

SEQ ID NO: 18197 - RNA, 21 nt, Artificial Sequence
  RNA Oligomer
guucaagcagauugccuacaa

SEQ ID NO: 18198 - RNA, 21 nt, Artificial Sequence
  RNA Oligomer
uggaacaaugaguucaagcag

SEQ ID NO: 18199 - RNA, 21 nt, Artificial Sequence
  RNA Oligomer
cccaacuggaacaaugaguuc

SEQ ID NO: 18200 - RNA, 21 nt, Artificial Sequence
  RNA Oligomer
gaugaaaaucaggcucuucac

SEQ ID NO: 18201 - RNA, 21 nt, Artificial Sequence
  RNA Oligomer
ggaaacacggaugagugagca

SEQ ID NO: 18202 - RNA, 21 nt, Artificial Sequence
  RNA Oligomer
gaagacuuuuucagcgugcac

SEQ ID NO: 18203 - RNA, 21 nt, Artificial Sequence
  RNA Oligomer
cuggaacuucacaugaaaaag

SEQ ID NO: 18204 - RNA, 21 nt, Artificial Sequence
  RNA Oligomer
guccuggaacuucacaugaaa

SEQ ID NO: 18205 - RNA, 21 nt, Artificial Sequence
  RNA Oligomer
cgauuucaacaagaaguuguc

SEQ ID NO: 18206 - RNA, 21 nt, Artificial Sequence
  RNA Oligomer
ccucaauuuucuggcaaggaa

SEQ ID NO: 18207 - RNA, 21 nt, Artificial Sequence
  RNA Oligomer
cgugccucaauuuucuggcaa

SEQ ID NO: 18208 - RNA, 21 nt, Artificial Sequence
  RNA Oligomer
guacacacaccauguuuucau

SEQ ID NO: 18209 - RNA, 21 nt, Artificial Sequence
  RNA Oligomer
cugaauugcuaaggacaauag

SEQ ID NO: 18210 - RNA, 21 nt, Artificial Sequence
  RNA Oligomer
acacaaccacugaauugcuaa

SEQ ID NO: 18211 - RNA, 21 nt, Artificial Sequence
  RNA Oligomer
gacaaaaaccucagauuucac

SEQ ID NO: 18212 - RNA, 21 nt, Artificial Sequence
  RNA Oligomer
ggaacaaguauuugcugcaga

SEQ ID NO: 18213 - RNA, 21 nt, Artificial Sequence
  RNA Oligomer
cuauugugaacaguacacuau

SEQ ID NO: 18214 - RNA, 21 nt, Artificial Sequence
  RNA Oligomer
cucucauggcugggaauaaau

SEQ ID NO: 18215 - RNA, 21 nt, Artificial Sequence
  RNA Oligomer
agcucucucgaggacacuuca

SEQ ID NO: 18216 - RNA, 21 nt, Artificial Sequence
  RNA Oligomer
gcagauugccuacaaucaccc

SEQ ID NO: 18217 - RNA, 21 nt, Artificial Sequence
  RNA Oligomer
uucaagcagauugccuacaau

SEQ ID NO: 18218 - RNA, 21 nt, Artificial Sequence
  RNA Oligomer
gcagaagaccuucuaugggag

SEQ ID NO: 18219 - RNA, 21 nt, Artificial Sequence
  RNA Oligomer
ugagggucucuccaccauauu

SEQ ID NO: 18220 - RNA, 21 nt, Artificial Sequence
  RNA Oligomer
ucacauagcuuuacacuggga

SEQ ID NO: 18221 - RNA, 21 nt, Artificial Sequence
  RNA Oligomer
gguguauuucuacuggauuug

SEQ ID NO: 18222 - RNA, 21 nt, Artificial Sequence
  RNA Oligomer
guacaaaugcagugaggcaca

SEQ ID NO: 18223 - RNA, 21 nt, Artificial Sequence
  RNA Oligomer
gaaaaagcguggcuuuaaaau

SEQ ID NO: 18224 - RNA, 21 nt, Artificial Sequence
  RNA Oligomer
uggcgauuucaacaagaaguu

SEQ ID NO: 18225 - RNA, 21 nt, Artificial Sequence
  RNA Oligomer
cagccgaagagcaacaaguau

SEQ ID NO: 18226 - RNA, 21 nt, Artificial Sequence
  RNA Oligomer
agacagucucucucugcacaa

SEQ ID NO: 18227 - RNA, 21 nt, Artificial Sequence
  RNA Oligomer
cuccuaugaguuguucuggua

SEQ ID NO: 18228 - RNA, 21 nt, Artificial Sequence
  RNA Oligomer
gaccucgucaacugaguucau

SEQ ID NO: 18229 - RNA, 21 nt, Artificial Sequence
  RNA Oligomer
caugaccucgucaacugaguu

SEQ ID NO: 18230 - RNA, 21 nt, Artificial Sequence
  RNA Oligomer
ccacugaauugcuaaggacaa

SEQ ID NO: 18231 - RNA, 21 nt, Artificial Sequence
  RNA Oligomer
ccacaucguggcgcauuucuu

SEQ ID NO: 18232 - RNA, 21 nt, Artificial Sequence
  RNA Oligomer
ccuaugggauagcuguuaaug

SEQ ID NO: 18233 - RNA, 21 nt, Artificial Sequence
  RNA Oligomer
cucagauuucacaaacugguc

SEQ ID NO: 18234 - RNA, 21 nt, Artificial Sequence
  RNA Oligomer
gagucuuuccauuacacacga

SEQ ID NO: 18235 - RNA, 21 nt, Artificial Sequence
  RNA Oligomer
caguacacuauaccauacuuc

SEQ ID NO: 18236 - RNA, 21 nt, Artificial Sequence
  RNA Oligomer
acuauugugaacaguacacua

SEQ ID NO: 18237 - RNA, 21 nt, Artificial Sequence
  RNA Oligomer
uccaccauauuaguacucuca

SEQ ID NO: 18238 - RNA, 21 nt, Artificial Sequence
  RNA Oligomer
cuccaccauauuaguacucuc

SEQ ID NO: 18239 - RNA, 21 nt, Artificial Sequence
  RNA Oligomer
gagggucucuccaccauauua

SEQ ID NO: 18240 - RNA, 21 nt, Artificial Sequence
  RNA Oligomer
gcucuucacauagcuuuacac

SEQ ID NO: 18241 - RNA, 21 nt, Artificial Sequence
  RNA Oligomer
ggcugggaugaaaaucaggcu

SEQ ID NO: 18242 - RNA, 21 nt, Artificial Sequence
  RNA Oligomer
gaaugagggucucuccaccau

SEQ ID NO: 18243 - RNA, 21 nt, Artificial Sequence
  RNA Oligomer
gaaaacucacuuucugaguua

SEQ ID NO: 18244 - RNA, 21 nt, Artificial Sequence
  RNA Oligomer
agguguauuucuacuggauuu

SEQ ID NO: 18245 - RNA, 21 nt, Artificial Sequence
  RNA Oligomer
cagauguauuucacuacccag

SEQ ID NO: 18246 - RNA, 21 nt, Artificial Sequence
  RNA Oligomer
uccuggaacuucacaugaaaa

SEQ ID NO: 18247 - RNA, 21 nt, Artificial Sequence
  RNA Oligomer
ggaaauggauuuuaggcccug

SEQ ID NO: 18248 - RNA, 21 nt, Artificial Sequence
  RNA Oligomer
caccauguuuucaucgucuuc

SEQ ID NO: 18249 - RNA, 21 nt, Artificial Sequence
  RNA Oligomer
acacaccauguuuucaucguc

SEQ ID NO: 18250 - RNA, 21 nt, Artificial Sequence
  RNA Oligomer
aggccuccuaugaguuguucu

SEQ ID NO: 18251 - RNA, 21 nt, Artificial Sequence
  RNA Oligomer
cugucagucgaaaccuuauuu

SEQ ID NO: 18252 - RNA, 21 nt, Artificial Sequence
  RNA Oligomer
ccaguugggaacuggugaaua

SEQ ID NO: 18253 - RNA, 21 nt, Artificial Sequence
  RNA Oligomer
cucgaggacacuucaaaagau

SEQ ID NO: 18254 - RNA, 21 nt, Artificial Sequence
  RNA Oligomer
ucucucgaggacacuucaaaa

SEQ ID NO: 18255 - RNA, 21 nt, Artificial Sequence
  RNA Oligomer
ccuaaagcucucucgaggaca

SEQ ID NO: 18256 - RNA, 21 nt, Artificial Sequence
  RNA Oligomer
cucuccaccauauuaguacuc

SEQ ID NO: 18257 - RNA, 21 nt, Artificial Sequence
  RNA Oligomer
gggucucuccaccauauuagu

SEQ ID NO: 18258 - RNA, 21 nt, Artificial Sequence
  RNA Oligomer
acucacuuucugaguuaucau

SEQ ID NO: 18259 - RNA, 21 nt, Artificial Sequence
  RNA Oligomer
ggaugcaagagcuuuugagug

SEQ ID NO: 18260 - RNA, 21 nt, Artificial Sequence
  RNA Oligomer
gagcaagguguauuucuacug

SEQ ID NO: 18261 - RNA, 21 nt, Artificial Sequence
  RNA Oligomer
cugacagauguauuucacuac

SEQ ID NO: 18262 - RNA, 21 nt, Artificial Sequence
  RNA Oligomer
caggaagacuuuuucagcgug

SEQ ID NO: 18263 - RNA, 21 nt, Artificial Sequence
  RNA Oligomer
augaaaaagcguggcuuuaaa

SEQ ID NO: 18264 - RNA, 21 nt, Artificial Sequence
  RNA Oligomer
gaacuucacaugaaaaagcgu

SEQ ID NO: 18265 - RNA, 21 nt, Artificial Sequence
  RNA Oligomer
ggaacuucacaugaaaaagcg

SEQ ID NO: 18266 - RNA, 21 nt, Artificial Sequence
  RNA Oligomer
cugacagccgaagagcaacaa

SEQ ID NO: 18267 - RNA, 21 nt, Artificial Sequence
  RNA Oligomer
aggaacccucggcuuggaaau

SEQ ID NO: 18268 - RNA, 21 nt, Artificial Sequence
  RNA Oligomer
gugccucaauuuucuggcaag

SEQ ID NO: 18269 - RNA, 21 nt, Artificial Sequence
  RNA Oligomer
ccgugccucaauuuucuggca

SEQ ID NO: 18270 - RNA, 21 nt, Artificial Sequence
  RNA Oligomer
caagacagucucucucugcac

SEQ ID NO: 18271 - RNA, 21 nt, Artificial Sequence
  RNA Oligomer
ggccuccuaugaguuguucug

SEQ ID NO: 18272 - RNA, 21 nt, Artificial Sequence
  RNA Oligomer
acgacccaacauccagacaca

SEQ ID NO: 18273 - RNA, 21 nt, Artificial Sequence
  RNA Oligomer
cagucgaaaccuuauuucauu

SEQ ID NO: 18274 - RNA, 21 nt, Artificial Sequence
  RNA Oligomer
cgcacugugccugaauuuuaa

SEQ ID NO: 18275 - RNA, 21 nt, Artificial Sequence
  RNA Oligomer
gugaacaguacacuauaccau

SEQ ID NO: 18276 - RNA, 21 nt, Artificial Sequence
  RNA Oligomer
cccaguugggaacuggugaau

SEQ ID NO: 18277 - RNA, 21 nt, Artificial Sequence
  RNA Oligomer
ucaaaagaugugccacuugua

SEQ ID NO: 18278 - RNA, 21 nt, Artificial Sequence
  RNA Oligomer
cucucucgaggacacuucaaa

SEQ ID NO: 18279 - RNA, 21 nt, Artificial Sequence
  RNA Oligomer
gcucucucgaggacacuucaa

SEQ ID NO: 18280 - RNA, 21 nt, Artificial Sequence
  RNA Oligomer
gaccuaaagcucucucgagga

SEQ ID NO: 18281 - RNA, 21 nt, Artificial Sequence
  RNA Oligomer
ggaacaaugaguucaagcaga

SEQ ID NO: 18282 - RNA, 21 nt, Artificial Sequence
  RNA Oligomer
ccaacuggaacaaugaguuca

SEQ ID NO: 18283 - RNA, 21 nt, Artificial Sequence
  RNA Oligomer
gaaacacggaugagugagcag

SEQ ID NO: 18284 - RNA, 21 nt, Artificial Sequence
  RNA Oligomer
ugccgggaugcaagagcuuuu

SEQ ID NO: 18285 - RNA, 21 nt, Artificial Sequence
  RNA Oligomer
ggauuuugaaugagggucucu

SEQ ID NO: 18286 - RNA, 21 nt, Artificial Sequence
  RNA Oligomer
caugaaaaagcguggcuuuaa

SEQ ID NO: 18287 - RNA, 21 nt, Artificial Sequence
  RNA Oligomer
cacaugaaaaagcguggcuuu

SEQ ID NO: 18288 - RNA, 21 nt, Artificial Sequence
  RNA Oligomer
ucacaugaaaaagcguggcuu

SEQ ID NO: 18289 - RNA, 21 nt, Artificial Sequence
  RNA Oligomer
cgcuaugcagaauggcagaca

SEQ ID NO: 18290 - RNA, 21 nt, Artificial Sequence
  RNA Oligomer
gccuccuaugaguuguucugg

SEQ ID NO: 18291 - RNA, 21 nt, Artificial Sequence
  RNA Oligomer
cagacaggccuccuaugaguu

SEQ ID NO: 18292 - RNA, 21 nt, Artificial Sequence
  RNA Oligomer
acugaauugcuaaggacaaua

SEQ ID NO: 18293 - RNA, 21 nt, Artificial Sequence
  RNA Oligomer
ggcgcauuucuucaaccugga

SEQ ID NO: 18294 - RNA, 21 nt, Artificial Sequence
  RNA Oligomer
uguuaaugcaaccauccacau

SEQ ID NO: 18295 - RNA, 21 nt, Artificial Sequence
  RNA Oligomer
ccuuauuucauucauaagagg

SEQ ID NO: 18296 - RNA, 21 nt, Artificial Sequence
  RNA Oligomer
ccugucagucgaaaccuuauu

SEQ ID NO: 18297 - RNA, 21 nt, Artificial Sequence
  RNA Oligomer
uaccugucagucgaaaccuua

SEQ ID NO: 18298 - RNA, 21 nt, Artificial Sequence
  RNA Oligomer
acaugucauauacaacagaac

SEQ ID NO: 18299 - RNA, 21 nt, Artificial Sequence
  RNA Oligomer
accauacuuccuuagcuuaua

SEQ ID NO: 18300 - RNA, 21 nt, Artificial Sequence
  RNA Oligomer
ccaggcauuguguuuucaauc

SEQ ID NO: 18301 - RNA, 21 nt, Artificial Sequence
  RNA Oligomer
ccauauuaguacucucauggc

SEQ ID NO: 18302 - RNA, 21 nt, Artificial Sequence
  RNA Oligomer
ugaguucaagcagauugccua

SEQ ID NO: 18303 - RNA, 21 nt, Artificial Sequence
  RNA Oligomer
auagcuuuacacugggacgaa

SEQ ID NO: 18304 - RNA, 21 nt, Artificial Sequence
  RNA Oligomer
cucacuuucugaguuaucaua

SEQ ID NO: 18305 - RNA, 21 nt, Artificial Sequence
  RNA Oligomer
ggaaaacucacuuucugaguu

SEQ ID NO: 18306 - RNA, 21 nt, Artificial Sequence
  RNA Oligomer
gggaaaacucacuuucugagu

SEQ ID NO: 18307 - RNA, 21 nt, Artificial Sequence
  RNA Oligomer
ugcaagagcuuuugagugguu

SEQ ID NO: 18308 - RNA, 21 nt, Artificial Sequence
  RNA Oligomer
caaacccaagacagucucucu

SEQ ID NO: 18309 - RNA, 21 nt, Artificial Sequence
  RNA Oligomer
gucggauuguucgaggccaaa

SEQ ID NO: 18310 - RNA, 21 nt, Artificial Sequence
  RNA Oligomer
ugguacacacaccauguuuuc

SEQ ID NO: 18311 - RNA, 21 nt, Artificial Sequence
  RNA Oligomer
cugguacacacaccauguuuu

SEQ ID NO: 18312 - RNA, 21 nt, Artificial Sequence
  RNA Oligomer
ggagaagaaauuuccugacag

SEQ ID NO: 18313 - RNA, 21 nt, Artificial Sequence
  RNA Oligomer
gucuugaucaugaccucguca

SEQ ID NO: 18314 - RNA, 21 nt, Artificial Sequence
  RNA Oligomer
cacugaauugcuaaggacaau

SEQ ID NO: 18315 - RNA, 21 nt, Artificial Sequence
  RNA Oligomer
cuguuaaugcaaccauccaca

SEQ ID NO: 18316 - RNA, 21 nt, Artificial Sequence
  RNA Oligomer
ggaggcaauuagacaaaaacc

SEQ ID NO: 18317 - RNA, 21 nt, Artificial Sequence
  RNA Oligomer
uucuaauaccugucagucgaa

SEQ ID NO: 18318 - RNA, 21 nt, Artificial Sequence
  RNA Oligomer
cugaauuuuaacugcaugcua

SEQ ID NO: 18319 - RNA, 21 nt, Artificial Sequence
  RNA Oligomer
gugccugaauuuuaacugcau

SEQ ID NO: 18320 - RNA, 21 nt, Artificial Sequence
  RNA Oligomer
ucccaguugggaacuggugaa

SEQ ID NO: 18321 - RNA, 21 nt, Artificial Sequence
  RNA Oligomer
ggacacuucaaaagaugugcc

SEQ ID NO: 18322 - RNA, 21 nt, Artificial Sequence
  RNA Oligomer
ucaagcagauugccuacaauc

SEQ ID NO: 18323 - RNA, 21 nt, Artificial Sequence
  RNA Oligomer
gaguucaagcagauugccuac

SEQ ID NO: 18324 - RNA, 21 nt, Artificial Sequence
  RNA Oligomer
gaucucuuacucucccuggaa

SEQ ID NO: 18325 - RNA, 21 nt, Artificial Sequence
  RNA Oligomer
gcaguacaucuuggugcagug

SEQ ID NO: 18326 - RNA, 21 nt, Artificial Sequence
  RNA Oligomer
gaaauggauuuuaggcccugu

SEQ ID NO: 18327 - RNA, 21 nt, Artificial Sequence
  RNA Oligomer
guagagaccgcuaugcagaau

SEQ ID NO: 18328 - RNA, 21 nt, Artificial Sequence
  RNA Oligomer
ucaacugaguucaucagacag

SEQ ID NO: 18329 - RNA, 21 nt, Artificial Sequence
  RNA Oligomer
guggcgcauuucuucaaccug

SEQ ID NO: 18330 - RNA, 21 nt, Artificial Sequence
  RNA Oligomer
ggauagcuguuaaugcaacca

SEQ ID NO: 18331 - RNA, 21 nt, Artificial Sequence
  RNA Oligomer
gucgccuaugggauagcuguu

SEQ ID NO: 18332 - RNA, 21 nt, Artificial Sequence
  RNA Oligomer
accugucagucgaaaccuuau

SEQ ID NO: 18333 - RNA, 21 nt, Artificial Sequence
  RNA Oligomer
cuaauucuaauaccugucagu

SEQ ID NO: 18334 - RNA, 21 nt, Artificial Sequence
  RNA Oligomer
uccgcacugugccugaauuuu

SEQ ID NO: 18335 - RNA, 21 nt, Artificial Sequence
  RNA Oligomer
gcuucuagacuuuggagguca

SEQ ID NO: 18336 - RNA, 21 nt, Artificial Sequence
  RNA Oligomer
ccacuuguauucaucagcuga

SEQ ID NO: 18337 - RNA, 21 nt, Artificial Sequence
  RNA Oligomer
acacuucaaaagaugugccac

SEQ ID NO: 18338 - RNA, 21 nt, Artificial Sequence
  RNA Oligomer
gacacuucaaaagaugugcca

SEQ ID NO: 18339 - RNA, 21 nt, Artificial Sequence
  RNA Oligomer
ggucucuccaccauauuagua

SEQ ID NO: 18340 - RNA, 21 nt, Artificial Sequence
  RNA Oligomer
accggcugggaugaaaaucag

SEQ ID NO: 18341 - RNA, 21 nt, Artificial Sequence
  RNA Oligomer
cagccauaucuucgcuggagu

SEQ ID NO: 18342 - RNA, 21 nt, Artificial Sequence
  RNA Oligomer
acaugaaaaagcguggcuuua

SEQ ID NO: 18343 - RNA, 21 nt, Artificial Sequence
  RNA Oligomer
ggcgauuucaacaagaaguug

SEQ ID NO: 18344 - RNA, 21 nt, Artificial Sequence
  RNA Oligomer
acccucggcuuggaaauggau

SEQ ID NO: 18345 - RNA, 21 nt, Artificial Sequence
  RNA Oligomer
cuaugcagaauggcagacagu

SEQ ID NO: 18346 - RNA, 21 nt, Artificial Sequence
  RNA Oligomer
caccuucuguagagaccgcua

SEQ ID NO: 18347 - RNA, 21 nt, Artificial Sequence
  RNA Oligomer
ccucgucaacugaguucauca

SEQ ID NO: 18348 - RNA, 21 nt, Artificial Sequence
  RNA Oligomer
augggauagcuguuaaugcaa

SEQ ID NO: 18349 - RNA, 21 nt, Artificial Sequence
  RNA Oligomer
agacaaaaaccucagauuuca

SEQ ID NO: 18350 - RNA, 21 nt, Artificial Sequence
  RNA Oligomer
aggcaauuagacaaaaaccuc

SEQ ID NO: 18351 - RNA, 21 nt, Artificial Sequence
  RNA Oligomer
accguggaggaggcaauuaga

SEQ ID NO: 18352 - RNA, 21 nt, Artificial Sequence
  RNA Oligomer
cuaauaccugucagucgaaac

SEQ ID NO: 18353 - RNA, 21 nt, Artificial Sequence
  RNA Oligomer
agcccuuacuaacgacccaac

SEQ ID NO: 18354 - RNA, 21 nt, Artificial Sequence
  RNA Oligomer
agggaagcccuuacuaacgac

SEQ ID NO: 18355 - RNA, 21 nt, Artificial Sequence
  RNA Oligomer
accauauuaguacucucaugg

SEQ ID NO: 18356 - RNA, 21 nt, Artificial Sequence
  RNA Oligomer
acugacgugauuacaggcuua

SEQ ID NO: 18357 - RNA, 21 nt, Artificial Sequence
  RNA Oligomer
aaacucacuuucugaguuauc

SEQ ID NO: 18358 - RNA, 21 nt, Artificial Sequence
  RNA Oligomer
agccauaucuucgcuggagug

SEQ ID NO: 18359 - RNA, 21 nt, Artificial Sequence
  RNA Oligomer
uuaggcccuguggucuuguau

SEQ ID NO: 18360 - RNA, 21 nt, Artificial Sequence
  RNA Oligomer
gcuaugcagaauggcagacag

SEQ ID NO: 18361 - RNA, 21 nt, Artificial Sequence
  RNA Oligomer
acagucucucucugcacaaca

SEQ ID NO: 18362 - RNA, 21 nt, Artificial Sequence
  RNA Oligomer
cguggcgcauuucuucaaccu

SEQ ID NO: 18363 - RNA, 21 nt, Artificial Sequence
  RNA Oligomer
gaacaaguauuugcugcagag

SEQ ID NO: 18364 - RNA, 21 nt, Artificial Sequence
  RNA Oligomer
gcuaauucuaauaccugucag

SEQ ID NO: 18365 - RNA, 21 nt, Artificial Sequence
  RNA Oligomer
auccgcacugugccugaauuu

SEQ ID NO: 18366 - RNA, 21 nt, Artificial Sequence
  RNA Oligomer
caguugggaacuggugaauaa

SEQ ID NO: 18367 - RNA, 21 nt, Artificial Sequence
  RNA Oligomer
ccuguugauaugagcucccag

SEQ ID NO: 18368 - RNA, 21 nt, Artificial Sequence
  RNA Oligomer
guacucucauggcugggaaua

SEQ ID NO: 18369 - RNA, 21 nt, Artificial Sequence
  RNA Oligomer
uggaggucaaguccaggcauu

SEQ ID NO: 18370 - RNA, 21 nt, Artificial Sequence
  RNA Oligomer
ucucuuacucucccuggaaac

SEQ ID NO: 18371 - RNA, 21 nt, Artificial Sequence
  RNA Oligomer
agcuuuugagugguuugcuga

SEQ ID NO: 18372 - RNA, 21 nt, Artificial Sequence
  RNA Oligomer
cugagcaagguguauuucuac

SEQ ID NO: 18373 - RNA, 21 nt, Artificial Sequence
  RNA Oligomer
ggcaguacaucuuggugcagu

SEQ ID NO: 18374 - RNA, 21 nt, Artificial Sequence
  RNA Oligomer
uucuggcgauuucaacaagaa

SEQ ID NO: 18375 - RNA, 21 nt, Artificial Sequence
  RNA Oligomer
cccucggcuuggaaauggauu

SEQ ID NO: 18376 - RNA, 21 nt, Artificial Sequence
  RNA Oligomer
ucaccuucuguagagaccgcu

SEQ ID NO: 18377 - RNA, 21 nt, Artificial Sequence
  RNA Oligomer
ccaagacagucucucucugca

SEQ ID NO: 18378 - RNA, 21 nt, Artificial Sequence
  RNA Oligomer
gucaacugaguucaucagaca

SEQ ID NO: 18379 - RNA, 21 nt, Artificial Sequence
  RNA Oligomer
ugaccucgucaacugaguuca

SEQ ID NO: 18380 - RNA, 21 nt, Artificial Sequence
  RNA Oligomer
cuaaggacaauagcaggcguc

SEQ ID NO: 18381 - RNA, 21 nt, Artificial Sequence
  RNA Oligomer
gcuaaggacaauagcaggcgu

SEQ ID NO: 18382 - RNA, 21 nt, Artificial Sequence
  RNA Oligomer
gggauagcuguuaaugcaacc

SEQ ID NO: 18383 - RNA, 21 nt, Artificial Sequence
  RNA Oligomer
ggcaauuagacaaaaaccuca

SEQ ID NO: 18384 - RNA, 21 nt, Artificial Sequence
  RNA Oligomer
gaggaacaaguauuugcugca

SEQ ID NO: 18385 - RNA, 21 nt, Artificial Sequence
  RNA Oligomer
ucagucgaaaccuuauuucau

SEQ ID NO: 18386 - RNA, 21 nt, Artificial Sequence
  RNA Oligomer
aguacucucauggcugggaau

SEQ ID NO: 18387 - RNA, 21 nt, Artificial Sequence
  RNA Oligomer
cugcccugacagauguauuuc

SEQ ID NO: 18388 - RNA, 21 nt, Artificial Sequence
  RNA Oligomer
ugcagugcccagccauaucuu

SEQ ID NO: 18389 - RNA, 21 nt, Artificial Sequence
  RNA Oligomer
gcgauuucaacaagaaguugu

SEQ ID NO: 18390 - RNA, 21 nt, Artificial Sequence
  RNA Oligomer
ucgucaacugaguucaucaga

SEQ ID NO: 18391 - RNA, 21 nt, Artificial Sequence
  RNA Oligomer
gauagcuguuaaugcaaccau

SEQ ID NO: 18392 - RNA, 21 nt, Artificial Sequence
  RNA Oligomer
gucgaaaccuuauuucauuca

SEQ ID NO: 18393 - RNA, 21 nt, Artificial Sequence
  RNA Oligomer
gucagucgaaaccuuauuuca

SEQ ID NO: 18394 - RNA, 21 nt, Artificial Sequence
  RNA Oligomer
ccugugacggccuguugauau

SEQ ID NO: 18395 - RNA, 21 nt, Artificial Sequence
  RNA Oligomer
uggauuuugaaugagggucuc

SEQ ID NO: 18396 - RNA, 21 nt, Artificial Sequence
  RNA Oligomer
uggaaauggauuuuaggcccu

SEQ ID NO: 18397 - RNA, 21 nt, Artificial Sequence
  RNA Oligomer
accuucuguagagaccgcuau

SEQ ID NO: 18398 - RNA, 21 nt, Artificial Sequence
  RNA Oligomer
aggaacaaguauuugcugcag

SEQ ID NO: 18399 - RNA, 21 nt, Artificial Sequence
  RNA Oligomer
uaguacucucauggcugggaa

SEQ ID NO: 18400 - RNA, 21 nt, Artificial Sequence
  RNA Oligomer
guggaccuaaagcucucucga

SEQ ID NO: 18401 - RNA, 21 nt, Artificial Sequence
  RNA Oligomer
uuaaagcagaagaccuucuau

SEQ ID NO: 18402 - RNA, 21 nt, Artificial Sequence
  RNA Oligomer
cuuaaagcagaagaccuucua

SEQ ID NO: 18403 - RNA, 21 nt, Artificial Sequence
  RNA Oligomer
ggcuuaaagcagaagaccuuc

SEQ ID NO: 18404 - RNA, 21 nt, Artificial Sequence
  RNA Oligomer
accgcuaugcagaauggcaga

SEQ ID NO: 18405 - RNA, 21 nt, Artificial Sequence
  RNA Oligomer
gggagaagaaauuuccugaca

SEQ ID NO: 18406 - RNA, 21 nt, Artificial Sequence
  RNA Oligomer
uguucuucuguggaccuaaag

SEQ ID NO: 18407 - RNA, 21 nt, Artificial Sequence
  RNA Oligomer
agggcaguacaucuuggugca

SEQ ID NO: 18408 - RNA, 21 nt, Artificial Sequence
  RNA Oligomer
ggauuuuaggcccuguggucu

SEQ ID NO: 18409 - RNA, 21 nt, Artificial Sequence
  RNA Oligomer
agggagaagaaauuuccugac

SEQ ID NO: 18410 - RNA, 21 nt, Artificial Sequence
  RNA Oligomer
uucaucagacaggccuccuau

SEQ ID NO: 18411 - RNA, 21 nt, Artificial Sequence
  RNA Oligomer
ugaguucaucagacaggccuc

SEQ ID NO: 18412 - RNA, 21 nt, Artificial Sequence
  RNA Oligomer
gagggagaagaaauuuccuga

SEQ ID NO: 18413 - RNA, 21 nt, Artificial Sequence
  RNA Oligomer
gccuaugggauagcuguuaau

SEQ ID NO: 18414 - RNA, 21 nt, Artificial Sequence
  RNA Oligomer
cgccuaugggauagcuguuaa

SEQ ID NO: 18415 - RNA, 21 nt, Artificial Sequence
  RNA Oligomer
ugccacuuguauucaucagcu

SEQ ID NO: 18416 - RNA, 21 nt, Artificial Sequence
  RNA Oligomer
aggcuuaaagcagaagaccuu

SEQ ID NO: 18417 - RNA, 21 nt, Artificial Sequence
  RNA Oligomer
agucgaaaccuuauuucauuc

SEQ ID NO: 18418 - RNA, 21 nt, Artificial Sequence
  RNA Oligomer
caacauccagacacaggugag

SEQ ID NO: 18419 - RNA, 21 nt, Artificial Sequence
  RNA Oligomer
ccaacauccagacacagguga

SEQ ID NO: 18420 - RNA, 21 nt, Artificial Sequence
  RNA Oligomer
ucgccuaugggauagcuguua

SEQ ID NO: 18421 - RNA, 21 nt, Artificial Sequence
  RNA Oligomer
caacaagaaguugucauuacc

SEQ ID NO: 18422 - RNA, 21 nt, Artificial Sequence
  RNA Oligomer
gagaagaaauuuccugacagc

SEQ ID NO: 18423 - RNA, 21 nt, Artificial Sequence
  RNA Oligomer
ugagugguuugcugaucucuu

SEQ ID NO: 18424 - RNA, 21 nt, Artificial Sequence
  RNA Oligomer
ucaacaagaaguugucauuac

SEQ ID NO: 18425 - RNA, 21 nt, Artificial Sequence
  RNA Oligomer
uuauaagcuaaggaaguaugg

SEQ ID NO: 18426 - RNA, 21 nt, Artificial Sequence
  RNA Oligomer
uaaggaaguaugguauagugu

SEQ ID NO: 18427 - RNA, 21 nt, Artificial Sequence
  RNA Oligomer
aagagccugauuuucauccca

SEQ ID NO: 18428 - RNA, 21 nt, Artificial Sequence
  RNA Oligomer
aagcucuccuuguuguaauag

SEQ ID NO: 18429 - RNA, 21 nt, Artificial Sequence
  RNA Oligomer
aaaauaacucguguguaaugg

SEQ ID NO: 18430 - RNA, 21 nt, Artificial Sequence
  RNA Oligomer
gauaaaaauuuauucccagcc

SEQ ID NO: 18431 - RNA, 21 nt, Artificial Sequence
  RNA Oligomer
guuguaauagaaaugaacacc

SEQ ID NO: 18432 - RNA, 21 nt, Artificial Sequence
  RNA Oligomer
auuucagaagagcagcgaagg

SEQ ID NO: 18433 - RNA, 21 nt, Artificial Sequence
  RNA Oligomer
uuucagaagagcagcgaaggg

SEQ ID NO: 18434 - RNA, 21 nt, Artificial Sequence
  RNA Oligomer
augauacuuguugcucuucgg

SEQ ID NO: 18435 - RNA, 21 nt, Artificial Sequence
  RNA Oligomer
uucggcugucaggaaauuucu

SEQ ID NO: 18436 - RNA, 21 nt, Artificial Sequence
  RNA Oligomer
aaagaagacgaugaaaacaug

SEQ ID NO: 18437 - RNA, 21 nt, Artificial Sequence
  RNA Oligomer
auucagugguuguguuugugg

SEQ ID NO: 18438 - RNA, 21 nt, Artificial Sequence
  RNA Oligomer
uguaauagaaaugaacaccuc

SEQ ID NO: 18439 - RNA, 21 nt, Artificial Sequence
  RNA Oligomer
uauagauuucagaagagcagc

SEQ ID NO: 18440 - RNA, 21 nt, Artificial Sequence
  RNA Oligomer
guuccuugccagaaaauugag

SEQ ID NO: 18441 - RNA, 21 nt, Artificial Sequence
  RNA Oligomer
uuccagguugaagaaaugcgc

SEQ ID NO: 18442 - RNA, 21 nt, Artificial Sequence
  RNA Oligomer
uccaaagucuagaagcucucc

SEQ ID NO: 18443 - RNA, 21 nt, Artificial Sequence
  RNA Oligomer
aaagucuagaagcucuccuug

SEQ ID NO: 18444 - RNA, 21 nt, Artificial Sequence
  RNA Oligomer
guaauagaaaugaacaccucu

SEQ ID NO: 18445 - RNA, 21 nt, Artificial Sequence
  RNA Oligomer
aaaccacucaaaagcucuugc

SEQ ID NO: 18446 - RNA, 21 nt, Artificial Sequence
  RNA Oligomer
uagauuucagaagagcagcga

SEQ ID NO: 18447 - RNA, 21 nt, Artificial Sequence
  RNA Oligomer
ugauacuuguugcucuucggc

SEQ ID NO: 18448 - RNA, 21 nt, Artificial Sequence
  RNA Oligomer
aucaagacuaaagccagagag

SEQ ID NO: 18449 - RNA, 21 nt, Artificial Sequence
  RNA Oligomer
uacuuguuccucuuaugaaug

SEQ ID NO: 18450 - RNA, 21 nt, Artificial Sequence
  RNA Oligomer
cuaaggaaguaugguauagug

SEQ ID NO: 18451 - RNA, 21 nt, Artificial Sequence
  RNA Oligomer
caucuuuugaaguguccucga

SEQ ID NO: 18452 - RNA, 21 nt, Artificial Sequence
  RNA Oligomer
uuuaagccuguaaucacguca

SEQ ID NO: 18453 - RNA, 21 nt, Artificial Sequence
  RNA Oligomer
auagauuucagaagagcagcg

SEQ ID NO: 18454 - RNA, 21 nt, Artificial Sequence
  RNA Oligomer
agugaaauacaucugucaggg

SEQ ID NO: 18455 - RNA, 21 nt, Artificial Sequence
  RNA Oligomer
gugaaauacaucugucagggc

SEQ ID NO: 18456 - RNA, 21 nt, Artificial Sequence
  RNA Oligomer
ucaugauacuuguugcucuuc

SEQ ID NO: 18457 - RNA, 21 nt, Artificial Sequence
  RNA Oligomer
ccagaaccuaauuauucuuuc

SEQ ID NO: 18458 - RNA, 21 nt, Artificial Sequence
  RNA Oligomer
auucuuucacaugcauacaag

SEQ ID NO: 18459 - RNA, 21 nt, Artificial Sequence
  RNA Oligomer
guguaccagaacaacucauag

SEQ ID NO: 18460 - RNA, 21 nt, Artificial Sequence
  RNA Oligomer
caugaucaagacuaaagccag

SEQ ID NO: 18461 - RNA, 21 nt, Artificial Sequence
  RNA Oligomer
uuuugucuaauugccuccucc

SEQ ID NO: 18462 - RNA, 21 nt, Artificial Sequence
  RNA Oligomer
guuaaaauucaggcacagugc

SEQ ID NO: 18463 - RNA, 21 nt, Artificial Sequence
  RNA Oligomer
uguugaacccaaaauaacucg

SEQ ID NO: 18464 - RNA, 21 nt, Artificial Sequence
  RNA Oligomer
uugaacccaaaauaacucgug

SEQ ID NO: 18465 - RNA, 21 nt, Artificial Sequence
  RNA Oligomer
uguugggucguuaguaagggc

SEQ ID NO: 18466 - RNA, 21 nt, Artificial Sequence
  RNA Oligomer
aaaaauuuauucccagccaug

SEQ ID NO: 18467 - RNA, 21 nt, Artificial Sequence
  RNA Oligomer
agaacacgccaauacugcugc

SEQ ID NO: 18468 - RNA, 21 nt, Artificial Sequence
  RNA Oligomer
aucacgucaguauuuucgucc

SEQ ID NO: 18469 - RNA, 21 nt, Artificial Sequence
  RNA Oligomer
agagccugauuuucaucccag

SEQ ID NO: 18470 - RNA, 21 nt, Artificial Sequence
  RNA Oligomer
aucgccagaaccuaauuauuc

SEQ ID NO: 18471 - RNA, 21 nt, Artificial Sequence
  RNA Oligomer
uuucacaugcauacaagacca

SEQ ID NO: 18472 - RNA, 21 nt, Artificial Sequence
  RNA Oligomer
uuuuugucuaauugccuccuc

SEQ ID NO: 18473 - RNA, 21 nt, Artificial Sequence
  RNA Oligomer
cagguauuagaauuagcaugc

SEQ ID NO: 18474 - RNA, 21 nt, Artificial Sequence
  RNA Oligomer
aacccaaaauaacucgugugu

SEQ ID NO: 18475 - RNA, 21 nt, Artificial Sequence
  RNA Oligomer
auguugggucguuaguaaggg

SEQ ID NO: 18476 - RNA, 21 nt, Artificial Sequence
  RNA Oligomer
aaaauuuauucccagccauga

SEQ ID NO: 18477 - RNA, 21 nt, Artificial Sequence
  RNA Oligomer
aacacgccaauacugcugcug

SEQ ID NO: 18478 - RNA, 21 nt, Artificial Sequence
  RNA Oligomer
aaucugcuugaacucauuguu

SEQ ID NO: 18479 - RNA, 21 nt, Artificial Sequence
  RNA Oligomer
aguguaaagcuaugugaagag

SEQ ID NO: 18480 - RNA, 21 nt, Artificial Sequence
  RNA Oligomer
aaauacaccuugcucagcuuc

SEQ ID NO: 18481 - RNA, 21 nt, Artificial Sequence
  RNA Oligomer
uagugaaauacaucugucagg

SEQ ID NO: 18482 - RNA, 21 nt, Artificial Sequence
  RNA Oligomer
aucaugauacuuguugcucuu

SEQ ID NO: 18483 - RNA, 21 nt, Artificial Sequence
  RNA Oligomer
caugauacuuguugcucuucg

SEQ ID NO: 18484 - RNA, 21 nt, Artificial Sequence
  RNA Oligomer
uucuuucacaugcauacaaga

SEQ ID NO: 18485 - RNA, 21 nt, Artificial Sequence
  RNA Oligomer
ugaucaagacuaaagccagag

SEQ ID NO: 18486 - RNA, 21 nt, Artificial Sequence
  RNA Oligomer
aauucagugguuguguuugug

SEQ ID NO: 18487 - RNA, 21 nt, Artificial Sequence
  RNA Oligomer
cugagguuuuugucuaauugc

SEQ ID NO: 18488 - RNA, 21 nt, Artificial Sequence
  RNA Oligomer
ucuucauaccaguagaacgug

SEQ ID NO: 18489 - RNA, 21 nt, Artificial Sequence
  RNA Oligomer
uucauaccaguagaacguguc

SEQ ID NO: 18490 - RNA, 21 nt, Artificial Sequence
  RNA Oligomer
aaauuuauucccagccaugag

SEQ ID NO: 18491 - RNA, 21 nt, Artificial Sequence
  RNA Oligomer
auuauuauucaccaguuccca

SEQ ID NO: 18492 - RNA, 21 nt, Artificial Sequence
  RNA Oligomer
gucuagaagcucuccuuguug

SEQ ID NO: 18493 - RNA, 21 nt, Artificial Sequence
  RNA Oligomer
uaauagaaaugaacaccucug

SEQ ID NO: 18494 - RNA, 21 nt, Artificial Sequence
  RNA Oligomer
uuagguccacagaagaacacg

SEQ ID NO: 18495 - RNA, 21 nt, Artificial Sequence
  RNA Oligomer
uuaagccuguaaucacgucag

SEQ ID NO: 18496 - RNA, 21 nt, Artificial Sequence
  RNA Oligomer
uaaucacgucaguauuuucgu

SEQ ID NO: 18497 - RNA, 21 nt, Artificial Sequence
  RNA Oligomer
uuuucgucccaguguaaagcu

SEQ ID NO: 18498 - RNA, 21 nt, Artificial Sequence
  RNA Oligomer
accauauagauuucagaagag

SEQ ID NO: 18499 - RNA, 21 nt, Artificial Sequence
  RNA Oligomer
cauauagauuucagaagagca

SEQ ID NO: 18500 - RNA, 21 nt, Artificial Sequence
  RNA Oligomer
auauagauuucagaagagcag

SEQ ID NO: 18501 - RNA, 21 nt, Artificial Sequence
  RNA Oligomer
uucacaugcauacaagaccac

SEQ ID NO: 18502 - RNA, 21 nt, Artificial Sequence
  RNA Oligomer
ucucuacagaaggugauguug

SEQ ID NO: 18503 - RNA, 21 nt, Artificial Sequence
  RNA Oligomer
aaggugauguugugcagagag

SEQ ID NO: 18504 - RNA, 21 nt, Artificial Sequence
  RNA Oligomer
aaauuucuucucccucaccug

SEQ ID NO: 18505 - RNA, 21 nt, Artificial Sequence
  RNA Oligomer
uucuucucccucaccuguguc

SEQ ID NO: 18506 - RNA, 21 nt, Artificial Sequence
  RNA Oligomer
ugaacccaaaauaacucgugu

SEQ ID NO: 18507 - RNA, 21 nt, Artificial Sequence
  RNA Oligomer
ucauaccaguagaacguguca

SEQ ID NO: 18508 - RNA, 21 nt, Artificial Sequence
  RNA Oligomer
gaacacgccaauacugcugcu

SEQ ID NO: 18509 - RNA, 21 nt, Artificial Sequence
  RNA Oligomer
aaaucgccagaaccuaauuau

SEQ ID NO: 18510 - RNA, 21 nt, Artificial Sequence
  RNA Oligomer
guaccagaacaacucauagga

SEQ ID NO: 18511 - RNA, 21 nt, Artificial Sequence
  RNA Oligomer
uguccuuagcaauucaguggu

SEQ ID NO: 18512 - RNA, 21 nt, Artificial Sequence
  RNA Oligomer
cguuccagguugaagaaaugc

SEQ ID NO: 18513 - RNA, 21 nt, Artificial Sequence
  RNA Oligomer
aauuauuauucaccaguuccc

SEQ ID NO: 18514 - RNA, 21 nt, Artificial Sequence
  RNA Oligomer
ugggagcucauaucaacaggc

SEQ ID NO: 18515 - RNA, 21 nt, Artificial Sequence
  RNA Oligomer
uugaaaacacaaugccuggac

SEQ ID NO: 18516 - RNA, 21 nt, Artificial Sequence
  RNA Oligomer
accuccaaagucuagaagcuc

SEQ ID NO: 18517 - RNA, 21 nt, Artificial Sequence
  RNA Oligomer
aagucuagaagcucuccuugu

SEQ ID NO: 18518 - RNA, 21 nt, Artificial Sequence
  RNA Oligomer
aaguggcacaucuuuugaagu

SEQ ID NO: 18519 - RNA, 21 nt, Artificial Sequence
  RNA Oligomer
uagguccacagaagaacacgc

SEQ ID NO: 18520 - RNA, 21 nt, Artificial Sequence
  RNA Oligomer
agaagaacacgccaauacugc

SEQ ID NO: 18521 - RNA, 21 nt, Artificial Sequence
  RNA Oligomer
aagaacacgccaauacugcug

SEQ ID NO: 18522 - RNA, 21 nt, Artificial Sequence
  RNA Oligomer
guaaucacgucaguauuuucg

SEQ ID NO: 18523 - RNA, 21 nt, Artificial Sequence
  RNA Oligomer
caaaccacucaaaagcucuug

SEQ ID NO: 18524 - RNA, 21 nt, Artificial Sequence
  RNA Oligomer
acucaaaagcucuugcauccc

SEQ ID NO: 18525 - RNA, 21 nt, Artificial Sequence
  RNA Oligomer
ucaaaagcucuugcaucccgg

SEQ ID NO: 18526 - RNA, 21 nt, Artificial Sequence
  RNA Oligomer
auccaguagaaauacaccuug

SEQ ID NO: 18527 - RNA, 21 nt, Artificial Sequence
  RNA Oligomer
uagaaauacaccuugcucagc

SEQ ID NO: 18528 - RNA, 21 nt, Artificial Sequence
  RNA Oligomer
cuugguaaugacaacuucuug

SEQ ID NO: 18529 - RNA, 21 nt, Artificial Sequence
  RNA Oligomer
uugguaaugacaacuucuugu

SEQ ID NO: 18530 - RNA, 21 nt, Artificial Sequence
  RNA Oligomer
aauuucuucucccucaccugu

SEQ ID NO: 18531 - RNA, 21 nt, Artificial Sequence
  RNA Oligomer
uccuuagcaauucagugguug

SEQ ID NO: 18532 - RNA, 21 nt, Artificial Sequence
  RNA Oligomer
uucagugguuguguuuguggg

SEQ ID NO: 18533 - RNA, 21 nt, Artificial Sequence
  RNA Oligomer
ucugagguuuuugucuaauug

SEQ ID NO: 18534 - RNA, 21 nt, Artificial Sequence
  RNA Oligomer
guuuuugucuaauugccuccu

SEQ ID NO: 18535 - RNA, 21 nt, Artificial Sequence
  RNA Oligomer
uuugucuaauugccuccucca

SEQ ID NO: 18536 - RNA, 21 nt, Artificial Sequence
  RNA Oligomer
agguauuagaauuagcaugca

SEQ ID NO: 18537 - RNA, 21 nt, Artificial Sequence
  RNA Oligomer
guugaacccaaaauaacucgu

SEQ ID NO: 18538 - RNA, 21 nt, Artificial Sequence
  RNA Oligomer
gaacccaaaauaacucgugug

SEQ ID NO: 18539 - RNA, 21 nt, Artificial Sequence
  RNA Oligomer
aacugggagcucauaucaaca

SEQ ID NO: 18540 - RNA, 21 nt, Artificial Sequence
  RNA Oligomer
caugagaguacuaauauggug

SEQ ID NO: 18541 - RNA, 21 nt, Artificial Sequence
  RNA Oligomer
uguaaucacgucaguauuuuc

SEQ ID NO: 18542 - RNA, 21 nt, Artificial Sequence
  RNA Oligomer
agcaaaccacucaaaagcucu

SEQ ID NO: 18543 - RNA, 21 nt, Artificial Sequence
  RNA Oligomer
cucauucaaaauccagcaccc

SEQ ID NO: 18544 - RNA, 21 nt, Artificial Sequence
  RNA Oligomer
caugcauacaagaccacaggg

SEQ ID NO: 18545 - RNA, 21 nt, Artificial Sequence
  RNA Oligomer
gacuaaagccagagagaucac

SEQ ID NO: 18546 - RNA, 21 nt, Artificial Sequence
  RNA Oligomer
cuaaagccagagagaucacca

SEQ ID NO: 18547 - RNA, 21 nt, Artificial Sequence
  RNA Oligomer
uuucuucucccucaccugugu

SEQ ID NO: 18548 - RNA, 21 nt, Artificial Sequence
  RNA Oligomer
guuccagguugaagaaaugcg

SEQ ID NO: 18549 - RNA, 21 nt, Artificial Sequence
  RNA Oligomer
aguuugugaaaucugagguuu

SEQ ID NO: 18550 - RNA, 21 nt, Artificial Sequence
  RNA Oligomer
agcaugcaguuaaaauucagg

SEQ ID NO: 18551 - RNA, 21 nt, Artificial Sequence
  RNA Oligomer
gcaugcaguuaaaauucaggc

SEQ ID NO: 18552 - RNA, 21 nt, Artificial Sequence
  RNA Oligomer
caugcaguuaaaauucaggca

SEQ ID NO: 18553 - RNA, 21 nt, Artificial Sequence
  RNA Oligomer
aaagacuccuccucuucauac

SEQ ID NO: 18554 - RNA, 21 nt, Artificial Sequence
  RNA Oligomer
auuauucaccaguucccaacu

SEQ ID NO: 18555 - RNA, 21 nt, Artificial Sequence
  RNA Oligomer
cagcugaugaauacaaguggc

SEQ ID NO: 18556 - RNA, 21 nt, Artificial Sequence
  RNA Oligomer
aaucacgucaguauuuucguc

SEQ ID NO: 18557 - RNA, 21 nt, Artificial Sequence
  RNA Oligomer
ucacgucaguauuuucguccc

SEQ ID NO: 18558 - RNA, 21 nt, Artificial Sequence
  RNA Oligomer
auuuucgucccaguguaaagc

SEQ ID NO: 18559 - RNA, 21 nt, Artificial Sequence
  RNA Oligomer
agggagaguaagagaucagca

SEQ ID NO: 18560 - RNA, 21 nt, Artificial Sequence
  RNA Oligomer
agaguaagagaucagcaaacc

SEQ ID NO: 18561 - RNA, 21 nt, Artificial Sequence
  RNA Oligomer
aucagcaaaccacucaaaagc

SEQ ID NO: 18562 - RNA, 21 nt, Artificial Sequence
  RNA Oligomer
ugcacgcugaaaaagucuucc

SEQ ID NO: 18563 - RNA, 21 nt, Artificial Sequence
  RNA Oligomer
accuugguaaugacaacuucu

SEQ ID NO: 18564 - RNA, 21 nt, Artificial Sequence
  RNA Oligomer
cuuguugaaaucgccagaacc

SEQ ID NO: 18565 - RNA, 21 nt, Artificial Sequence
  RNA Oligomer
uuguugaaaucgccagaaccu

SEQ ID NO: 18566 - RNA, 21 nt, Artificial Sequence
  RNA Oligomer
augcauacaagaccacagggc

SEQ ID NO: 18567 - RNA, 21 nt, Artificial Sequence
  RNA Oligomer
aaaauccauuuccaagccgag

SEQ ID NO: 18568 - RNA, 21 nt, Artificial Sequence
  RNA Oligomer
auguugugcagagagagacug

SEQ ID NO: 18569 - RNA, 21 nt, Artificial Sequence
  RNA Oligomer
uaaagccagagagaucaccag

SEQ ID NO: 18570 - RNA, 21 nt, Artificial Sequence
  RNA Oligomer
aaagccagagagaucaccaga

SEQ ID NO: 18571 - RNA, 21 nt, Artificial Sequence
  RNA Oligomer
auuucuucucccucaccugug

SEQ ID NO: 18572 - RNA, 21 nt, Artificial Sequence
  RNA Oligomer
ugacagguauuagaauuagca

SEQ ID NO: 18573 - RNA, 21 nt, Artificial Sequence
  RNA Oligomer
agacuccuccucuucauacca

SEQ ID NO: 18574 - RNA, 21 nt, Artificial Sequence
  RNA Oligomer
caaguggcacaucuuuugaag

SEQ ID NO: 18575 - RNA, 21 nt, Artificial Sequence
  RNA Oligomer
uuuagguccacagaagaacac

SEQ ID NO: 18576 - RNA, 21 nt, Artificial Sequence
  RNA Oligomer
cagggagaguaagagaucagc

SEQ ID NO: 18577 - RNA, 21 nt, Artificial Sequence
  RNA Oligomer
agacccucauucaaaauccag

SEQ ID NO: 18578 - RNA, 21 nt, Artificial Sequence
  RNA Oligomer
caccuugguaaugacaacuuc

SEQ ID NO: 18579 - RNA, 21 nt, Artificial Sequence
  RNA Oligomer
cauagcggucucuacagaagg

SEQ ID NO: 18580 - RNA, 21 nt, Artificial Sequence
  RNA Oligomer
aacaacucauaggaggccugu

SEQ ID NO: 18581 - RNA, 21 nt, Artificial Sequence
  RNA Oligomer
acuaaagccagagagaucacc

SEQ ID NO: 18582 - RNA, 21 nt, Artificial Sequence
  RNA Oligomer
guccucugcagcaaauacuug

SEQ ID NO: 18583 - RNA, 21 nt, Artificial Sequence
  RNA Oligomer
aagacuccuccucuucauacc

SEQ ID NO: 18584 - RNA, 21 nt, Artificial Sequence
  RNA Oligomer
guagaacgugucaauaaacag

SEQ ID NO: 18585 - RNA, 21 nt, Artificial Sequence
  RNA Oligomer
auugaaaacacaaugccugga

SEQ ID NO: 18586 - RNA, 21 nt, Artificial Sequence
  RNA Oligomer
aaaacacaaugccuggacuug

SEQ ID NO: 18587 - RNA, 21 nt, Artificial Sequence
  RNA Oligomer
aaacacaaugccuggacuuga

SEQ ID NO: 18588 - RNA, 21 nt, Artificial Sequence
  RNA Oligomer
acacaaugccuggacuugacc

SEQ ID NO: 18589 - RNA, 21 nt, Artificial Sequence
  RNA Oligomer
cacgucaguauuuucguccca

SEQ ID NO: 18590 - RNA, 21 nt, Artificial Sequence
  RNA Oligomer
cucaaaagcucuugcaucccg

SEQ ID NO: 18591 - RNA, 21 nt, Artificial Sequence
  RNA Oligomer
aauacaccuugcucagcuuca

SEQ ID NO: 18592 - RNA, 21 nt, Artificial Sequence
  RNA Oligomer
acaugcauacaagaccacagg

SEQ ID NO: 18593 - RNA, 21 nt, Artificial Sequence
  RNA Oligomer
cuuguugcucuucggcuguca

SEQ ID NO: 18594 - RNA, 21 nt, Artificial Sequence
  RNA Oligomer
aaauccauuuccaagccgagg

SEQ ID NO: 18595 - RNA, 21 nt, Artificial Sequence
  RNA Oligomer
cuacagaaggugauguugugc

SEQ ID NO: 18596 - RNA, 21 nt, Artificial Sequence
  RNA Oligomer
auacaaguggcacaucuuuug

SEQ ID NO: 18597 - RNA, 21 nt, Artificial Sequence
  RNA Oligomer
uacaccuugcucagcuucagu

SEQ ID NO: 18598 - RNA, 21 nt, Artificial Sequence
  RNA Oligomer
acccucauucaaaauccagca

SEQ ID NO: 18599 - RNA, 21 nt, Artificial Sequence
  RNA Oligomer
ugguggagagacccucauuca

SEQ ID NO: 18600 - RNA, 21 nt, Artificial Sequence
  RNA Oligomer
aauccaguagaaauacaccuu

SEQ ID NO: 18601 - RNA, 21 nt, Artificial Sequence
  RNA Oligomer
aagaagacgaugaaaacaugg

SEQ ID NO: 18602 - RNA, 21 nt, Artificial Sequence
  RNA Oligomer
guguaauggaaagacuccucc

SEQ ID NO: 18603 - RNA, 21 nt, Artificial Sequence
  RNA Oligomer
uagaacgugucaauaaacaga

SEQ ID NO: 18604 - RNA, 21 nt, Artificial Sequence
  RNA Oligomer
augaauacaaguggcacaucu

SEQ ID NO: 18605 - RNA, 21 nt, Artificial Sequence
  RNA Oligomer
uugaacucauuguuccaguug

SEQ ID NO: 18606 - RNA, 21 nt, Artificial Sequence
  RNA Oligomer
uaaagcuaugugaagagccug

SEQ ID NO: 18607 - RNA, 21 nt, Artificial Sequence
  RNA Oligomer
aucccggcaaauccaguagaa

SEQ ID NO: 18608 - RNA, 21 nt, Artificial Sequence
  RNA Oligomer
uaguaagggcuucccuaguaa

SEQ ID NO: 18609 - RNA, 21 nt, Artificial Sequence
  RNA Oligomer
aagacgaugaaaacauggugu

SEQ ID NO: 18610 - RNA, 21 nt, Artificial Sequence
  RNA Oligomer
gucccaguguaaagcuaugug

SEQ ID NO: 18611 - RNA, 21 nt, Artificial Sequence
  RNA Oligomer
uuuuaaagccacgcuuuuuca

SEQ ID NO: 18612 - RNA, 21 nt, Artificial Sequence
  RNA Oligomer
uacuuguugcucuucggcugu

SEQ ID NO: 18613 - RNA, 21 nt, Artificial Sequence
  RNA Oligomer
cuaaaauccauuuccaagccg

SEQ ID NO: 18614 - RNA, 21 nt, Artificial Sequence
  RNA Oligomer
acagaaggugauguugugcag

SEQ ID NO: 18615 - RNA, 21 nt, Artificial Sequence
  RNA Oligomer
uaauggaaagacuccuccucu

SEQ ID NO: 18616 - RNA, 21 nt, Artificial Sequence
  RNA Oligomer
aacucauuguuccaguugggc

SEQ ID NO: 18617 - RNA, 21 nt, Artificial Sequence
  RNA Oligomer
gaagagccugauuuucauccc

SEQ ID NO: 18618 - RNA, 21 nt, Artificial Sequence
  RNA Oligomer
ucugugccucacugcauuugu

SEQ ID NO: 18619 - RNA, 21 nt, Artificial Sequence
  RNA Oligomer
uacaucugucagggcaguucc

SEQ ID NO: 18620 - RNA, 21 nt, Artificial Sequence
  RNA Oligomer
augugcacgcugaaaaagucu

SEQ ID NO: 18621 - RNA, 21 nt, Artificial Sequence
  RNA Oligomer
acgcugaaaaagucuuccugg

SEQ ID NO: 18622 - RNA, 21 nt, Artificial Sequence
  RNA Oligomer
uguguguaccagaacaacuca

SEQ ID NO: 18623 - RNA, 21 nt, Artificial Sequence
  RNA Oligomer
uugagguagcucucguuaggg

SEQ ID NO: 18624 - RNA, 21 nt, Artificial Sequence
  RNA Oligomer
uguguaauggaaagacuccuc

SEQ ID NO: 18625 - RNA, 21 nt, Artificial Sequence
  RNA Oligomer
aaguaugguauaguguacugu

SEQ ID NO: 18626 - RNA, 21 nt, Artificial Sequence
  RNA Oligomer
acuugauugaaaacacaaugc

SEQ ID NO: 18627 - RNA, 21 nt, Artificial Sequence
  RNA Oligomer
aauagaaaugaacaccucugg

SEQ ID NO: 18628 - RNA, 21 nt, Artificial Sequence
  RNA Oligomer
ucauuguuccaguugggccuc

SEQ ID NO: 18629 - RNA, 21 nt, Artificial Sequence
  RNA Oligomer
aaagcuaugugaagagccuga

SEQ ID NO: 18630 - RNA, 21 nt, Artificial Sequence
  RNA Oligomer
uaugugaagagccugauuuuc

SEQ ID NO: 18631 - RNA, 21 nt, Artificial Sequence
  RNA Oligomer
uaagagaucagcaaaccacuc

SEQ ID NO: 18632 - RNA, 21 nt, Artificial Sequence
  RNA Oligomer
uccaguagaaauacaccuugc

SEQ ID NO: 18633 - RNA, 21 nt, Artificial Sequence
  RNA Oligomer
uacagaaggugauguugugca

SEQ ID NO: 18634 - RNA, 21 nt, Artificial Sequence
  RNA Oligomer
agagacugucuuggguuuggc

SEQ ID NO: 18635 - RNA, 21 nt, Artificial Sequence
  RNA Oligomer
gucaugaucaagacuaaagcc

SEQ ID NO: 18636 - RNA, 21 nt, Artificial Sequence
  RNA Oligomer
aacucguguguaauggaaaga

SEQ ID NO: 18637 - RNA, 21 nt, Artificial Sequence
  RNA Oligomer
acucguguguaauggaaagac

SEQ ID NO: 18638 - RNA, 21 nt, Artificial Sequence
  RNA Oligomer
uguaauggaaagacuccuccu

SEQ ID NO: 18639 - RNA, 21 nt, Artificial Sequence
  RNA Oligomer
uaugguauaguguacuguuca

SEQ ID NO: 18640 - RNA, 21 nt, Artificial Sequence
  RNA Oligomer
auagaaaugaacaccucuggg

SEQ ID NO: 18641 - RNA, 21 nt, Artificial Sequence
  RNA Oligomer
aucugcuugaacucauuguuc

SEQ ID NO: 18642 - RNA, 21 nt, Artificial Sequence
  RNA Oligomer
acucauuguuccaguugggcc

SEQ ID NO: 18643 - RNA, 21 nt, Artificial Sequence
  RNA Oligomer
uguaaagcuaugugaagagcc

SEQ ID NO: 18644 - RNA, 21 nt, Artificial Sequence
  RNA Oligomer
augugaagagccugauuuuca

SEQ ID NO: 18645 - RNA, 21 nt, Artificial Sequence
  RNA Oligomer
ugaagagccugauuuucaucc

SEQ ID NO: 18646 - RNA, 21 nt, Artificial Sequence
  RNA Oligomer
gaguaagagaucagcaaacca

SEQ ID NO: 18647 - RNA, 21 nt, Artificial Sequence
  RNA Oligomer
uggguagugaaauacaucugu

SEQ ID NO: 18648 - RNA, 21 nt, Artificial Sequence
  RNA Oligomer
caugugaaguuccaggacucc

SEQ ID NO: 18649 - RNA, 21 nt, Artificial Sequence
  RNA Oligomer
ccuaaaauccauuuccaagcc

SEQ ID NO: 18650 - RNA, 21 nt, Artificial Sequence
  RNA Oligomer
uaaaauccauuuccaagccga

SEQ ID NO: 18651 - RNA, 21 nt, Artificial Sequence
  RNA Oligomer
aaacaugguguguguaccaga

SEQ ID NO: 18652 - RNA, 21 nt, Artificial Sequence
  RNA Oligomer
uugugaaaucugagguuuuug

SEQ ID NO: 18653 - RNA, 21 nt, Artificial Sequence
  RNA Oligomer
aaauaacucguguguaaugga

SEQ ID NO: 18654 - RNA, 21 nt, Artificial Sequence
  RNA Oligomer
auggaaagacuccuccucuuc

SEQ ID NO: 18655 - RNA, 21 nt, Artificial Sequence
  RNA Oligomer
cuugauugaaaacacaaugcc

SEQ ID NO: 18656 - RNA, 21 nt, Artificial Sequence
  RNA Oligomer
uugauugaaaacacaaugccu

SEQ ID NO: 18657 - RNA, 21 nt, Artificial Sequence
  RNA Oligomer
acaucuuuugaaguguccucg

SEQ ID NO: 18658 - RNA, 21 nt, Artificial Sequence
  RNA Oligomer
augagaguacuaauauggugg

SEQ ID NO: 18659 - RNA, 21 nt, Artificial Sequence
  RNA Oligomer
uucugcuuuaagccuguaauc

SEQ ID NO: 18660 - RNA, 21 nt, Artificial Sequence
  RNA Oligomer
uuuucaucccagccgguaaga

SEQ ID NO: 18661 - RNA, 21 nt, Artificial Sequence
  RNA Oligomer
acacacuggguagugaaauac

SEQ ID NO: 18662 - RNA, 21 nt, Artificial Sequence
  RNA Oligomer
uuuuucaugugaaguuccagg

SEQ ID NO: 18663 - RNA, 21 nt, Artificial Sequence
  RNA Oligomer
uccuugccagaaaauugaggc

SEQ ID NO: 18664 - RNA, 21 nt, Artificial Sequence
  RNA Oligomer
auggccaggcugagaaagaag

SEQ ID NO: 18665 - RNA, 21 nt, Artificial Sequence
  RNA Oligomer
agacgaugaaaacauggugug

SEQ ID NO: 18666 - RNA, 21 nt, Artificial Sequence
  RNA Oligomer
uaaaauucaggcacagugcgg

SEQ ID NO: 18667 - RNA, 21 nt, Artificial Sequence
  RNA Oligomer
uaagcuaaggaaguaugguau

SEQ ID NO: 18668 - RNA, 21 nt, Artificial Sequence
  RNA Oligomer
uugaccuccaaagucuagaag

SEQ ID NO: 18669 - RNA, 21 nt, Artificial Sequence
  RNA Oligomer
uuguaggcaaucugcuugaac

SEQ ID NO: 18670 - RNA, 21 nt, Artificial Sequence
  RNA Oligomer
cugcuugaacucauuguucca

SEQ ID NO: 18671 - RNA, 21 nt, Artificial Sequence
  RNA Oligomer
gaacucauuguuccaguuggg

SEQ ID NO: 18672 - RNA, 21 nt, Artificial Sequence
  RNA Oligomer
gugaagagccugauuuucauc

SEQ ID NO: 18673 - RNA, 21 nt, Artificial Sequence
  RNA Oligomer
ugcucacucauccguguuucc

SEQ ID NO: 18674 - RNA, 21 nt, Artificial Sequence
  RNA Oligomer
gugcacgcugaaaaagucuuc

SEQ ID NO: 18675 - RNA, 21 nt, Artificial Sequence
  RNA Oligomer
cuuuuucaugugaaguuccag

SEQ ID NO: 18676 - RNA, 21 nt, Artificial Sequence
  RNA Oligomer
uuucaugugaaguuccaggac

SEQ ID NO: 18677 - RNA, 21 nt, Artificial Sequence
  RNA Oligomer
gacaacuucuuguugaaaucg

SEQ ID NO: 18678 - RNA, 21 nt, Artificial Sequence
  RNA Oligomer
uuccuugccagaaaauugagg

SEQ ID NO: 18679 - RNA, 21 nt, Artificial Sequence
  RNA Oligomer
uugccagaaaauugaggcacg

SEQ ID NO: 18680 - RNA, 21 nt, Artificial Sequence
  RNA Oligomer
augaaaacaugguguguguac

SEQ ID NO: 18681 - RNA, 21 nt, Artificial Sequence
  RNA Oligomer
cuauuguccuuagcaauucag

SEQ ID NO: 18682 - RNA, 21 nt, Artificial Sequence
  RNA Oligomer
uuagcaauucagugguugugu

SEQ ID NO: 18683 - RNA, 21 nt, Artificial Sequence
  RNA Oligomer
gugaaaucugagguuuuuguc

SEQ ID NO: 18684 - RNA, 21 nt, Artificial Sequence
  RNA Oligomer
ucugcagcaaauacuuguucc

SEQ ID NO: 18685 - RNA, 21 nt, Artificial Sequence
  RNA Oligomer
auaguguacuguucacaauag

SEQ ID NO: 18686 - RNA, 21 nt, Artificial Sequence
  RNA Oligomer
auuuauucccagccaugagag

SEQ ID NO: 18687 - RNA, 21 nt, Artificial Sequence
  RNA Oligomer
ugaaguguccucgagagagcu

SEQ ID NO: 18688 - RNA, 21 nt, Artificial Sequence
  RNA Oligomer
gggugauuguaggcaaucugc

SEQ ID NO: 18689 - RNA, 21 nt, Artificial Sequence
  RNA Oligomer
auuguaggcaaucugcuugaa

SEQ ID NO: 18690 - RNA, 21 nt, Artificial Sequence
  RNA Oligomer
cucccauagaaggucuucugc

SEQ ID NO: 18691 - RNA, 21 nt, Artificial Sequence
  RNA Oligomer
aauaugguggagagacccuca

SEQ ID NO: 18692 - RNA, 21 nt, Artificial Sequence
  RNA Oligomer
ucccaguguaaagcuauguga

SEQ ID NO: 18693 - RNA, 21 nt, Artificial Sequence
  RNA Oligomer
caaauccaguagaaauacacc

SEQ ID NO: 18694 - RNA, 21 nt, Artificial Sequence
  RNA Oligomer
ugugccucacugcauuuguac

SEQ ID NO: 18695 - RNA, 21 nt, Artificial Sequence
  RNA Oligomer
auuuuaaagccacgcuuuuuc

SEQ ID NO: 18696 - RNA, 21 nt, Artificial Sequence
  RNA Oligomer
aacuucuuguugaaaucgcca

SEQ ID NO: 18697 - RNA, 21 nt, Artificial Sequence
  RNA Oligomer
auacuuguugcucuucggcug

SEQ ID NO: 18698 - RNA, 21 nt, Artificial Sequence
  RNA Oligomer
uugugcagagagagacugucu

SEQ ID NO: 18699 - RNA, 21 nt, Artificial Sequence
  RNA Oligomer
uaccagaacaacucauaggag

SEQ ID NO: 18700 - RNA, 21 nt, Artificial Sequence
  RNA Oligomer
augaacucaguugacgagguc

SEQ ID NO: 18701 - RNA, 21 nt, Artificial Sequence
  RNA Oligomer
aacucaguugacgaggucaug

SEQ ID NO: 18702 - RNA, 21 nt, Artificial Sequence
  RNA Oligomer
uuguccuuagcaauucagugg

SEQ ID NO: 18703 - RNA, 21 nt, Artificial Sequence
  RNA Oligomer
aagaaaugcgccacgaugugg

SEQ ID NO: 18704 - RNA, 21 nt, Artificial Sequence
  RNA Oligomer
cauuaacagcuaucccauagg

SEQ ID NO: 18705 - RNA, 21 nt, Artificial Sequence
  RNA Oligomer
gaccaguuugugaaaucugag

SEQ ID NO: 18706 - RNA, 21 nt, Artificial Sequence
  RNA Oligomer
ucguguguaauggaaagacuc

SEQ ID NO: 18707 - RNA, 21 nt, Artificial Sequence
  RNA Oligomer
gaaguaugguauaguguacug

SEQ ID NO: 18708 - RNA, 21 nt, Artificial Sequence
  RNA Oligomer
uaguguacuguucacaauagu

SEQ ID NO: 18709 - RNA, 21 nt, Artificial Sequence
  RNA Oligomer
ugagaguacuaauauggugga

SEQ ID NO: 18710 - RNA, 21 nt, Artificial Sequence
  RNA Oligomer
gagaguacuaauaugguggag

SEQ ID NO: 18711 - RNA, 21 nt, Artificial Sequence
  RNA Oligomer
uaauaugguggagagacccuc

SEQ ID NO: 18712 - RNA, 21 nt, Artificial Sequence
  RNA Oligomer
guguaaagcuaugugaagagc

SEQ ID NO: 18713 - RNA, 21 nt, Artificial Sequence
  RNA Oligomer
agccugauuuucaucccagcc

SEQ ID NO: 18714 - RNA, 21 nt, Artificial Sequence
  RNA Oligomer
augguggagagacccucauuc

SEQ ID NO: 18715 - RNA, 21 nt, Artificial Sequence
  RNA Oligomer
uaacucagaaagugaguuuuc

SEQ ID NO: 18716 - RNA, 21 nt, Artificial Sequence
  RNA Oligomer
aaauccaguagaaauacaccu

SEQ ID NO: 18717 - RNA, 21 nt, Artificial Sequence
  RNA Oligomer
cuggguagugaaauacaucug

SEQ ID NO: 18718 - RNA, 21 nt, Artificial Sequence
  RNA Oligomer
uuuucaugugaaguuccagga

SEQ ID NO: 18719 - RNA, 21 nt, Artificial Sequence
  RNA Oligomer
cagggccuaaaauccauuucc

SEQ ID NO: 18720 - RNA, 21 nt, Artificial Sequence
  RNA Oligomer
gaagacgaugaaaacauggug

SEQ ID NO: 18721 - RNA, 21 nt, Artificial Sequence
  RNA Oligomer
gacgaugaaaacauggugugu

SEQ ID NO: 18722 - RNA, 21 nt, Artificial Sequence
  RNA Oligomer
agaacaacucauaggaggccu

SEQ ID NO: 18723 - RNA, 21 nt, Artificial Sequence
  RNA Oligomer
aaauaagguuucgacugacag

SEQ ID NO: 18724 - RNA, 21 nt, Artificial Sequence
  RNA Oligomer
uauucaccaguucccaacugg

SEQ ID NO: 18725 - RNA, 21 nt, Artificial Sequence
  RNA Oligomer
aucuuuugaaguguccucgag

SEQ ID NO: 18726 - RNA, 21 nt, Artificial Sequence
  RNA Oligomer
uuuugaaguguccucgagaga

SEQ ID NO: 18727 - RNA, 21 nt, Artificial Sequence
  RNA Oligomer
uguccucgagagagcuuuagg

SEQ ID NO: 18728 - RNA, 21 nt, Artificial Sequence
  RNA Oligomer
gaguacuaauaugguggagag

SEQ ID NO: 18729 - RNA, 21 nt, Artificial Sequence
  RNA Oligomer
acuaauaugguggagagaccc

SEQ ID NO: 18730 - RNA, 21 nt, Artificial Sequence
  RNA Oligomer
augauaacucagaaagugagu

SEQ ID NO: 18731 - RNA, 21 nt, Artificial Sequence
  RNA Oligomer
cacucaaaagcucuugcaucc

SEQ ID NO: 18732 - RNA, 21 nt, Artificial Sequence
  RNA Oligomer
caguagaaauacaccuugcuc

SEQ ID NO: 18733 - RNA, 21 nt, Artificial Sequence
  RNA Oligomer
guagugaaauacaucugucag

SEQ ID NO: 18734 - RNA, 21 nt, Artificial Sequence
  RNA Oligomer
cacgcugaaaaagucuuccug

SEQ ID NO: 18735 - RNA, 21 nt, Artificial Sequence
  RNA Oligomer
uuuaaagccacgcuuuuucau

SEQ ID NO: 18736 - RNA, 21 nt, Artificial Sequence
  RNA Oligomer
acgcuuuuucaugugaaguuc

SEQ ID NO: 18737 - RNA, 21 nt, Artificial Sequence
  RNA Oligomer
cgcuuuuucaugugaaguucc

SEQ ID NO: 18738 - RNA, 21 nt, Artificial Sequence
  RNA Oligomer
uuguugcucuucggcugucag

SEQ ID NO: 18739 - RNA, 21 nt, Artificial Sequence
  RNA Oligomer
auuuccaagccgaggguuccu

SEQ ID NO: 18740 - RNA, 21 nt, Artificial Sequence
  RNA Oligomer
cuugccagaaaauugaggcac

SEQ ID NO: 18741 - RNA, 21 nt, Artificial Sequence
  RNA Oligomer
ugccagaaaauugaggcacgg

SEQ ID NO: 18742 - RNA, 21 nt, Artificial Sequence
  RNA Oligomer
gugcagagagagacugucuug

SEQ ID NO: 18743 - RNA, 21 nt, Artificial Sequence
  RNA Oligomer
cagaacaacucauaggaggcc

SEQ ID NO: 18744 - RNA, 21 nt, Artificial Sequence
  RNA Oligomer
ugugucuggauguugggucgu

SEQ ID NO: 18745 - RNA, 21 nt, Artificial Sequence
  RNA Oligomer
aaugaaauaagguuucgacug

SEQ ID NO: 18746 - RNA, 21 nt, Artificial Sequence
  RNA Oligomer
uuaaaauucaggcacagugcg

SEQ ID NO: 18747 - RNA, 21 nt, Artificial Sequence
  RNA Oligomer
augguauaguguacuguucac

SEQ ID NO: 18748 - RNA, 21 nt, Artificial Sequence
  RNA Oligomer
auucaccaguucccaacuggg

SEQ ID NO: 18749 - RNA, 21 nt, Artificial Sequence
  RNA Oligomer
uacaaguggcacaucuuuuga

SEQ ID NO: 18750 - RNA, 21 nt, Artificial Sequence
  RNA Oligomer
uuugaaguguccucgagagag

SEQ ID NO: 18751 - RNA, 21 nt, Artificial Sequence
  RNA Oligomer
uugaaguguccucgagagagc

SEQ ID NO: 18752 - RNA, 21 nt, Artificial Sequence
  RNA Oligomer
uccucgagagagcuuuagguc

SEQ ID NO: 18753 - RNA, 21 nt, Artificial Sequence
  RNA Oligomer
ucugcuugaacucauuguucc

SEQ ID NO: 18754 - RNA, 21 nt, Artificial Sequence
  RNA Oligomer
ugaacucauuguuccaguugg

SEQ ID NO: 18755 - RNA, 21 nt, Artificial Sequence
  RNA Oligomer
cugcucacucauccguguuuc

SEQ ID NO: 18756 - RNA, 21 nt, Artificial Sequence
  RNA Oligomer
aaaagcucuugcaucccggca

SEQ ID NO: 18757 - RNA, 21 nt, Artificial Sequence
  RNA Oligomer
agagacccucauucaaaaucc

SEQ ID NO: 18758 - RNA, 21 nt, Artificial Sequence
  RNA Oligomer
uuaaagccacgcuuuuucaug

SEQ ID NO: 18759 - RNA, 21 nt, Artificial Sequence
  RNA Oligomer
aaagccacgcuuuuucaugug

SEQ ID NO: 18760 - RNA, 21 nt, Artificial Sequence
  RNA Oligomer
aagccacgcuuuuucauguga

SEQ ID NO: 18761 - RNA, 21 nt, Artificial Sequence
  RNA Oligomer
ugucugccauucugcauagcg

SEQ ID NO: 18762 - RNA, 21 nt, Artificial Sequence
  RNA Oligomer
ccagaacaacucauaggaggc

SEQ ID NO: 18763 - RNA, 21 nt, Artificial Sequence
  RNA Oligomer
aacucauaggaggccugucug

SEQ ID NO: 18764 - RNA, 21 nt, Artificial Sequence
  RNA Oligomer
uauuguccuuagcaauucagu

SEQ ID NO: 18765 - RNA, 21 nt, Artificial Sequence
  RNA Oligomer
uccagguugaagaaaugcgcc

SEQ ID NO: 18766 - RNA, 21 nt, Artificial Sequence
  RNA Oligomer
auguggaugguugcauuaaca

SEQ ID NO: 18767 - RNA, 21 nt, Artificial Sequence
  RNA Oligomer
ccucuuaugaaugaaauaagg

SEQ ID NO: 18768 - RNA, 21 nt, Artificial Sequence
  RNA Oligomer
aauaagguuucgacugacagg

SEQ ID NO: 18769 - RNA, 21 nt, Artificial Sequence
  RNA Oligomer
uaagguuucgacugacaggua

SEQ ID NO: 18770 - RNA, 21 nt, Artificial Sequence
  RNA Oligomer
guucuguuguauaugacaugu

SEQ ID NO: 18771 - RNA, 21 nt, Artificial Sequence
  RNA Oligomer
uauaagcuaaggaaguauggu

SEQ ID NO: 18772 - RNA, 21 nt, Artificial Sequence
  RNA Oligomer
gauugaaaacacaaugccugg

SEQ ID NO: 18773 - RNA, 21 nt, Artificial Sequence
  RNA Oligomer
gccaugagaguacuaauaugg

SEQ ID NO: 18774 - RNA, 21 nt, Artificial Sequence
  RNA Oligomer
uaggcaaucugcuugaacuca

SEQ ID NO: 18775 - RNA, 21 nt, Artificial Sequence
  RNA Oligomer
uucgucccaguguaaagcuau

SEQ ID NO: 18776 - RNA, 21 nt, Artificial Sequence
  RNA Oligomer
uaugauaacucagaaagugag

SEQ ID NO: 18777 - RNA, 21 nt, Artificial Sequence
  RNA Oligomer
aacucagaaagugaguuuucc

SEQ ID NO: 18778 - RNA, 21 nt, Artificial Sequence
  RNA Oligomer
acucagaaagugaguuuuccc

SEQ ID NO: 18779 - RNA, 21 nt, Artificial Sequence
  RNA Oligomer
aaccacucaaaagcucuugca

SEQ ID NO: 18780 - RNA, 21 nt, Artificial Sequence
  RNA Oligomer
agagagacugucuuggguuug

SEQ ID NO: 18781 - RNA, 21 nt, Artificial Sequence
  RNA Oligomer
uuuggccucgaacaauccgac

SEQ ID NO: 18782 - RNA, 21 nt, Artificial Sequence
  RNA Oligomer
gaaaacaugguguguguacca

SEQ ID NO: 18783 - RNA, 21 nt, Artificial Sequence
  RNA Oligomer
aaaacaugguguguguaccag

SEQ ID NO: 18784 - RNA, 21 nt, Artificial Sequence
  RNA Oligomer
cugucaggaaauuucuucucc

SEQ ID NO: 18785 - RNA, 21 nt, Artificial Sequence
  RNA Oligomer
ugacgaggucaugaucaagac

SEQ ID NO: 18786 - RNA, 21 nt, Artificial Sequence
  RNA Oligomer
auuguccuuagcaauucagug

SEQ ID NO: 18787 - RNA, 21 nt, Artificial Sequence
  RNA Oligomer
uguggaugguugcauuaacag

SEQ ID NO: 18788 - RNA, 21 nt, Artificial Sequence
  RNA Oligomer
gguuuuugucuaauugccucc

SEQ ID NO: 18789 - RNA, 21 nt, Artificial Sequence
  RNA Oligomer
uucgacugacagguauuagaa

SEQ ID NO: 18790 - RNA, 21 nt, Artificial Sequence
  RNA Oligomer
uagcaugcaguuaaaauucag

SEQ ID NO: 18791 - RNA, 21 nt, Artificial Sequence
  RNA Oligomer
augcaguuaaaauucaggcac

SEQ ID NO: 18792 - RNA, 21 nt, Artificial Sequence
  RNA Oligomer
uucaccaguucccaacuggga

SEQ ID NO: 18793 - RNA, 21 nt, Artificial Sequence
  RNA Oligomer
ggcacaucuuuugaagugucc

SEQ ID NO: 18794 - RNA, 21 nt, Artificial Sequence
  RNA Oligomer
gauuguaggcaaucugcuuga

SEQ ID NO: 18795 - RNA, 21 nt, Artificial Sequence
  RNA Oligomer
guaggcaaucugcuugaacuc

SEQ ID NO: 18796 - RNA, 21 nt, Artificial Sequence
  RNA Oligomer
uuccagggagaguaagagauc

SEQ ID NO: 18797 - RNA, 21 nt, Artificial Sequence
  RNA Oligomer
cacugcaccaagauguacugc

SEQ ID NO: 18798 - RNA, 21 nt, Artificial Sequence
  RNA Oligomer
acagggccuaaaauccauuuc

SEQ ID NO: 18799 - RNA, 21 nt, Artificial Sequence
  RNA Oligomer
auucugcauagcggucucuac

SEQ ID NO: 18800 - RNA, 21 nt, Artificial Sequence
  RNA Oligomer
cugucugaugaacucaguuga

SEQ ID NO: 18801 - RNA, 21 nt, Artificial Sequence
  RNA Oligomer
cagguugaagaaaugcgccac

SEQ ID NO: 18802 - RNA, 21 nt, Artificial Sequence
  RNA Oligomer
ugguugcauuaacagcuaucc

SEQ ID NO: 18803 - RNA, 21 nt, Artificial Sequence
  RNA Oligomer
aacagcuaucccauaggcgac

SEQ ID NO: 18804 - RNA, 21 nt, Artificial Sequence
  RNA Oligomer
auaagguuucgacugacaggu

SEQ ID NO: 18805 - RNA, 21 nt, Artificial Sequence
  RNA Oligomer
acugacagguauuagaauuag

SEQ ID NO: 18806 - RNA, 21 nt, Artificial Sequence
  RNA Oligomer
aaaauucaggcacagugcgga

SEQ ID NO: 18807 - RNA, 21 nt, Artificial Sequence
  RNA Oligomer
ugaccuccaaagucuagaagc

SEQ ID NO: 18808 - RNA, 21 nt, Artificial Sequence
  RNA Oligomer
ucagcugaugaauacaagugg

SEQ ID NO: 18809 - RNA, 21 nt, Artificial Sequence
  RNA Oligomer
guggcacaucuuuugaagugu

SEQ ID NO: 18810 - RNA, 21 nt, Artificial Sequence
  RNA Oligomer
uggcacaucuuuugaaguguc

SEQ ID NO: 18811 - RNA, 21 nt, Artificial Sequence
  RNA Oligomer
uacuaauaugguggagagacc

SEQ ID NO: 18812 - RNA, 21 nt, Artificial Sequence
  RNA Oligomer
cugauuuucaucccagccggu

SEQ ID NO: 18813 - RNA, 21 nt, Artificial Sequence
  RNA Oligomer
acuccagcgaagauauggcug

SEQ ID NO: 18814 - RNA, 21 nt, Artificial Sequence
  RNA Oligomer
uaaagccacgcuuuuucaugu

SEQ ID NO: 18815 - RNA, 21 nt, Artificial Sequence
  RNA Oligomer
caacuucuuguugaaaucgcc

SEQ ID NO: 18816 - RNA, 21 nt, Artificial Sequence
  RNA Oligomer
auccauuuccaagccgagggu

SEQ ID NO: 18817 - RNA, 21 nt, Artificial Sequence
  RNA Oligomer
acugucugccauucugcauag

SEQ ID NO: 18818 - RNA, 21 nt, Artificial Sequence
  RNA Oligomer
uagcggucucuacagaaggug

SEQ ID NO: 18819 - RNA, 21 nt, Artificial Sequence
  RNA Oligomer
ugaugaacucaguugacgagg

SEQ ID NO: 18820 - RNA, 21 nt, Artificial Sequence
  RNA Oligomer
uugcauuaacagcuaucccau

SEQ ID NO: 18821 - RNA, 21 nt, Artificial Sequence
  RNA Oligomer
ugaaaucugagguuuuugucu

SEQ ID NO: 18822 - RNA, 21 nt, Artificial Sequence
  RNA Oligomer
gagguuuuugucuaauugccu

SEQ ID NO: 18823 - RNA, 21 nt, Artificial Sequence
  RNA Oligomer
ucuaauugccuccuccacggu

SEQ ID NO: 18824 - RNA, 21 nt, Artificial Sequence
  RNA Oligomer
guuucgacugacagguauuag

SEQ ID NO: 18825 - RNA, 21 nt, Artificial Sequence
  RNA Oligomer
guugggucguuaguaagggcu

SEQ ID NO: 18826 - RNA, 21 nt, Artificial Sequence
  RNA Oligomer
gucguuaguaagggcuucccu

SEQ ID NO: 18827 - RNA, 21 nt, Artificial Sequence
  RNA Oligomer
ccaugagaguacuaauauggu

SEQ ID NO: 18828 - RNA, 21 nt, Artificial Sequence
  RNA Oligomer
uaagccuguaaucacgucagu

SEQ ID NO: 18829 - RNA, 21 nt, Artificial Sequence
  RNA Oligomer
gauaacucagaaagugaguuu

SEQ ID NO: 18830 - RNA, 21 nt, Artificial Sequence
  RNA Oligomer
cacuccagcgaagauauggcu

SEQ ID NO: 18831 - RNA, 21 nt, Artificial Sequence
  RNA Oligomer
auacaagaccacagggccuaa

SEQ ID NO: 18832 - RNA, 21 nt, Artificial Sequence
  RNA Oligomer
cugucugccauucugcauagc

SEQ ID NO: 18833 - RNA, 21 nt, Artificial Sequence
  RNA Oligomer
uguugugcagagagagacugu

SEQ ID NO: 18834 - RNA, 21 nt, Artificial Sequence
  RNA Oligomer
agguugaagaaaugcgccacg

SEQ ID NO: 18835 - RNA, 21 nt, Artificial Sequence
  RNA Oligomer
cucugcagcaaauacuuguuc

SEQ ID NO: 18836 - RNA, 21 nt, Artificial Sequence
  RNA Oligomer
cugacagguauuagaauuagc

SEQ ID NO: 18837 - RNA, 21 nt, Artificial Sequence
  RNA Oligomer
aaauucaggcacagugcggau

SEQ ID NO: 18838 - RNA, 21 nt, Artificial Sequence
  RNA Oligomer
uuauucaccaguucccaacug

SEQ ID NO: 18839 - RNA, 21 nt, Artificial Sequence
  RNA Oligomer
cugggagcucauaucaacagg

SEQ ID NO: 18840 - RNA, 21 nt, Artificial Sequence
  RNA Oligomer
uauucccagccaugagaguac

SEQ ID NO: 18841 - RNA, 21 nt, Artificial Sequence
  RNA Oligomer
aaugccuggacuugaccucca

SEQ ID NO: 18842 - RNA, 21 nt, Artificial Sequence
  RNA Oligomer
guuuccagggagaguaagaga

SEQ ID NO: 18843 - RNA, 21 nt, Artificial Sequence
  RNA Oligomer
ucagcaaaccacucaaaagcu

SEQ ID NO: 18844 - RNA, 21 nt, Artificial Sequence
  RNA Oligomer
guagaaauacaccuugcucag

SEQ ID NO: 18845 - RNA, 21 nt, Artificial Sequence
  RNA Oligomer
acugcaccaagauguacugcc

SEQ ID NO: 18846 - RNA, 21 nt, Artificial Sequence
  RNA Oligomer
uucuuguugaaaucgccagaa

SEQ ID NO: 18847 - RNA, 21 nt, Artificial Sequence
  RNA Oligomer
aauccauuuccaagccgaggg

SEQ ID NO: 18848 - RNA, 21 nt, Artificial Sequence
  RNA Oligomer
agcggucucuacagaagguga

SEQ ID NO: 18849 - RNA, 21 nt, Artificial Sequence
  RNA Oligomer
ugcagagagagacugucuugg

SEQ ID NO: 18850 - RNA, 21 nt, Artificial Sequence
  RNA Oligomer
ugucugaugaacucaguugac

SEQ ID NO: 18851 - RNA, 21 nt, Artificial Sequence
  RNA Oligomer
ugaacucaguugacgagguca

SEQ ID NO: 18852 - RNA, 21 nt, Artificial Sequence
  RNA Oligomer
gacgccugcuauuguccuuag

SEQ ID NO: 18853 - RNA, 21 nt, Artificial Sequence
  RNA Oligomer
acgccugcuauuguccuuagc

SEQ ID NO: 18854 - RNA, 21 nt, Artificial Sequence
  RNA Oligomer
gguugcauuaacagcuauccc

SEQ ID NO: 18855 - RNA, 21 nt, Artificial Sequence
  RNA Oligomer
ugagguuuuugucuaauugcc

SEQ ID NO: 18856 - RNA, 21 nt, Artificial Sequence
  RNA Oligomer
ugcagcaaauacuuguuccuc

SEQ ID NO: 18857 - RNA, 21 nt, Artificial Sequence
  RNA Oligomer
augaaauaagguuucgacuga

SEQ ID NO: 18858 - RNA, 21 nt, Artificial Sequence
  RNA Oligomer
auucccagccaugagaguacu

SEQ ID NO: 18859 - RNA, 21 nt, Artificial Sequence
  RNA Oligomer
gaaauacaucugucagggcag

SEQ ID NO: 18860 - RNA, 21 nt, Artificial Sequence
  RNA Oligomer
aagauauggcugggcacugca

SEQ ID NO: 18861 - RNA, 21 nt, Artificial Sequence
  RNA Oligomer
acaacuucuuguugaaaucgc

SEQ ID NO: 18862 - RNA, 21 nt, Artificial Sequence
  RNA Oligomer
ucugaugaacucaguugacga

SEQ ID NO: 18863 - RNA, 21 nt, Artificial Sequence
  RNA Oligomer
augguugcauuaacagcuauc

SEQ ID NO: 18864 - RNA, 21 nt, Artificial Sequence
  RNA Oligomer
ugaaugaaauaagguuucgac

SEQ ID NO: 18865 - RNA, 21 nt, Artificial Sequence
  RNA Oligomer
ugaaauaagguuucgacugac

SEQ ID NO: 18866 - RNA, 21 nt, Artificial Sequence
  RNA Oligomer
auaucaacaggccgucacagg

SEQ ID NO: 18867 - RNA, 21 nt, Artificial Sequence
  RNA Oligomer
gagacccucauucaaaaucca

SEQ ID NO: 18868 - RNA, 21 nt, Artificial Sequence
  RNA Oligomer
agggccuaaaauccauuucca

SEQ ID NO: 18869 - RNA, 21 nt, Artificial Sequence
  RNA Oligomer
auagcggucucuacagaaggu

SEQ ID NO: 18870 - RNA, 21 nt, Artificial Sequence
  RNA Oligomer
cugcagcaaauacuuguuccu

SEQ ID NO: 18871 - RNA, 21 nt, Artificial Sequence
  RNA Oligomer
uucccagccaugagaguacua

SEQ ID NO: 18872 - RNA, 21 nt, Artificial Sequence
  RNA Oligomer
ucgagagagcuuuagguccac

SEQ ID NO: 18873 - RNA, 21 nt, Artificial Sequence
  RNA Oligomer
auagaaggucuucugcuuuaa

SEQ ID NO: 18874 - RNA, 21 nt, Artificial Sequence
  RNA Oligomer
uagaaggucuucugcuuuaag

SEQ ID NO: 18875 - RNA, 21 nt, Artificial Sequence
  RNA Oligomer
gaaggucuucugcuuuaagcc

SEQ ID NO: 18876 - RNA, 21 nt, Artificial Sequence
  RNA Oligomer
ucugccauucugcauagcggu

SEQ ID NO: 18877 - RNA, 21 nt, Artificial Sequence
  RNA Oligomer
ugucaggaaauuucuucuccc

SEQ ID NO: 18878 - RNA, 21 nt, Artificial Sequence
  RNA Oligomer
cuuuagguccacagaagaaca

SEQ ID NO: 18879 - RNA, 21 nt, Artificial Sequence
  RNA Oligomer
ugcaccaagauguacugcccu

SEQ ID NO: 18880 - RNA, 21 nt, Artificial Sequence
  RNA Oligomer
agaccacagggccuaaaaucc

SEQ ID NO: 18881 - RNA, 21 nt, Artificial Sequence
  RNA Oligomer
gucaggaaauuucuucucccu

SEQ ID NO: 18882 - RNA, 21 nt, Artificial Sequence
  RNA Oligomer
auaggaggccugucugaugaa

SEQ ID NO: 18883 - RNA, 21 nt, Artificial Sequence
  RNA Oligomer
gaggccugucugaugaacuca

SEQ ID NO: 18884 - RNA, 21 nt, Artificial Sequence
  RNA Oligomer
ucaggaaauuucuucucccuc

SEQ ID NO: 18885 - RNA, 21 nt, Artificial Sequence
  RNA Oligomer
auuaacagcuaucccauaggc

SEQ ID NO: 18886 - RNA, 21 nt, Artificial Sequence
  RNA Oligomer
uuaacagcuaucccauaggcg

SEQ ID NO: 18887 - RNA, 21 nt, Artificial Sequence
  RNA Oligomer
agcugaugaauacaaguggca

SEQ ID NO: 18888 - RNA, 21 nt, Artificial Sequence
  RNA Oligomer
aaggucuucugcuuuaagccu

SEQ ID NO: 18889 - RNA, 21 nt, Artificial Sequence
  RNA Oligomer
gaaugaaauaagguuucgacu

SEQ ID NO: 18890 - RNA, 21 nt, Artificial Sequence
  RNA Oligomer
cucaccugugucuggauguug

SEQ ID NO: 18891 - RNA, 21 nt, Artificial Sequence
  RNA Oligomer
ucaccugugucuggauguugg

SEQ ID NO: 18892 - RNA, 21 nt, Artificial Sequence
  RNA Oligomer
uaacagcuaucccauaggcga

SEQ ID NO: 18893 - RNA, 21 nt, Artificial Sequence
  RNA Oligomer
gguaaugacaacuucuuguug

SEQ ID NO: 18894 - RNA, 21 nt, Artificial Sequence
  RNA Oligomer
gcugucaggaaauuucuucuc

SEQ ID NO: 18895 - RNA, 21 nt, Artificial Sequence
  RNA Oligomer
aagagaucagcaaaccacuca

SEQ ID NO: 18896 - RNA, 21 nt, Artificial Sequence
  RNA Oligomer
guaaugacaacuucuuguuga

SEQ ID NO: 18897 - RNA, 21 nt, Artificial Sequence
  RNA Oligomer
ggaaguggagaguaaagacag

SEQ ID NO: 18898 - RNA, 21 nt, Artificial Sequence
  RNA Oligomer
guagaaacacagaaugggacu

SEQ ID NO: 18899 - RNA, 21 nt, Artificial Sequence
  RNA Oligomer
ucguagaaacacagaauggga

SEQ ID NO: 18900 - RNA, 21 nt, Artificial Sequence
  RNA Oligomer
cgagcaacagguuggugaaaa

SEQ ID NO: 18901 - RNA, 21 nt, Artificial Sequence
  RNA Oligomer
gagcaacagguuggugaaaac

SEQ ID NO: 18902 - RNA, 21 nt, Artificial Sequence
  RNA Oligomer
ccuggagcgaucguagaaaca

SEQ ID NO: 18903 - RNA, 21 nt, Artificial Sequence
  RNA Oligomer
cccuuuggaaauccagcugca

SEQ ID NO: 18904 - RNA, 21 nt, Artificial Sequence
  RNA Oligomer
gguuggcacuucgagaaggaa

SEQ ID NO: 18905 - RNA, 21 nt, Artificial Sequence
  RNA Oligomer
ccuguguccuuggagaaagcu

SEQ ID NO: 18906 - RNA, 21 nt, Artificial Sequence
  RNA Oligomer
ggagcgaucguagaaacacag

SEQ ID NO: 18907 - RNA, 21 nt, Artificial Sequence
  RNA Oligomer
cccaaugcuauuuacauacag

SEQ ID NO: 18908 - RNA, 21 nt, Artificial Sequence
  RNA Oligomer
ccaaugcuauuuacauacagc

SEQ ID NO: 18909 - RNA, 21 nt, Artificial Sequence
  RNA Oligomer
ccuuuggaaauccagcugcag

SEQ ID NO: 18910 - RNA, 21 nt, Artificial Sequence
  RNA Oligomer
gagcgaucguagaaacacaga

SEQ ID NO: 18911 - RNA, 21 nt, Artificial Sequence
  RNA Oligomer
guccuuggagaaagcugguuc

SEQ ID NO: 18912 - RNA, 21 nt, Artificial Sequence
  RNA Oligomer
caaugcuauuuacauacagcu

SEQ ID NO: 18913 - RNA, 21 nt, Artificial Sequence
  RNA Oligomer
gggaagcccuuuggaaaucca

SEQ ID NO: 18914 - RNA, 21 nt, Artificial Sequence
  RNA Oligomer
ggaaauccagcugcagaaaca

SEQ ID NO: 18915 - RNA, 21 nt, Artificial Sequence
  RNA Oligomer
ggaagcccuuuggaaauccag

SEQ ID NO: 18916 - RNA, 21 nt, Artificial Sequence
  RNA Oligomer
gaaaacccuguguccuuggag

SEQ ID NO: 18917 - RNA, 21 nt, Artificial Sequence
  RNA Oligomer
aaacccuguguccuuggagaa

SEQ ID NO: 18918 - RNA, 21 nt, Artificial Sequence
  RNA Oligomer
gguuggugaaaacccuguguc

SEQ ID NO: 18919 - RNA, 21 nt, Artificial Sequence
  RNA Oligomer
agcgaucguagaaacacagaa

SEQ ID NO: 18920 - RNA, 21 nt, Artificial Sequence
  RNA Oligomer
uuggaaauccagcugcagaaa

SEQ ID NO: 18921 - RNA, 21 nt, Artificial Sequence
  RNA Oligomer
agcccuuuggaaauccagcug

SEQ ID NO: 18922 - RNA, 21 nt, Artificial Sequence
  RNA Oligomer
agaaagcugguucccguuuuc

SEQ ID NO: 18923 - RNA, 21 nt, Artificial Sequence
  RNA Oligomer
ggagaaagcugguucccguuu

SEQ ID NO: 18924 - RNA, 21 nt, Artificial Sequence
  RNA Oligomer
uggugaaaacccuguguccuu

SEQ ID NO: 18925 - RNA, 21 nt, Artificial Sequence
  RNA Oligomer
uggagaaagcugguucccguu

SEQ ID NO: 18926 - RNA, 21 nt, Artificial Sequence
  RNA Oligomer
agguuggugaaaacccugugu

SEQ ID NO: 18927 - RNA, 21 nt, Artificial Sequence
  RNA Oligomer
cagguuggugaaaacccugug

SEQ ID NO: 18928 - RNA, 21 nt, Artificial Sequence
  RNA Oligomer
gagaaagcugguucccguuuu

SEQ ID NO: 18929 - RNA, 21 nt, Artificial Sequence
  RNA Oligomer
cugucuuuacucuccacuucc

SEQ ID NO: 18930 - RNA, 21 nt, Artificial Sequence
  RNA Oligomer
agucccauucuguguuucuac

SEQ ID NO: 18931 - RNA, 21 nt, Artificial Sequence
  RNA Oligomer
ucccauucuguguuucuacga

SEQ ID NO: 18932 - RNA, 21 nt, Artificial Sequence
  RNA Oligomer
uuuucaccaaccuguugcucg

SEQ ID NO: 18933 - RNA, 21 nt, Artificial Sequence
  RNA Oligomer
guuuucaccaaccuguugcuc

SEQ ID NO: 18934 - RNA, 21 nt, Artificial Sequence
  RNA Oligomer
uguuucuacgaucgcuccagg

SEQ ID NO: 18935 - RNA, 21 nt, Artificial Sequence
  RNA Oligomer
ugcagcuggauuuccaaaggg

SEQ ID NO: 18936 - RNA, 21 nt, Artificial Sequence
  RNA Oligomer
uuccuucucgaagugccaacc

SEQ ID NO: 18937 - RNA, 21 nt, Artificial Sequence
  RNA Oligomer
agcuuucuccaaggacacagg

SEQ ID NO: 18938 - RNA, 21 nt, Artificial Sequence
  RNA Oligomer
cuguguuucuacgaucgcucc

SEQ ID NO: 18939 - RNA, 21 nt, Artificial Sequence
  RNA Oligomer
cuguauguaaauagcauuggg

SEQ ID NO: 18940 - RNA, 21 nt, Artificial Sequence
  RNA Oligomer
gcuguauguaaauagcauugg

SEQ ID NO: 18941 - RNA, 21 nt, Artificial Sequence
  RNA Oligomer
cugcagcuggauuuccaaagg

SEQ ID NO: 18942 - RNA, 21 nt, Artificial Sequence
  RNA Oligomer
ucuguguuucuacgaucgcuc

SEQ ID NO: 18943 - RNA, 21 nt, Artificial Sequence
  RNA Oligomer
gaaccagcuuucuccaaggac

SEQ ID NO: 18944 - RNA, 21 nt, Artificial Sequence
  RNA Oligomer
agcuguauguaaauagcauug

SEQ ID NO: 18945 - RNA, 21 nt, Artificial Sequence
  RNA Oligomer
uggauuuccaaagggcuuccc

SEQ ID NO: 18946 - RNA, 21 nt, Artificial Sequence
  RNA Oligomer
uguuucugcagcuggauuucc

SEQ ID NO: 18947 - RNA, 21 nt, Artificial Sequence
  RNA Oligomer
cuggauuuccaaagggcuucc

SEQ ID NO: 18948 - RNA, 21 nt, Artificial Sequence
  RNA Oligomer
cuccaaggacacaggguuuuc

SEQ ID NO: 18949 - RNA, 21 nt, Artificial Sequence
  RNA Oligomer
uucuccaaggacacaggguuu

SEQ ID NO: 18950 - RNA, 21 nt, Artificial Sequence
  RNA Oligomer
gacacaggguuuucaccaacc

SEQ ID NO: 18951 - RNA, 21 nt, Artificial Sequence
  RNA Oligomer
uucuguguuucuacgaucgcu

SEQ ID NO: 18952 - RNA, 21 nt, Artificial Sequence
  RNA Oligomer
uuucugcagcuggauuuccaa

SEQ ID NO: 18953 - RNA, 21 nt, Artificial Sequence
  RNA Oligomer
cagcuggauuuccaaagggcu

SEQ ID NO: 18954 - RNA, 21 nt, Artificial Sequence
  RNA Oligomer
gaaaacgggaaccagcuuucu

SEQ ID NO: 18955 - RNA, 21 nt, Artificial Sequence
  RNA Oligomer
aaacgggaaccagcuuucucc

SEQ ID NO: 18956 - RNA, 21 nt, Artificial Sequence
  RNA Oligomer
aaggacacaggguuuucacca

SEQ ID NO: 18957 - RNA, 21 nt, Artificial Sequence
  RNA Oligomer
aacgggaaccagcuuucucca

SEQ ID NO: 18958 - RNA, 21 nt, Artificial Sequence
  RNA Oligomer
acacaggguuuucaccaaccu

SEQ ID NO: 18959 - RNA, 21 nt, Artificial Sequence
  RNA Oligomer
cacaggguuuucaccaaccug

SEQ ID NO: 18960 - RNA, 21 nt, Artificial Sequence
  RNA Oligomer
aaaacgggaaccagcuuucuc

SEQ ID NO: 18961 - RNA, 21 nt, Artificial Sequence
  RNA Oligomer
ggaaaaaaucacggucacuuu

SEQ ID NO: 18962 - RNA, 21 nt, Artificial Sequence
  RNA Oligomer
gcgaaauuagugcggaaaguu

SEQ ID NO: 18963 - RNA, 21 nt, Artificial Sequence
  RNA Oligomer
ugaaugggacagaagcgaaau

SEQ ID NO: 18964 - RNA, 21 nt, Artificial Sequence
  RNA Oligomer
ggagacaaagcuuuuguugau

SEQ ID NO: 18965 - RNA, 21 nt, Artificial Sequence
  RNA Oligomer
ggaaggauacuaauuauacac

SEQ ID NO: 18966 - RNA, 21 nt, Artificial Sequence
  RNA Oligomer
gagacaaagcuuuuguugauu

SEQ ID NO: 18967 - RNA, 21 nt, Artificial Sequence
  RNA Oligomer
gaaugggacagaagcgaaauu

SEQ ID NO: 18968 - RNA, 21 nt, Artificial Sequence
  RNA Oligomer
ccaggaguacauuacuuuucu

SEQ ID NO: 18969 - RNA, 21 nt, Artificial Sequence
  RNA Oligomer
ggaguacauuacuuuucuuga

SEQ ID NO: 18970 - RNA, 21 nt, Artificial Sequence
  RNA Oligomer
caggaguacauuacuuuucuu

SEQ ID NO: 18971 - RNA, 21 nt, Artificial Sequence
  RNA Oligomer
cuaauuauacacucaacacag

SEQ ID NO: 18972 - RNA, 21 nt, Artificial Sequence
  RNA Oligomer
gucugaauggaaggauacuaa

SEQ ID NO: 18973 - RNA, 21 nt, Artificial Sequence
  RNA Oligomer
cgagucugaauggaaggauac

SEQ ID NO: 18974 - RNA, 21 nt, Artificial Sequence
  RNA Oligomer
gcgagucugaauggaaggaua

SEQ ID NO: 18975 - RNA, 21 nt, Artificial Sequence
  RNA Oligomer
cgacggagacaaagcuuuugu

SEQ ID NO: 18976 - RNA, 21 nt, Artificial Sequence
  RNA Oligomer
gaagcgaaauuagugcggaaa

SEQ ID NO: 18977 - RNA, 21 nt, Artificial Sequence
  RNA Oligomer
agaagcgaaauuagugcggaa

SEQ ID NO: 18978 - RNA, 21 nt, Artificial Sequence
  RNA Oligomer
gguugggagcuggaacugaau

SEQ ID NO: 18979 - RNA, 21 nt, Artificial Sequence
  RNA Oligomer
gaguuuugucaagagccagua

SEQ ID NO: 18980 - RNA, 21 nt, Artificial Sequence
  RNA Oligomer
caccaggaguacauuacuuuu

SEQ ID NO: 18981 - RNA, 21 nt, Artificial Sequence
  RNA Oligomer
ggacaacacuuuugcagauga

SEQ ID NO: 18982 - RNA, 21 nt, Artificial Sequence
  RNA Oligomer
guugauuuccugagugaugaa

SEQ ID NO: 18983 - RNA, 21 nt, Artificial Sequence
  RNA Oligomer
ggcgagucugaauggaaggau

SEQ ID NO: 18984 - RNA, 21 nt, Artificial Sequence
  RNA Oligomer
gacaaagcuuuuguugauuuc

SEQ ID NO: 18985 - RNA, 21 nt, Artificial Sequence
  RNA Oligomer
accgacggagacaaagcuuuu

SEQ ID NO: 18986 - RNA, 21 nt, Artificial Sequence
  RNA Oligomer
acaccgacggagacaaagcuu

SEQ ID NO: 18987 - RNA, 21 nt, Artificial Sequence
  RNA Oligomer
gggaaaaaaucacggucacuu

SEQ ID NO: 18988 - RNA, 21 nt, Artificial Sequence
  RNA Oligomer
cugaauggaaggauacuaauu

SEQ ID NO: 18989 - RNA, 21 nt, Artificial Sequence
  RNA Oligomer
ucugaauggaaggauacuaau

SEQ ID NO: 18990 - RNA, 21 nt, Artificial Sequence
  RNA Oligomer
cgugguugaaguuauaaagaa

SEQ ID NO: 18991 - RNA, 21 nt, Artificial Sequence
  RNA Oligomer
gacggagacaaagcuuuuguu

SEQ ID NO: 18992 - RNA, 21 nt, Artificial Sequence
  RNA Oligomer
gggacagaagcgaaauuagug

SEQ ID NO: 18993 - RNA, 21 nt, Artificial Sequence
  RNA Oligomer
aggaggaaagaaaaauucaga

SEQ ID NO: 18994 - RNA, 21 nt, Artificial Sequence
  RNA Oligomer
gugaugaaauuaaggaggaaa

SEQ ID NO: 18995 - RNA, 21 nt, Artificial Sequence
  RNA Oligomer
ugaagaccucaagaguuuugu

SEQ ID NO: 18996 - RNA, 21 nt, Artificial Sequence
  RNA Oligomer
ggaaguuagcuuucaguccac

SEQ ID NO: 18997 - RNA, 21 nt, Artificial Sequence
  RNA Oligomer
cggagacaaagcuuuuguuga

SEQ ID NO: 18998 - RNA, 21 nt, Artificial Sequence
  RNA Oligomer
gggcagaagguugaagaacag

SEQ ID NO: 18999 - RNA, 21 nt, Artificial Sequence
  RNA Oligomer
gagcuggaacugaaugggaca

SEQ ID NO: 19000 - RNA, 21 nt, Artificial Sequence
  RNA Oligomer
agugaugaaauuaaggaggaa

SEQ ID NO: 19001 - RNA, 21 nt, Artificial Sequence
  RNA Oligomer
cacuggcgagucugaauggaa

SEQ ID NO: 19002 - RNA, 21 nt, Artificial Sequence
  RNA Oligomer
gcuuuuguugauuuccugagu

SEQ ID NO: 19003 - RNA, 21 nt, Artificial Sequence
  RNA Oligomer
ucgugguugaaguuauaaaga

SEQ ID NO: 19004 - RNA, 21 nt, Artificial Sequence
  RNA Oligomer
caauuucgugguugaaguuau

SEQ ID NO: 19005 - RNA, 21 nt, Artificial Sequence
  RNA Oligomer
acggagacaaagcuuuuguug

SEQ ID NO: 19006 - RNA, 21 nt, Artificial Sequence
  RNA Oligomer
acauuugauggugaggaggaa

SEQ ID NO: 19007 - RNA, 21 nt, Artificial Sequence
  RNA Oligomer
cacggucacuuucaacauuaa

SEQ ID NO: 19008 - RNA, 21 nt, Artificial Sequence
  RNA Oligomer
ucacggucacuuucaacauua

SEQ ID NO: 19009 - RNA, 21 nt, Artificial Sequence
  RNA Oligomer
cgaaauuagugcggaaaguug

SEQ ID NO: 19010 - RNA, 21 nt, Artificial Sequence
  RNA Oligomer
gcuagacaugugcuuugaaau

SEQ ID NO: 19011 - RNA, 21 nt, Artificial Sequence
  RNA Oligomer
ugaugaaauuaaggaggaaag

SEQ ID NO: 19012 - RNA, 21 nt, Artificial Sequence
  RNA Oligomer
gagugaugaaauuaaggagga

SEQ ID NO: 19013 - RNA, 21 nt, Artificial Sequence
  RNA Oligomer
aggaguacauuacuuuucuug

SEQ ID NO: 19014 - RNA, 21 nt, Artificial Sequence
  RNA Oligomer
gacaucuucucuaucagggaa

SEQ ID NO: 19015 - RNA, 21 nt, Artificial Sequence
  RNA Oligomer
agguugggagcuggaacugaa

SEQ ID NO: 19016 - RNA, 21 nt, Artificial Sequence
  RNA Oligomer
agcauaaaacccucccuaaga

SEQ ID NO: 19017 - RNA, 21 nt, Artificial Sequence
  RNA Oligomer
ggaggaaagaaaaauucagaa

SEQ ID NO: 19018 - RNA, 21 nt, Artificial Sequence
  RNA Oligomer
cugagugaugaaauuaaggag

SEQ ID NO: 19019 - RNA, 21 nt, Artificial Sequence
  RNA Oligomer
gacaacacuuuugcagaugag

SEQ ID NO: 19020 - RNA, 21 nt, Artificial Sequence
  RNA Oligomer
ucagggaaguuagcuuucagu

SEQ ID NO: 19021 - RNA, 21 nt, Artificial Sequence
  RNA Oligomer
agcgaaauuagugcggaaagu

SEQ ID NO: 19022 - RNA, 21 nt, Artificial Sequence
  RNA Oligomer
gaugaaauuaaggaggaaaga

SEQ ID NO: 19023 - RNA, 21 nt, Artificial Sequence
  RNA Oligomer
uggacaacacuuuugcagaug

SEQ ID NO: 19024 - RNA, 21 nt, Artificial Sequence
  RNA Oligomer
ccuaauggauuuccuugccga

SEQ ID NO: 19025 - RNA, 21 nt, Artificial Sequence
  RNA Oligomer
gaaguuagcuuucaguccacu

SEQ ID NO: 19026 - RNA, 21 nt, Artificial Sequence
  RNA Oligomer
cuaucagggaaguuagcuuuc

SEQ ID NO: 19027 - RNA, 21 nt, Artificial Sequence
  RNA Oligomer
aaagcuuuuguugauuuccug

SEQ ID NO: 19028 - RNA, 21 nt, Artificial Sequence
  RNA Oligomer
cagaagguugaagaacaggag

SEQ ID NO: 19029 - RNA, 21 nt, Artificial Sequence
  RNA Oligomer
gcagaagguugaagaacagga

SEQ ID NO: 19030 - RNA, 21 nt, Artificial Sequence
  RNA Oligomer
ggaaagaaaaauucagaagca

SEQ ID NO: 19031 - RNA, 21 nt, Artificial Sequence
  RNA Oligomer
cauaguuucauggcaggcuuu

SEQ ID NO: 19032 - RNA, 21 nt, Artificial Sequence
  RNA Oligomer
cagaugcugaaagccauaguu

SEQ ID NO: 19033 - RNA, 21 nt, Artificial Sequence
  RNA Oligomer
acagaugcugaaagccauagu

SEQ ID NO: 19034 - RNA, 21 nt, Artificial Sequence
  RNA Oligomer
guggacaacacuuuugcagau

SEQ ID NO: 19035 - RNA, 21 nt, Artificial Sequence
  RNA Oligomer
uacacucaacacagauuccuu

SEQ ID NO: 19036 - RNA, 21 nt, Artificial Sequence
  RNA Oligomer
caagaagacgaggcugagagu

SEQ ID NO: 19037 - RNA, 21 nt, Artificial Sequence
  RNA Oligomer
cuuguguuggacugucauuau

SEQ ID NO: 19038 - RNA, 21 nt, Artificial Sequence
  RNA Oligomer
cuaauggauuuccuugccgac

SEQ ID NO: 19039 - RNA, 21 nt, Artificial Sequence
  RNA Oligomer
gggaaguuagcuuucagucca

SEQ ID NO: 19040 - RNA, 21 nt, Artificial Sequence
  RNA Oligomer
cagggaaguuagcuuucaguc

SEQ ID NO: 19041 - RNA, 21 nt, Artificial Sequence
  RNA Oligomer
gagguuggacaagaagacgag

SEQ ID NO: 19042 - RNA, 21 nt, Artificial Sequence
  RNA Oligomer
ggcagaagguugaagaacagg

SEQ ID NO: 19043 - RNA, 21 nt, Artificial Sequence
  RNA Oligomer
ccuuguguuggacugucauua

SEQ ID NO: 19044 - RNA, 21 nt, Artificial Sequence
  RNA Oligomer
uuccuuggacugggccuuaua

SEQ ID NO: 19045 - RNA, 21 nt, Artificial Sequence
  RNA Oligomer
agcaucccaccaacauuugau

SEQ ID NO: 19046 - RNA, 21 nt, Artificial Sequence
  RNA Oligomer
uccuuggacugggccuuauau

SEQ ID NO: 19047 - RNA, 21 nt, Artificial Sequence
  RNA Oligomer
ccagaggaugagguuggacaa

SEQ ID NO: 19048 - RNA, 21 nt, Artificial Sequence
  RNA Oligomer
ggucacuuucaacauuaacaa

SEQ ID NO: 19049 - RNA, 21 nt, Artificial Sequence
  RNA Oligomer
gaggaugagguuggacaagaa

SEQ ID NO: 19050 - RNA, 21 nt, Artificial Sequence
  RNA Oligomer
gaggaaagaaaaauucagaag

SEQ ID NO: 19051 - RNA, 21 nt, Artificial Sequence
  RNA Oligomer
agacaugugcuuugaaaugau

SEQ ID NO: 19052 - RNA, 21 nt, Artificial Sequence
  RNA Oligomer
ccagugaacaaauccuacucu

SEQ ID NO: 19053 - RNA, 21 nt, Artificial Sequence
  RNA Oligomer
gaccaccuaauggauuuccuu

SEQ ID NO: 19054 - RNA, 21 nt, Artificial Sequence
  RNA Oligomer
gggccuuauaugaccaccuaa

SEQ ID NO: 19055 - RNA, 21 nt, Artificial Sequence
  RNA Oligomer
cuggaacugaaugggacagaa

SEQ ID NO: 19056 - RNA, 21 nt, Artificial Sequence
  RNA Oligomer
gacaugugcuuugaaaugauu

SEQ ID NO: 19057 - RNA, 21 nt, Artificial Sequence
  RNA Oligomer
caagagccaguagagcagaca

SEQ ID NO: 19058 - RNA, 21 nt, Artificial Sequence
  RNA Oligomer
gcaccaggaguacauuacuuu

SEQ ID NO: 19059 - RNA, 21 nt, Artificial Sequence
  RNA Oligomer
cccaauuucgugguugaaguu

SEQ ID NO: 19060 - RNA, 21 nt, Artificial Sequence
  RNA Oligomer
uggaacugaaugggacagaag

SEQ ID NO: 19061 - RNA, 21 nt, Artificial Sequence
  RNA Oligomer
caagggcagaagguugaagaa

SEQ ID NO: 19062 - RNA, 21 nt, Artificial Sequence
  RNA Oligomer
cacuuucaacauuaacaacag

SEQ ID NO: 19063 - RNA, 21 nt, Artificial Sequence
  RNA Oligomer
ggcuuuggccagugaacaaau

SEQ ID NO: 19064 - RNA, 21 nt, Artificial Sequence
  RNA Oligomer
agacagaugcugaaagccaua

SEQ ID NO: 19065 - RNA, 21 nt, Artificial Sequence
  RNA Oligomer
agaccucaagaguuuugucaa

SEQ ID NO: 19066 - RNA, 21 nt, Artificial Sequence
  RNA Oligomer
uuauaugaccaccuaauggau

SEQ ID NO: 19067 - RNA, 21 nt, Artificial Sequence
  RNA Oligomer
gccuuauaugaccaccuaaug

SEQ ID NO: 19068 - RNA, 21 nt, Artificial Sequence
  RNA Oligomer
gcaagggcagaagguugaaga

SEQ ID NO: 19069 - RNA, 21 nt, Artificial Sequence
  RNA Oligomer
acggucacuuucaacauuaac

SEQ ID NO: 19070 - RNA, 21 nt, Artificial Sequence
  RNA Oligomer
ggccuuauaugaccaccuaau

SEQ ID NO: 19071 - RNA, 21 nt, Artificial Sequence
  RNA Oligomer
aggcugagagugacaucuucu

SEQ ID NO: 19072 - RNA, 21 nt, Artificial Sequence
  RNA Oligomer
aggagccugaacugacaucaa

SEQ ID NO: 19073 - RNA, 21 nt, Artificial Sequence
  RNA Oligomer
gucacuuucaacauuaacaac

SEQ ID NO: 19074 - RNA, 21 nt, Artificial Sequence
  RNA Oligomer
cggucacuuucaacauuaaca

SEQ ID NO: 19075 - RNA, 21 nt, Artificial Sequence
  RNA Oligomer
gcauaaaacccucccuaagau

SEQ ID NO: 19076 - RNA, 21 nt, Artificial Sequence
  RNA Oligomer
gccagugaacaaauccuacuc

SEQ ID NO: 19077 - RNA, 21 nt, Artificial Sequence
  RNA Oligomer
ggccagugaacaaauccuacu

SEQ ID NO: 19078 - RNA, 21 nt, Artificial Sequence
  RNA Oligomer
caggcuuuggccagugaacaa

SEQ ID NO: 19079 - RNA, 21 nt, Artificial Sequence
  RNA Oligomer
agaugcugaaagccauaguuu

SEQ ID NO: 19080 - RNA, 21 nt, Artificial Sequence
  RNA Oligomer
gagcaccaggaguacauuacu

SEQ ID NO: 19081 - RNA, 21 nt, Artificial Sequence
  RNA Oligomer
ggagcaccaggaguacauuac

SEQ ID NO: 19082 - RNA, 21 nt, Artificial Sequence
  RNA Oligomer
ugggccuuauaugaccaccua

SEQ ID NO: 19083 - RNA, 21 nt, Artificial Sequence
  RNA Oligomer
ggaugagguuggacaagaaga

SEQ ID NO: 19084 - RNA, 21 nt, Artificial Sequence
  RNA Oligomer
aggaugagguuggacaagaag

SEQ ID NO: 19085 - RNA, 21 nt, Artificial Sequence
  RNA Oligomer
acucccaauuucgugguugaa

SEQ ID NO: 19086 - RNA, 21 nt, Artificial Sequence
  RNA Oligomer
ucaacucccaauuucgugguu

SEQ ID NO: 19087 - RNA, 21 nt, Artificial Sequence
  RNA Oligomer
gagccugaacugacaucaacu

SEQ ID NO: 19088 - RNA, 21 nt, Artificial Sequence
  RNA Oligomer
ccucaagaguuuugucaagag

SEQ ID NO: 19089 - RNA, 21 nt, Artificial Sequence
  RNA Oligomer
cugggccuuauaugaccaccu

SEQ ID NO: 19090 - RNA, 21 nt, Artificial Sequence
  RNA Oligomer
ggacugucauuauccagagga

SEQ ID NO: 19091 - RNA, 21 nt, Artificial Sequence
  RNA Oligomer
acugaaugggacagaagcgaa

SEQ ID NO: 19092 - RNA, 21 nt, Artificial Sequence
  RNA Oligomer
gaagcauaaaacccucccuaa

SEQ ID NO: 19093 - RNA, 21 nt, Artificial Sequence
  RNA Oligomer
accucaagaguuuugucaaga

SEQ ID NO: 19094 - RNA, 21 nt, Artificial Sequence
  RNA Oligomer
ugauuuccugagugaugaaau

SEQ ID NO: 19095 - RNA, 21 nt, Artificial Sequence
  RNA Oligomer
ugaccaccuaauggauuuccu

SEQ ID NO: 19096 - RNA, 21 nt, Artificial Sequence
  RNA Oligomer
aucuucucuaucagggaaguu

SEQ ID NO: 19097 - RNA, 21 nt, Artificial Sequence
  RNA Oligomer
ugagagugacaucuucucuau

SEQ ID NO: 19098 - RNA, 21 nt, Artificial Sequence
  RNA Oligomer
gacugucauuauccagaggau

SEQ ID NO: 19099 - RNA, 21 nt, Artificial Sequence
  RNA Oligomer
ucccaauuucgugguugaagu

SEQ ID NO: 19100 - RNA, 21 nt, Artificial Sequence
  RNA Oligomer
cugaacugacaucaacuccca

SEQ ID NO: 19101 - RNA, 21 nt, Artificial Sequence
  RNA Oligomer
gugaacaaauccuacucugaa

SEQ ID NO: 19102 - RNA, 21 nt, Artificial Sequence
  RNA Oligomer
ccaauuucgugguugaaguua

SEQ ID NO: 19103 - RNA, 21 nt, Artificial Sequence
  RNA Oligomer
caacucccaauuucgugguug

SEQ ID NO: 19104 - RNA, 21 nt, Artificial Sequence
  RNA Oligomer
ugaacugacaucaacucccaa

SEQ ID NO: 19105 - RNA, 21 nt, Artificial Sequence
  RNA Oligomer
guugaagaacaggagccugaa

SEQ ID NO: 19106 - RNA, 21 nt, Artificial Sequence
  RNA Oligomer
agaagcauaaaacccucccua

SEQ ID NO: 19107 - RNA, 21 nt, Artificial Sequence
  RNA Oligomer
cagacagaugcugaaagccau

SEQ ID NO: 19108 - RNA, 21 nt, Artificial Sequence
  RNA Oligomer
gaagaccucaagaguuuuguc

SEQ ID NO: 19109 - RNA, 21 nt, Artificial Sequence
  RNA Oligomer
ggacugggccuuauaugacca

SEQ ID NO: 19110 - RNA, 21 nt, Artificial Sequence
  RNA Oligomer
cucuaucagggaaguuagcuu

SEQ ID NO: 19111 - RNA, 21 nt, Artificial Sequence
  RNA Oligomer
ugacaucuucucuaucaggga

SEQ ID NO: 19112 - RNA, 21 nt, Artificial Sequence
  RNA Oligomer
gagugacaucuucucuaucag

SEQ ID NO: 19113 - RNA, 21 nt, Artificial Sequence
  RNA Oligomer
gcccuuguguuggacugucau

SEQ ID NO: 19114 - RNA, 21 nt, Artificial Sequence
  RNA Oligomer
acugacaucaacucccaauuu

SEQ ID NO: 19115 - RNA, 21 nt, Artificial Sequence
  RNA Oligomer
ccaacauuugauggugaggag

SEQ ID NO: 19116 - RNA, 21 nt, Artificial Sequence
  RNA Oligomer
gcuggaacugaaugggacaga

SEQ ID NO: 19117 - RNA, 21 nt, Artificial Sequence
  RNA Oligomer
cccuaagaugucuggagguug

SEQ ID NO: 19118 - RNA, 21 nt, Artificial Sequence
  RNA Oligomer
ugaacaaauccuacucugaag

SEQ ID NO: 19119 - RNA, 21 nt, Artificial Sequence
  RNA Oligomer
gagccaguagagcagacagau

SEQ ID NO: 19120 - RNA, 21 nt, Artificial Sequence
  RNA Oligomer
agcaccaggaguacauuacuu

SEQ ID NO: 19121 - RNA, 21 nt, Artificial Sequence
  RNA Oligomer
ucaacacagauuccuuggacu

SEQ ID NO: 19122 - RNA, 21 nt, Artificial Sequence
  RNA Oligomer
aacugacaucaacucccaauu

SEQ ID NO: 19123 - RNA, 21 nt, Artificial Sequence
  RNA Oligomer
gaacugacaucaacucccaau

SEQ ID NO: 19124 - RNA, 21 nt, Artificial Sequence
  RNA Oligomer
ggagccugaacugacaucaac

SEQ ID NO: 19125 - RNA, 21 nt, Artificial Sequence
  RNA Oligomer
gaacaaauccuacucugaagc

SEQ ID NO: 19126 - RNA, 21 nt, Artificial Sequence
  RNA Oligomer
cagugaacaaauccuacucug

SEQ ID NO: 19127 - RNA, 21 nt, Artificial Sequence
  RNA Oligomer
cuugaagaccucaagaguuuu

SEQ ID NO: 19128 - RNA, 21 nt, Artificial Sequence
  RNA Oligomer
cuggagcaccaggaguacauu

SEQ ID NO: 19129 - RNA, 21 nt, Artificial Sequence
  RNA Oligomer
ggguuguccuuugcaucugca

SEQ ID NO: 19130 - RNA, 21 nt, Artificial Sequence
  RNA Oligomer
acaucuucucuaucagggaag

SEQ ID NO: 19131 - RNA, 21 nt, Artificial Sequence
  RNA Oligomer
ugauggcaagaaggcccuugu

SEQ ID NO: 19132 - RNA, 21 nt, Artificial Sequence
  RNA Oligomer
ugacaucaacucccaauuucg

SEQ ID NO: 19133 - RNA, 21 nt, Artificial Sequence
  RNA Oligomer
gccugaacugacaucaacucc

SEQ ID NO: 19134 - RNA, 21 nt, Artificial Sequence
  RNA Oligomer
gaagaacaggagccugaacug

SEQ ID NO: 19135 - RNA, 21 nt, Artificial Sequence
  RNA Oligomer
ccaccaacauuugauggugag

SEQ ID NO: 19136 - RNA, 21 nt, Artificial Sequence
  RNA Oligomer
caacagcaucccaccaacauu

SEQ ID NO: 19137 - RNA, 21 nt, Artificial Sequence
  RNA Oligomer
aggcuuuggccagugaacaaa

SEQ ID NO: 19138 - RNA, 21 nt, Artificial Sequence
  RNA Oligomer
ccaguagagcagacagaugcu

SEQ ID NO: 19139 - RNA, 21 nt, Artificial Sequence
  RNA Oligomer
agagugacaucuucucuauca

SEQ ID NO: 19140 - RNA, 21 nt, Artificial Sequence
  RNA Oligomer
gagagugacaucuucucuauc

SEQ ID NO: 19141 - RNA, 21 nt, Artificial Sequence
  RNA Oligomer
cauuauccagaggaugagguu

SEQ ID NO: 19142 - RNA, 21 nt, Artificial Sequence
  RNA Oligomer
acagcaucccaccaacauuug

SEQ ID NO: 19143 - RNA, 21 nt, Artificial Sequence
  RNA Oligomer
acaacagcaucccaccaacau

SEQ ID NO: 19144 - RNA, 21 nt, Artificial Sequence
  RNA Oligomer
agugaacaaauccuacucuga

SEQ ID NO: 19145 - RNA, 21 nt, Artificial Sequence
  RNA Oligomer
gcagacagaugcugaaagcca

SEQ ID NO: 19146 - RNA, 21 nt, Artificial Sequence
  RNA Oligomer
guagagcagacagaugcugaa

SEQ ID NO: 19147 - RNA, 21 nt, Artificial Sequence
  RNA Oligomer
cccuuguguuggacugucauu

SEQ ID NO: 19148 - RNA, 21 nt, Artificial Sequence
  RNA Oligomer
cccaccaacauuugaugguga

SEQ ID NO: 19149 - RNA, 21 nt, Artificial Sequence
  RNA Oligomer
ucccaccaacauuugauggug

SEQ ID NO: 19150 - RNA, 21 nt, Artificial Sequence
  RNA Oligomer
ucccuaagaugucuggagguu

SEQ ID NO: 19151 - RNA, 21 nt, Artificial Sequence
  RNA Oligomer
cucccuaagaugucuggaggu

SEQ ID NO: 19152 - RNA, 21 nt, Artificial Sequence
  RNA Oligomer
cagaagcauaaaacccucccu

SEQ ID NO: 19153 - RNA, 21 nt, Artificial Sequence
  RNA Oligomer
caacacagauuccuuggacug

SEQ ID NO: 19154 - RNA, 21 nt, Artificial Sequence
  RNA Oligomer
ucuaucagggaaguuagcuuu

SEQ ID NO: 19155 - RNA, 21 nt, Artificial Sequence
  RNA Oligomer
gcugagagugacaucuucucu

SEQ ID NO: 19156 - RNA, 21 nt, Artificial Sequence
  RNA Oligomer
gcaucccaccaacauuugaug

SEQ ID NO: 19157 - RNA, 21 nt, Artificial Sequence
  RNA Oligomer
uccuacucugaagcuagacau

SEQ ID NO: 19158 - RNA, 21 nt, Artificial Sequence
  RNA Oligomer
gguggacaacacuuuugcaga

SEQ ID NO: 19159 - RNA, 21 nt, Artificial Sequence
  RNA Oligomer
cucaacacagauuccuuggac

SEQ ID NO: 19160 - RNA, 21 nt, Artificial Sequence
  RNA Oligomer
uggcaagaaggcccuuguguu

SEQ ID NO: 19161 - RNA, 21 nt, Artificial Sequence
  RNA Oligomer
caaauccuacucugaagcuag

SEQ ID NO: 19162 - RNA, 21 nt, Artificial Sequence
  RNA Oligomer
acaaauccuacucugaagcua

SEQ ID NO: 19163 - RNA, 21 nt, Artificial Sequence
  RNA Oligomer
ggcugagagugacaucuucuc

SEQ ID NO: 19164 - RNA, 21 nt, Artificial Sequence
  RNA Oligomer
cgaggcugagagugacaucuu

SEQ ID NO: 19165 - RNA, 21 nt, Artificial Sequence
  RNA Oligomer
agcuagacaugugcuuugaaa

SEQ ID NO: 19166 - RNA, 21 nt, Artificial Sequence
  RNA Oligomer
aagcuagacaugugcuuugaa

SEQ ID NO: 19167 - RNA, 21 nt, Artificial Sequence
  RNA Oligomer
ccuuugcaucugcacguguuc

SEQ ID NO: 19168 - RNA, 21 nt, Artificial Sequence
  RNA Oligomer
ccuacucugaagcuagacaug

SEQ ID NO: 19169 - RNA, 21 nt, Artificial Sequence
  RNA Oligomer
ucgcaagggcagaagguugaa

SEQ ID NO: 19170 - RNA, 21 nt, Artificial Sequence
  RNA Oligomer
aaagugaccgugauuuuuucc

SEQ ID NO: 19171 - RNA, 21 nt, Artificial Sequence
  RNA Oligomer
aacuuuccgcacuaauuucgc

SEQ ID NO: 19172 - RNA, 21 nt, Artificial Sequence
  RNA Oligomer
auuucgcuucugucccauuca

SEQ ID NO: 19173 - RNA, 21 nt, Artificial Sequence
  RNA Oligomer
aucaacaaaagcuuugucucc

SEQ ID NO: 19174 - RNA, 21 nt, Artificial Sequence
  RNA Oligomer
guguauaauuaguauccuucc

SEQ ID NO: 19175 - RNA, 21 nt, Artificial Sequence
  RNA Oligomer
aaucaacaaaagcuuugucuc

SEQ ID NO: 19176 - RNA, 21 nt, Artificial Sequence
  RNA Oligomer
aauuucgcuucugucccauuc

SEQ ID NO: 19177 - RNA, 21 nt, Artificial Sequence
  RNA Oligomer
agaaaaguaauguacuccugg

SEQ ID NO: 19178 - RNA, 21 nt, Artificial Sequence
  RNA Oligomer
ucaagaaaaguaauguacucc

SEQ ID NO: 19179 - RNA, 21 nt, Artificial Sequence
  RNA Oligomer
aagaaaaguaauguacuccug

SEQ ID NO: 19180 - RNA, 21 nt, Artificial Sequence
  RNA Oligomer
cuguguugaguguauaauuag

SEQ ID NO: 19181 - RNA, 21 nt, Artificial Sequence
  RNA Oligomer
uuaguauccuuccauucagac

SEQ ID NO: 19182 - RNA, 21 nt, Artificial Sequence
  RNA Oligomer
guauccuuccauucagacucg

SEQ ID NO: 19183 - RNA, 21 nt, Artificial Sequence
  RNA Oligomer
uauccuuccauucagacucgc

SEQ ID NO: 19184 - RNA, 21 nt, Artificial Sequence
  RNA Oligomer
acaaaagcuuugucuccgucg

SEQ ID NO: 19185 - RNA, 21 nt, Artificial Sequence
  RNA Oligomer
uuuccgcacuaauuucgcuuc

SEQ ID NO: 19186 - RNA, 21 nt, Artificial Sequence
  RNA Oligomer
uuccgcacuaauuucgcuucu

SEQ ID NO: 19187 - RNA, 21 nt, Artificial Sequence
  RNA Oligomer
auucaguuccagcucccaacc

SEQ ID NO: 19188 - RNA, 21 nt, Artificial Sequence
  RNA Oligomer
uacuggcucuugacaaaacuc

SEQ ID NO: 19189 - RNA, 21 nt, Artificial Sequence
  RNA Oligomer
aaaaguaauguacuccuggug

SEQ ID NO: 19190 - RNA, 21 nt, Artificial Sequence
  RNA Oligomer
ucaucugcaaaaguguugucc

SEQ ID NO: 19191 - RNA, 21 nt, Artificial Sequence
  RNA Oligomer
uucaucacucaggaaaucaac

SEQ ID NO: 19192 - RNA, 21 nt, Artificial Sequence
  RNA Oligomer
auccuuccauucagacucgcc

SEQ ID NO: 19193 - RNA, 21 nt, Artificial Sequence
  RNA Oligomer
gaaaucaacaaaagcuuuguc

SEQ ID NO: 19194 - RNA, 21 nt, Artificial Sequence
  RNA Oligomer
aaaagcuuugucuccgucggu

SEQ ID NO: 19195 - RNA, 21 nt, Artificial Sequence
  RNA Oligomer
aagcuuugucuccgucggugu

SEQ ID NO: 19196 - RNA, 21 nt, Artificial Sequence
  RNA Oligomer
aagugaccgugauuuuuuccc

SEQ ID NO: 19197 - RNA, 21 nt, Artificial Sequence
  RNA Oligomer
aauuaguauccuuccauucag

SEQ ID NO: 19198 - RNA, 21 nt, Artificial Sequence
  RNA Oligomer
auuaguauccuuccauucaga

SEQ ID NO: 19199 - RNA, 21 nt, Artificial Sequence
  RNA Oligomer
uucuuuauaacuucaaccacg

SEQ ID NO: 19200 - RNA, 21 nt, Artificial Sequence
  RNA Oligomer
aacaaaagcuuugucuccguc

SEQ ID NO: 19201 - RNA, 21 nt, Artificial Sequence
  RNA Oligomer
cacuaauuucgcuucuguccc

SEQ ID NO: 19202 - RNA, 21 nt, Artificial Sequence
  RNA Oligomer
ucugaauuuuucuuuccuccu

SEQ ID NO: 19203 - RNA, 21 nt, Artificial Sequence
  RNA Oligomer
uuuccuccuuaauuucaucac

SEQ ID NO: 19204 - RNA, 21 nt, Artificial Sequence
  RNA Oligomer
acaaaacucuugaggucuuca

SEQ ID NO: 19205 - RNA, 21 nt, Artificial Sequence
  RNA Oligomer
guggacugaaagcuaacuucc

SEQ ID NO: 19206 - RNA, 21 nt, Artificial Sequence
  RNA Oligomer
ucaacaaaagcuuugucuccg

SEQ ID NO: 19207 - RNA, 21 nt, Artificial Sequence
  RNA Oligomer
cuguucuucaaccuucugccc

SEQ ID NO: 19208 - RNA, 21 nt, Artificial Sequence
  RNA Oligomer
ugucccauucaguuccagcuc

SEQ ID NO: 19209 - RNA, 21 nt, Artificial Sequence
  RNA Oligomer
uuccuccuuaauuucaucacu

SEQ ID NO: 19210 - RNA, 21 nt, Artificial Sequence
  RNA Oligomer
uuccauucagacucgccagug

SEQ ID NO: 19211 - RNA, 21 nt, Artificial Sequence
  RNA Oligomer
acucaggaaaucaacaaaagc

SEQ ID NO: 19212 - RNA, 21 nt, Artificial Sequence
  RNA Oligomer
ucuuuauaacuucaaccacga

SEQ ID NO: 19213 - RNA, 21 nt, Artificial Sequence
  RNA Oligomer
auaacuucaaccacgaaauug

SEQ ID NO: 19214 - RNA, 21 nt, Artificial Sequence
  RNA Oligomer
caacaaaagcuuugucuccgu

SEQ ID NO: 19215 - RNA, 21 nt, Artificial Sequence
  RNA Oligomer
uuccuccucaccaucaaaugu

SEQ ID NO: 19216 - RNA, 21 nt, Artificial Sequence
  RNA Oligomer
uuaauguugaaagugaccgug

SEQ ID NO: 19217 - RNA, 21 nt, Artificial Sequence
  RNA Oligomer
uaauguugaaagugaccguga

SEQ ID NO: 19218 - RNA, 21 nt, Artificial Sequence
  RNA Oligomer
caacuuuccgcacuaauuucg

SEQ ID NO: 19219 - RNA, 21 nt, Artificial Sequence
  RNA Oligomer
auuucaaagcacaugucuagc

SEQ ID NO: 19220 - RNA, 21 nt, Artificial Sequence
  RNA Oligomer
cuuuccuccuuaauuucauca

SEQ ID NO: 19221 - RNA, 21 nt, Artificial Sequence
  RNA Oligomer
uccuccuuaauuucaucacuc

SEQ ID NO: 19222 - RNA, 21 nt, Artificial Sequence
  RNA Oligomer
caagaaaaguaauguacuccu

SEQ ID NO: 19223 - RNA, 21 nt, Artificial Sequence
  RNA Oligomer
uucccugauagagaagauguc

SEQ ID NO: 19224 - RNA, 21 nt, Artificial Sequence
  RNA Oligomer
uucaguuccagcucccaaccu

SEQ ID NO: 19225 - RNA, 21 nt, Artificial Sequence
  RNA Oligomer
ucuuagggaggguuuuaugcu

SEQ ID NO: 19226 - RNA, 21 nt, Artificial Sequence
  RNA Oligomer
uucugaauuuuucuuuccucc

SEQ ID NO: 19227 - RNA, 21 nt, Artificial Sequence
  RNA Oligomer
cuccuuaauuucaucacucag

SEQ ID NO: 19228 - RNA, 21 nt, Artificial Sequence
  RNA Oligomer
cucaucugcaaaaguguuguc

SEQ ID NO: 19229 - RNA, 21 nt, Artificial Sequence
  RNA Oligomer
acugaaagcuaacuucccuga

SEQ ID NO: 19230 - RNA, 21 nt, Artificial Sequence
  RNA Oligomer
acuuuccgcacuaauuucgcu

SEQ ID NO: 19231 - RNA, 21 nt, Artificial Sequence
  RNA Oligomer
ucuuuccuccuuaauuucauc

SEQ ID NO: 19232 - RNA, 21 nt, Artificial Sequence
  RNA Oligomer
caucugcaaaaguguugucca

SEQ ID NO: 19233 - RNA, 21 nt, Artificial Sequence
  RNA Oligomer
ucggcaaggaaauccauuagg

SEQ ID NO: 19234 - RNA, 21 nt, Artificial Sequence
  RNA Oligomer
aguggacugaaagcuaacuuc

SEQ ID NO: 19235 - RNA, 21 nt, Artificial Sequence
  RNA Oligomer
gaaagcuaacuucccugauag

SEQ ID NO: 19236 - RNA, 21 nt, Artificial Sequence
  RNA Oligomer
caggaaaucaacaaaagcuuu

SEQ ID NO: 19237 - RNA, 21 nt, Artificial Sequence
  RNA Oligomer
cuccuguucuucaaccuucug

SEQ ID NO: 19238 - RNA, 21 nt, Artificial Sequence
  RNA Oligomer
uccuguucuucaaccuucugc

SEQ ID NO: 19239 - RNA, 21 nt, Artificial Sequence
  RNA Oligomer
ugcuucugaauuuuucuuucc

SEQ ID NO: 19240 - RNA, 21 nt, Artificial Sequence
  RNA Oligomer
aaagccugccaugaaacuaug

SEQ ID NO: 19241 - RNA, 21 nt, Artificial Sequence
  RNA Oligomer
aacuauggcuuucagcaucug

SEQ ID NO: 19242 - RNA, 21 nt, Artificial Sequence
  RNA Oligomer
acuauggcuuucagcaucugu

SEQ ID NO: 19243 - RNA, 21 nt, Artificial Sequence
  RNA Oligomer
aucugcaaaaguguuguccac

SEQ ID NO: 19244 - RNA, 21 nt, Artificial Sequence
  RNA Oligomer
aaggaaucuguguugagugua

SEQ ID NO: 19245 - RNA, 21 nt, Artificial Sequence
  RNA Oligomer
acucucagccucgucuucuug

SEQ ID NO: 19246 - RNA, 21 nt, Artificial Sequence
  RNA Oligomer
auaaugacaguccaacacaag

SEQ ID NO: 19247 - RNA, 21 nt, Artificial Sequence
  RNA Oligomer
gucggcaaggaaauccauuag

SEQ ID NO: 19248 - RNA, 21 nt, Artificial Sequence
  RNA Oligomer
uggacugaaagcuaacuuccc

SEQ ID NO: 19249 - RNA, 21 nt, Artificial Sequence
  RNA Oligomer
gacugaaagcuaacuucccug

SEQ ID NO: 19250 - RNA, 21 nt, Artificial Sequence
  RNA Oligomer
cucgucuucuuguccaaccuc

SEQ ID NO: 19251 - RNA, 21 nt, Artificial Sequence
  RNA Oligomer
ccuguucuucaaccuucugcc

SEQ ID NO: 19252 - RNA, 21 nt, Artificial Sequence
  RNA Oligomer
uaaugacaguccaacacaagg

SEQ ID NO: 19253 - RNA, 21 nt, Artificial Sequence
  RNA Oligomer
uauaaggcccaguccaaggaa

SEQ ID NO: 19254 - RNA, 21 nt, Artificial Sequence
  RNA Oligomer
aucaaauguuggugggaugcu

SEQ ID NO: 19255 - RNA, 21 nt, Artificial Sequence
  RNA Oligomer
auauaaggcccaguccaagga

SEQ ID NO: 19256 - RNA, 21 nt, Artificial Sequence
  RNA Oligomer
uuguccaaccucauccucugg

SEQ ID NO: 19257 - RNA, 21 nt, Artificial Sequence
  RNA Oligomer
uuguuaauguugaaagugacc

SEQ ID NO: 19258 - RNA, 21 nt, Artificial Sequence
  RNA Oligomer
uucuuguccaaccucauccuc

SEQ ID NO: 19259 - RNA, 21 nt, Artificial Sequence
  RNA Oligomer
cuucugaauuuuucuuuccuc

SEQ ID NO: 19260 - RNA, 21 nt, Artificial Sequence
  RNA Oligomer
aucauuucaaagcacaugucu

SEQ ID NO: 19261 - RNA, 21 nt, Artificial Sequence
  RNA Oligomer
agaguaggauuuguucacugg

SEQ ID NO: 19262 - RNA, 21 nt, Artificial Sequence
  RNA Oligomer
aaggaaauccauuaggugguc

SEQ ID NO: 19263 - RNA, 21 nt, Artificial Sequence
  RNA Oligomer
uuagguggucauauaaggccc

SEQ ID NO: 19264 - RNA, 21 nt, Artificial Sequence
  RNA Oligomer
uucugucccauucaguuccag

SEQ ID NO: 19265 - RNA, 21 nt, Artificial Sequence
  RNA Oligomer
aaucauuucaaagcacauguc

SEQ ID NO: 19266 - RNA, 21 nt, Artificial Sequence
  RNA Oligomer
ugucugcucuacuggcucuug

SEQ ID NO: 19267 - RNA, 21 nt, Artificial Sequence
  RNA Oligomer
aaaguaauguacuccuggugc

SEQ ID NO: 19268 - RNA, 21 nt, Artificial Sequence
  RNA Oligomer
aacuucaaccacgaaauuggg

SEQ ID NO: 19269 - RNA, 21 nt, Artificial Sequence
  RNA Oligomer
cuucugucccauucaguucca

SEQ ID NO: 19270 - RNA, 21 nt, Artificial Sequence
  RNA Oligomer
uucuucaaccuucugcccuug

SEQ ID NO: 19271 - RNA, 21 nt, Artificial Sequence
  RNA Oligomer
cuguuguuaauguugaaagug

SEQ ID NO: 19272 - RNA, 21 nt, Artificial Sequence
  RNA Oligomer
auuuguucacuggccaaagcc

SEQ ID NO: 19273 - RNA, 21 nt, Artificial Sequence
  RNA Oligomer
uauggcuuucagcaucugucu

SEQ ID NO: 19274 - RNA, 21 nt, Artificial Sequence
  RNA Oligomer
uugacaaaacucuugaggucu

SEQ ID NO: 19275 - RNA, 21 nt, Artificial Sequence
  RNA Oligomer
auccauuagguggucauauaa

SEQ ID NO: 19276 - RNA, 21 nt, Artificial Sequence
  RNA Oligomer
cauuagguggucauauaaggc

SEQ ID NO: 19277 - RNA, 21 nt, Artificial Sequence
  RNA Oligomer
ucuucaaccuucugcccuugc

SEQ ID NO: 19278 - RNA, 21 nt, Artificial Sequence
  RNA Oligomer
guuaauguugaaagugaccgu

SEQ ID NO: 19279 - RNA, 21 nt, Artificial Sequence
  RNA Oligomer
auuagguggucauauaaggcc

SEQ ID NO: 19280 - RNA, 21 nt, Artificial Sequence
  RNA Oligomer
agaagaugucacucucagccu

SEQ ID NO: 19281 - RNA, 21 nt, Artificial Sequence
  RNA Oligomer
uugaugucaguucaggcuccu

SEQ ID NO: 19282 - RNA, 21 nt, Artificial Sequence
  RNA Oligomer
guuguuaauguugaaagugac

SEQ ID NO: 19283 - RNA, 21 nt, Artificial Sequence
  RNA Oligomer
uguuaauguugaaagugaccg

SEQ ID NO: 19284 - RNA, 21 nt, Artificial Sequence
  RNA Oligomer
aucuuagggaggguuuuaugc

SEQ ID NO: 19285 - RNA, 21 nt, Artificial Sequence
  RNA Oligomer
gaguaggauuuguucacuggc

SEQ ID NO: 19286 - RNA, 21 nt, Artificial Sequence
  RNA Oligomer
aguaggauuuguucacuggcc

SEQ ID NO: 19287 - RNA, 21 nt, Artificial Sequence
  RNA Oligomer
uuguucacuggccaaagccug

SEQ ID NO: 19288 - RNA, 21 nt, Artificial Sequence
  RNA Oligomer
aaacuauggcuuucagcaucu

SEQ ID NO: 19289 - RNA, 21 nt, Artificial Sequence
  RNA Oligomer
aguaauguacuccuggugcuc

SEQ ID NO: 19290 - RNA, 21 nt, Artificial Sequence
  RNA Oligomer
guaauguacuccuggugcucc

SEQ ID NO: 19291 - RNA, 21 nt, Artificial Sequence
  RNA Oligomer
uagguggucauauaaggccca

SEQ ID NO: 19292 - RNA, 21 nt, Artificial Sequence
  RNA Oligomer
ucuucuuguccaaccucaucc

SEQ ID NO: 19293 - RNA, 21 nt, Artificial Sequence
  RNA Oligomer
cuucuuguccaaccucauccu

SEQ ID NO: 19294 - RNA, 21 nt, Artificial Sequence
  RNA Oligomer
uucaaccacgaaauugggagu

SEQ ID NO: 19295 - RNA, 21 nt, Artificial Sequence
  RNA Oligomer
aaccacgaaauugggaguuga

SEQ ID NO: 19296 - RNA, 21 nt, Artificial Sequence
  RNA Oligomer
aguugaugucaguucaggcuc

SEQ ID NO: 19297 - RNA, 21 nt, Artificial Sequence
  RNA Oligomer
cucuugacaaaacucuugagg

SEQ ID NO: 19298 - RNA, 21 nt, Artificial Sequence
  RNA Oligomer
agguggucauauaaggcccag

SEQ ID NO: 19299 - RNA, 21 nt, Artificial Sequence
  RNA Oligomer
uccucuggauaaugacagucc

SEQ ID NO: 19300 - RNA, 21 nt, Artificial Sequence
  RNA Oligomer
uucgcuucugucccauucagu

SEQ ID NO: 19301 - RNA, 21 nt, Artificial Sequence
  RNA Oligomer
uuagggaggguuuuaugcuuc

SEQ ID NO: 19302 - RNA, 21 nt, Artificial Sequence
  RNA Oligomer
ucuugacaaaacucuugaggu

SEQ ID NO: 19303 - RNA, 21 nt, Artificial Sequence
  RNA Oligomer
auuucaucacucaggaaauca

SEQ ID NO: 19304 - RNA, 21 nt, Artificial Sequence
  RNA Oligomer
aggaaauccauuaggugguca

SEQ ID NO: 19305 - RNA, 21 nt, Artificial Sequence
  RNA Oligomer
aacuucccugauagagaagau

SEQ ID NO: 19306 - RNA, 21 nt, Artificial Sequence
  RNA Oligomer
auagagaagaugucacucuca

SEQ ID NO: 19307 - RNA, 21 nt, Artificial Sequence
  RNA Oligomer
auccucuggauaaugacaguc

SEQ ID NO: 19308 - RNA, 21 nt, Artificial Sequence
  RNA Oligomer
acuucaaccacgaaauuggga

SEQ ID NO: 19309 - RNA, 21 nt, Artificial Sequence
  RNA Oligomer
ugggaguugaugucaguucag

SEQ ID NO: 19310 - RNA, 21 nt, Artificial Sequence
  RNA Oligomer
uucagaguaggauuuguucac

SEQ ID NO: 19311 - RNA, 21 nt, Artificial Sequence
  RNA Oligomer
uaacuucaaccacgaaauugg

SEQ ID NO: 19312 - RNA, 21 nt, Artificial Sequence
  RNA Oligomer
caaccacgaaauugggaguug

SEQ ID NO: 19313 - RNA, 21 nt, Artificial Sequence
  RNA Oligomer
uugggaguugaugucaguuca

SEQ ID NO: 19314 - RNA, 21 nt, Artificial Sequence
  RNA Oligomer
uucaggcuccuguucuucaac

SEQ ID NO: 19315 - RNA, 21 nt, Artificial Sequence
  RNA Oligomer
uagggaggguuuuaugcuucu

SEQ ID NO: 19316 - RNA, 21 nt, Artificial Sequence
  RNA Oligomer
auggcuuucagcaucugucug

SEQ ID NO: 19317 - RNA, 21 nt, Artificial Sequence
  RNA Oligomer
gacaaaacucuugaggucuuc

SEQ ID NO: 19318 - RNA, 21 nt, Artificial Sequence
  RNA Oligomer
uggucauauaaggcccagucc

SEQ ID NO: 19319 - RNA, 21 nt, Artificial Sequence
  RNA Oligomer
aagcuaacuucccugauagag

SEQ ID NO: 19320 - RNA, 21 nt, Artificial Sequence
  RNA Oligomer
ucccugauagagaagauguca

SEQ ID NO: 19321 - RNA, 21 nt, Artificial Sequence
  RNA Oligomer
cugauagagaagaugucacuc

SEQ ID NO: 19322 - RNA, 21 nt, Artificial Sequence
  RNA Oligomer
augacaguccaacacaagggc

SEQ ID NO: 19323 - RNA, 21 nt, Artificial Sequence
  RNA Oligomer
aaauugggaguugaugucagu

SEQ ID NO: 19324 - RNA, 21 nt, Artificial Sequence
  RNA Oligomer
cuccucaccaucaaauguugg

SEQ ID NO: 19325 - RNA, 21 nt, Artificial Sequence
  RNA Oligomer
ucugucccauucaguuccagc

SEQ ID NO: 19326 - RNA, 21 nt, Artificial Sequence
  RNA Oligomer
caaccuccagacaucuuaggg

SEQ ID NO: 19327 - RNA, 21 nt, Artificial Sequence
  RNA Oligomer
cuucagaguaggauuuguuca

SEQ ID NO: 19328 - RNA, 21 nt, Artificial Sequence
  RNA Oligomer
aucugucugcucuacuggcuc

SEQ ID NO: 19329 - RNA, 21 nt, Artificial Sequence
  RNA Oligomer
aaguaauguacuccuggugcu

SEQ ID NO: 19330 - RNA, 21 nt, Artificial Sequence
  RNA Oligomer
aguccaaggaaucuguguuga

SEQ ID NO: 19331 - RNA, 21 nt, Artificial Sequence
  RNA Oligomer
aauugggaguugaugucaguu

SEQ ID NO: 19332 - RNA, 21 nt, Artificial Sequence
  RNA Oligomer
auugggaguugaugucaguuc

SEQ ID NO: 19333 - RNA, 21 nt, Artificial Sequence
  RNA Oligomer
guugaugucaguucaggcucc

SEQ ID NO: 19334 - RNA, 21 nt, Artificial Sequence
  RNA Oligomer
gcuucagaguaggauuuguuc

SEQ ID NO: 19335 - RNA, 21 nt, Artificial Sequence
  RNA Oligomer
cagaguaggauuuguucacug

SEQ ID NO: 19336 - RNA, 21 nt, Artificial Sequence
  RNA Oligomer
aaaacucuugaggucuucaag

SEQ ID NO: 19337 - RNA, 21 nt, Artificial Sequence
  RNA Oligomer
aauguacuccuggugcuccag

SEQ ID NO: 19338 - RNA, 21 nt, Artificial Sequence
  RNA Oligomer
ugcagaugcaaaggacaaccc

SEQ ID NO: 19339 - RNA, 21 nt, Artificial Sequence
  RNA Oligomer
cuucccugauagagaagaugu

SEQ ID NO: 19340 - RNA, 21 nt, Artificial Sequence
  RNA Oligomer
acaagggccuucuugccauca

SEQ ID NO: 19341 - RNA, 21 nt, Artificial Sequence
  RNA Oligomer
cgaaauugggaguugauguca

SEQ ID NO: 19342 - RNA, 21 nt, Artificial Sequence
  RNA Oligomer
ggaguugaugucaguucaggc

SEQ ID NO: 19343 - RNA, 21 nt, Artificial Sequence
  RNA Oligomer
caguucaggcuccuguucuuc

SEQ ID NO: 19344 - RNA, 21 nt, Artificial Sequence
  RNA Oligomer
cucaccaucaaauguuggugg

SEQ ID NO: 19345 - RNA, 21 nt, Artificial Sequence
  RNA Oligomer
aauguuggugggaugcuguug

SEQ ID NO: 19346 - RNA, 21 nt, Artificial Sequence
  RNA Oligomer
uuuguucacuggccaaagccu

SEQ ID NO: 19347 - RNA, 21 nt, Artificial Sequence
  RNA Oligomer
agcaucugucugcucuacugg

SEQ ID NO: 19348 - RNA, 21 nt, Artificial Sequence
  RNA Oligomer
ugauagagaagaugucacucu

SEQ ID NO: 19349 - RNA, 21 nt, Artificial Sequence
  RNA Oligomer
gauagagaagaugucacucuc

SEQ ID NO: 19350 - RNA, 21 nt, Artificial Sequence
  RNA Oligomer
aaccucauccucuggauaaug

SEQ ID NO: 19351 - RNA, 21 nt, Artificial Sequence
  RNA Oligomer
caaauguuggugggaugcugu

SEQ ID NO: 19352 - RNA, 21 nt, Artificial Sequence
  RNA Oligomer
auguuggugggaugcuguugu

SEQ ID NO: 19353 - RNA, 21 nt, Artificial Sequence
  RNA Oligomer
ucagaguaggauuuguucacu

SEQ ID NO: 19354 - RNA, 21 nt, Artificial Sequence
  RNA Oligomer
uggcuuucagcaucugucugc

SEQ ID NO: 19355 - RNA, 21 nt, Artificial Sequence
  RNA Oligomer
uucagcaucugucugcucuac

SEQ ID NO: 19356 - RNA, 21 nt, Artificial Sequence
  RNA Oligomer
aaugacaguccaacacaaggg

SEQ ID NO: 19357 - RNA, 21 nt, Artificial Sequence
  RNA Oligomer
ucaccaucaaauguugguggg

SEQ ID NO: 19358 - RNA, 21 nt, Artificial Sequence
  RNA Oligomer
caccaucaaauguugguggga

SEQ ID NO: 19359 - RNA, 21 nt, Artificial Sequence
  RNA Oligomer
aaccuccagacaucuuaggga

SEQ ID NO: 19360 - RNA, 21 nt, Artificial Sequence
  RNA Oligomer
accuccagacaucuuagggag

SEQ ID NO: 19361 - RNA, 21 nt, Artificial Sequence
  RNA Oligomer
agggaggguuuuaugcuucug

SEQ ID NO: 19362 - RNA, 21 nt, Artificial Sequence
  RNA Oligomer
caguccaaggaaucuguguug

SEQ ID NO: 19363 - RNA, 21 nt, Artificial Sequence
  RNA Oligomer
aaagcuaacuucccugauaga

SEQ ID NO: 19364 - RNA, 21 nt, Artificial Sequence
  RNA Oligomer
agagaagaugucacucucagc

SEQ ID NO: 19365 - RNA, 21 nt, Artificial Sequence
  RNA Oligomer
caucaaauguuggugggaugc

SEQ ID NO: 19366 - RNA, 21 nt, Artificial Sequence
  RNA Oligomer
augucuagcuucagaguagga

SEQ ID NO: 19367 - RNA, 21 nt, Artificial Sequence
  RNA Oligomer
ucugcaaaaguguuguccacc

SEQ ID NO: 19368 - RNA, 21 nt, Artificial Sequence
  RNA Oligomer
guccaaggaaucuguguugag

SEQ ID NO: 19369 - RNA, 21 nt, Artificial Sequence
  RNA Oligomer
aacacaagggccuucuugcca

SEQ ID NO: 19370 - RNA, 21 nt, Artificial Sequence
  RNA Oligomer
cuagcuucagaguaggauuug

SEQ ID NO: 19371 - RNA, 21 nt, Artificial Sequence
  RNA Oligomer
uagcuucagaguaggauuugu

SEQ ID NO: 19372 - RNA, 21 nt, Artificial Sequence
  RNA Oligomer
gagaagaugucacucucagcc

SEQ ID NO: 19373 - RNA, 21 nt, Artificial Sequence
  RNA Oligomer
aagaugucacucucagccucg

SEQ ID NO: 19374 - RNA, 21 nt, Artificial Sequence
  RNA Oligomer
uuucaaagcacaugucuagcu

SEQ ID NO: 19375 - RNA, 21 nt, Artificial Sequence
  RNA Oligomer
uucaaagcacaugucuagcuu

SEQ ID NO: 19376 - RNA, 21 nt, Artificial Sequence
  RNA Oligomer
gaacacgugcagaugcaaagg

SEQ ID NO: 19377 - RNA, 21 nt, Artificial Sequence
  RNA Oligomer
caugucuagcuucagaguagg

SEQ ID NO: 19378 - RNA, 21 nt, Artificial Sequence
  RNA Oligomer
uucaaccuucugcccuugcga

SEQ ID NO: 19379 - RNA, 21 nt, Artificial Sequence
  RNA Oligomer
gguugucuacuaaagaaagau

SEQ ID NO: 19380 - RNA, 21 nt, Artificial Sequence
  RNA Oligomer
ggccuuauauaucacacuauu

SEQ ID NO: 19381 - RNA, 21 nt, Artificial Sequence
  RNA Oligomer
ggauuacuucugagcuugcaa

SEQ ID NO: 19382 - RNA, 21 nt, Artificial Sequence
  RNA Oligomer
ggagacauggaaaaaauacug

SEQ ID NO: 19383 - RNA, 21 nt, Artificial Sequence
  RNA Oligomer
ggaauuaagucuccgauuauu

SEQ ID NO: 19384 - RNA, 21 nt, Artificial Sequence
  RNA Oligomer
gugaauuuaauccucuccuuu

SEQ ID NO: 19385 - RNA, 21 nt, Artificial Sequence
  RNA Oligomer
cucugcauuggugaauuuaau

SEQ ID NO: 19386 - RNA, 21 nt, Artificial Sequence
  RNA Oligomer
cacucugcauuggugaauuua

SEQ ID NO: 19387 - RNA, 21 nt, Artificial Sequence
  RNA Oligomer
gccuuauauaucacacuauug

SEQ ID NO: 19388 - RNA, 21 nt, Artificial Sequence
  RNA Oligomer
gcacuucagcaauaaugggaa

SEQ ID NO: 19389 - RNA, 21 nt, Artificial Sequence
  RNA Oligomer
ugcauuggugaauuuaauccu

SEQ ID NO: 19390 - RNA, 21 nt, Artificial Sequence
  RNA Oligomer
ucugcauuggugaauuuaauc

SEQ ID NO: 19391 - RNA, 21 nt, Artificial Sequence
  RNA Oligomer
cagguugucuacuaaagaaag

SEQ ID NO: 19392 - RNA, 21 nt, Artificial Sequence
  RNA Oligomer
cuauaauuacaccuaugggau

SEQ ID NO: 19393 - RNA, 21 nt, Artificial Sequence
  RNA Oligomer
gaaaccaagauagagcuacaa

SEQ ID NO: 19394 - RNA, 21 nt, Artificial Sequence
  RNA Oligomer
uggccuuauauaucacacuau

SEQ ID NO: 19395 - RNA, 21 nt, Artificial Sequence
  RNA Oligomer
cuguaaaugcugcguuccuaa

SEQ ID NO: 19396 - RNA, 21 nt, Artificial Sequence
  RNA Oligomer
agacauggaaaaaauacugcu

SEQ ID NO: 19397 - RNA, 21 nt, Artificial Sequence
  RNA Oligomer
gacauggaaaaaauacugcug

SEQ ID NO: 19398 - RNA, 21 nt, Artificial Sequence
  RNA Oligomer
acuugguucguuaguggauua

SEQ ID NO: 19399 - RNA, 21 nt, Artificial Sequence
  RNA Oligomer
caaccuccaccagcaccuuuu

SEQ ID NO: 19400 - RNA, 21 nt, Artificial Sequence
  RNA Oligomer
gccucgguuucuauuuauaau

SEQ ID NO: 19401 - RNA, 21 nt, Artificial Sequence
  RNA Oligomer
agccucgguuucuauuuauaa

SEQ ID NO: 19402 - RNA, 21 nt, Artificial Sequence
  RNA Oligomer
cagccucgguuucuauuuaua

SEQ ID NO: 19403 - RNA, 21 nt, Artificial Sequence
  RNA Oligomer
ggaaagaaguugaaagcaucu

SEQ ID NO: 19404 - RNA, 21 nt, Artificial Sequence
  RNA Oligomer
gaaagaaggaaagaaguugaa

SEQ ID NO: 19405 - RNA, 21 nt, Artificial Sequence
  RNA Oligomer
cucuccuuuguguucaacuuu

SEQ ID NO: 19406 - RNA, 21 nt, Artificial Sequence
  RNA Oligomer
gaauuuaauccucuccuuugu

SEQ ID NO: 19407 - RNA, 21 nt, Artificial Sequence
  RNA Oligomer
guggccuuauauaucacacua

SEQ ID NO: 19408 - RNA, 21 nt, Artificial Sequence
  RNA Oligomer
cugauuaaugucuacugugaa

SEQ ID NO: 19409 - RNA, 21 nt, Artificial Sequence
  RNA Oligomer
gcugcguuccuaauuuaguaa

SEQ ID NO: 19410 - RNA, 21 nt, Artificial Sequence
  RNA Oligomer
ccaucucugcugcucucucau

SEQ ID NO: 19411 - RNA, 21 nt, Artificial Sequence
  RNA Oligomer
agaaguugaaagcaucuugaa

SEQ ID NO: 19412 - RNA, 21 nt, Artificial Sequence
  RNA Oligomer
uucuaagcaaaucugugucua

SEQ ID NO: 19413 - RNA, 21 nt, Artificial Sequence
  RNA Oligomer
ucuuuaucacucugcauuggu

SEQ ID NO: 19414 - RNA, 21 nt, Artificial Sequence
  RNA Oligomer
ccaagagcucucacugugaca

SEQ ID NO: 19415 - RNA, 21 nt, Artificial Sequence
  RNA Oligomer
agaaaccaagauagagcuaca

SEQ ID NO: 19416 - RNA, 21 nt, Artificial Sequence
  RNA Oligomer
acagaaaccaagauagagcua

SEQ ID NO: 19417 - RNA, 21 nt, Artificial Sequence
  RNA Oligomer
gucuacugugaaaauuuggua

SEQ ID NO: 19418 - RNA, 21 nt, Artificial Sequence
  RNA Oligomer
uaauuacaccuaugggaucaa

SEQ ID NO: 19419 - RNA, 21 nt, Artificial Sequence
  RNA Oligomer
aaaugcugcguuccuaauuua

SEQ ID NO: 19420 - RNA, 21 nt, Artificial Sequence
  RNA Oligomer
guaaaugcugcguuccuaauu

SEQ ID NO: 19421 - RNA, 21 nt, Artificial Sequence
  RNA Oligomer
ccucuccuuuguguucaacuu

SEQ ID NO: 19422 - RNA, 21 nt, Artificial Sequence
  RNA Oligomer
ugaauuuaauccucuccuuug

SEQ ID NO: 19423 - RNA, 21 nt, Artificial Sequence
  RNA Oligomer
accuuaauucagcugaaguac

SEQ ID NO: 19424 - RNA, 21 nt, Artificial Sequence
  RNA Oligomer
cuagucaugauguguguugua

SEQ ID NO: 19425 - RNA, 21 nt, Artificial Sequence
  RNA Oligomer
guugaaagcaucuugaagaaa

SEQ ID NO: 19426 - RNA, 21 nt, Artificial Sequence
  RNA Oligomer
aguugaaagcaucuugaagaa

SEQ ID NO: 19427 - RNA, 21 nt, Artificial Sequence
  RNA Oligomer
ggaagaugauauugaaagaag

SEQ ID NO: 19428 - RNA, 21 nt, Artificial Sequence
  RNA Oligomer
uccucuccuuuguguucaacu

SEQ ID NO: 19429 - RNA, 21 nt, Artificial Sequence
  RNA Oligomer
ucguacacuaaacucuucuug

SEQ ID NO: 19430 - RNA, 21 nt, Artificial Sequence
  RNA Oligomer
uucguacacuaaacucuucuu

SEQ ID NO: 19431 - RNA, 21 nt, Artificial Sequence
  RNA Oligomer
cugcguuccuaauuuaguaaa

SEQ ID NO: 19432 - RNA, 21 nt, Artificial Sequence
  RNA Oligomer
gacuugguucguuaguggauu

SEQ ID NO: 19433 - RNA, 21 nt, Artificial Sequence
  RNA Oligomer
ugacuugguucguuaguggau

SEQ ID NO: 19434 - RNA, 21 nt, Artificial Sequence
  RNA Oligomer
cuauuuauaauggagacaugg

SEQ ID NO: 19435 - RNA, 21 nt, Artificial Sequence
  RNA Oligomer
gcucucucauuugcuggccau

SEQ ID NO: 19436 - RNA, 21 nt, Artificial Sequence
  RNA Oligomer
ccuggguagaacugcacuuca

SEQ ID NO: 19437 - RNA, 21 nt, Artificial Sequence
  RNA Oligomer
cacuucagcaauaaugggaac

SEQ ID NO: 19438 - RNA, 21 nt, Artificial Sequence
  RNA Oligomer
aggaaagaaguugaaagcauc

SEQ ID NO: 19439 - RNA, 21 nt, Artificial Sequence
  RNA Oligomer
ugaaagaaggaaagaaguuga

SEQ ID NO: 19440 - RNA, 21 nt, Artificial Sequence
  RNA Oligomer
uacacuaaacucuucuugcuu

SEQ ID NO: 19441 - RNA, 21 nt, Artificial Sequence
  RNA Oligomer
agcaugagucuggacggagua

SEQ ID NO: 19442 - RNA, 21 nt, Artificial Sequence
  RNA Oligomer
gggaucaauaagcaugucaga

SEQ ID NO: 19443 - RNA, 21 nt, Artificial Sequence
  RNA Oligomer
ugcugcguuccuaauuuagua

SEQ ID NO: 19444 - RNA, 21 nt, Artificial Sequence
  RNA Oligomer
gaaagcaucuugaagaaaaac

SEQ ID NO: 19445 - RNA, 21 nt, Artificial Sequence
  RNA Oligomer
cugacuugguucguuagugga

SEQ ID NO: 19446 - RNA, 21 nt, Artificial Sequence
  RNA Oligomer
guuccucuuuaaacacccgaa

SEQ ID NO: 19447 - RNA, 21 nt, Artificial Sequence
  RNA Oligomer
gaaagaaguugaaagcaucuu

SEQ ID NO: 19448 - RNA, 21 nt, Artificial Sequence
  RNA Oligomer
gaaggaaagaaguugaaagca

SEQ ID NO: 19449 - RNA, 21 nt, Artificial Sequence
  RNA Oligomer
gaggaagaugauauugaaaga

SEQ ID NO: 19450 - RNA, 21 nt, Artificial Sequence
  RNA Oligomer
ucuuuuccucuuuaucacucu

SEQ ID NO: 19451 - RNA, 21 nt, Artificial Sequence
  RNA Oligomer
guacacuaaacucuucuugcu

SEQ ID NO: 19452 - RNA, 21 nt, Artificial Sequence
  RNA Oligomer
ggaugcagguugucuacuaaa

SEQ ID NO: 19453 - RNA, 21 nt, Artificial Sequence
  RNA Oligomer
agucaugauguguguuguauu

SEQ ID NO: 19454 - RNA, 21 nt, Artificial Sequence
  RNA Oligomer
ccucuuuaucacucugcauug

SEQ ID NO: 19455 - RNA, 21 nt, Artificial Sequence
  RNA Oligomer
gucaugauguguguuguauuu

SEQ ID NO: 19456 - RNA, 21 nt, Artificial Sequence
  RNA Oligomer
uaagcaugucagacugauuaa

SEQ ID NO: 19457 - RNA, 21 nt, Artificial Sequence
  RNA Oligomer
gcauauucucugcagaauuuc

SEQ ID NO: 19458 - RNA, 21 nt, Artificial Sequence
  RNA Oligomer
ggagagaaaaacagcucacag

SEQ ID NO: 19459 - RNA, 21 nt, Artificial Sequence
  RNA Oligomer
guaucuuuuccucuuuaucac

SEQ ID NO: 19460 - RNA, 21 nt, Artificial Sequence
  RNA Oligomer
gcagguugucuacuaaagaaa

SEQ ID NO: 19461 - RNA, 21 nt, Artificial Sequence
  RNA Oligomer
auacuagucaugauguguguu

SEQ ID NO: 19462 - RNA, 21 nt, Artificial Sequence
  RNA Oligomer
gcaugucagacugauuaaugu

SEQ ID NO: 19463 - RNA, 21 nt, Artificial Sequence
  RNA Oligomer
agcaugucagacugauuaaug

SEQ ID NO: 19464 - RNA, 21 nt, Artificial Sequence
  RNA Oligomer
cuaugggaucaauaagcaugu

SEQ ID NO: 19465 - RNA, 21 nt, Artificial Sequence
  RNA Oligomer
ggcauauucucugcagaauuu

SEQ ID NO: 19466 - RNA, 21 nt, Artificial Sequence
  RNA Oligomer
gaagaugauauugaaagaagg

SEQ ID NO: 19467 - RNA, 21 nt, Artificial Sequence
  RNA Oligomer
caauaagcaugucagacugau

SEQ ID NO: 19468 - RNA, 21 nt, Artificial Sequence
  RNA Oligomer
ugggaucaauaagcaugucag

SEQ ID NO: 19469 - RNA, 21 nt, Artificial Sequence
  RNA Oligomer
cgguuucuauuuauaauggag

SEQ ID NO: 19470 - RNA, 21 nt, Artificial Sequence
  RNA Oligomer
cucucucauuugcuggccauc

SEQ ID NO: 19471 - RNA, 21 nt, Artificial Sequence
  RNA Oligomer
gugugcuuuuaaaaucagcuu

SEQ ID NO: 19472 - RNA, 21 nt, Artificial Sequence
  RNA Oligomer
uccucuuuaucacucugcauu

SEQ ID NO: 19473 - RNA, 21 nt, Artificial Sequence
  RNA Oligomer
uuccucuuuaucacucugcau

SEQ ID NO: 19474 - RNA, 21 nt, Artificial Sequence
  RNA Oligomer
uggaugcagguugucuacuaa

SEQ ID NO: 19475 - RNA, 21 nt, Artificial Sequence
  RNA Oligomer
ggaucaauaagcaugucagac

SEQ ID NO: 19476 - RNA, 21 nt, Artificial Sequence
  RNA Oligomer
cugcagaauuucugaaaguuu

SEQ ID NO: 19477 - RNA, 21 nt, Artificial Sequence
  RNA Oligomer
gggcauauucucugcagaauu

SEQ ID NO: 19478 - RNA, 21 nt, Artificial Sequence
  RNA Oligomer
gcauuggagagaaaaacagcu

SEQ ID NO: 19479 - RNA, 21 nt, Artificial Sequence
  RNA Oligomer
cucuucuugcuuuugcauuau

SEQ ID NO: 19480 - RNA, 21 nt, Artificial Sequence
  RNA Oligomer
gccacgucacuuguguuuauu

SEQ ID NO: 19481 - RNA, 21 nt, Artificial Sequence
  RNA Oligomer
ccucgguuucuauuuauaaug

SEQ ID NO: 19482 - RNA, 21 nt, Artificial Sequence
  RNA Oligomer
aggaauuaagucuccgauuau

SEQ ID NO: 19483 - RNA, 21 nt, Artificial Sequence
  RNA Oligomer
uaaggaauuaagucuccgauu

SEQ ID NO: 19484 - RNA, 21 nt, Artificial Sequence
  RNA Oligomer
gcagaauuucugaaaguuuuc

SEQ ID NO: 19485 - RNA, 21 nt, Artificial Sequence
  RNA Oligomer
gaaaaacagcucacagucuga

SEQ ID NO: 19486 - RNA, 21 nt, Artificial Sequence
  RNA Oligomer
agaacugcacuucagcaauaa

SEQ ID NO: 19487 - RNA, 21 nt, Artificial Sequence
  RNA Oligomer
auaaggaauuaagucuccgau

SEQ ID NO: 19488 - RNA, 21 nt, Artificial Sequence
  RNA Oligomer
gcuguacaguucguacacuaa

SEQ ID NO: 19489 - RNA, 21 nt, Artificial Sequence
  RNA Oligomer
cccaaggaguuccucuuuaaa

SEQ ID NO: 19490 - RNA, 21 nt, Artificial Sequence
  RNA Oligomer
agagaaaaacagcucacaguc

SEQ ID NO: 19491 - RNA, 21 nt, Artificial Sequence
  RNA Oligomer
uggagagaaaaacagcucaca

SEQ ID NO: 19492 - RNA, 21 nt, Artificial Sequence
  RNA Oligomer
gaacugcacuucagcaauaau

SEQ ID NO: 19493 - RNA, 21 nt, Artificial Sequence
  RNA Oligomer
ucacucugcauuggugaauuu

SEQ ID NO: 19494 - RNA, 21 nt, Artificial Sequence
  RNA Oligomer
cacuaaacucuucuugcuuuu

SEQ ID NO: 19495 - RNA, 21 nt, Artificial Sequence
  RNA Oligomer
gaaaaaauacugcuggacgca

SEQ ID NO: 19496 - RNA, 21 nt, Artificial Sequence
  RNA Oligomer
ccacgucacuuguguuuauuu

SEQ ID NO: 19497 - RNA, 21 nt, Artificial Sequence
  RNA Oligomer
ccaacagggcuucugaaacag

SEQ ID NO: 19498 - RNA, 21 nt, Artificial Sequence
  RNA Oligomer
cagcuuuauucuaagcaaauc

SEQ ID NO: 19499 - RNA, 21 nt, Artificial Sequence
  RNA Oligomer
ggugaauuuaauccucuccuu

SEQ ID NO: 19500 - RNA, 21 nt, Artificial Sequence
  RNA Oligomer
gcauuggugaauuuaauccuc

SEQ ID NO: 19501 - RNA, 21 nt, Artificial Sequence
  RNA Oligomer
aaggaauuaagucuccgauua

SEQ ID NO: 19502 - RNA, 21 nt, Artificial Sequence
  RNA Oligomer
agcuguacaguucguacacua

SEQ ID NO: 19503 - RNA, 21 nt, Artificial Sequence
  RNA Oligomer
cccauagcauuggagagaaaa

SEQ ID NO: 19504 - RNA, 21 nt, Artificial Sequence
  RNA Oligomer
cuucugaaacagauacccaua

SEQ ID NO: 19505 - RNA, 21 nt, Artificial Sequence
  RNA Oligomer
cuccgauuauuaggugaucac

SEQ ID NO: 19506 - RNA, 21 nt, Artificial Sequence
  RNA Oligomer
ugcaaccuuaauucagcugaa

SEQ ID NO: 19507 - RNA, 21 nt, Artificial Sequence
  RNA Oligomer
ggccacgucacuuguguuuau

SEQ ID NO: 19508 - RNA, 21 nt, Artificial Sequence
  RNA Oligomer
gcaacauagcucacugaagag

SEQ ID NO: 19509 - RNA, 21 nt, Artificial Sequence
  RNA Oligomer
uccuuccaucucugcugcucu

SEQ ID NO: 19510 - RNA, 21 nt, Artificial Sequence
  RNA Oligomer
ccagccucgguuucuauuuau

SEQ ID NO: 19511 - RNA, 21 nt, Artificial Sequence
  RNA Oligomer
ccauagcauuggagagaaaaa

SEQ ID NO: 19512 - RNA, 21 nt, Artificial Sequence
  RNA Oligomer
cccuggaugaucaguuuucug

SEQ ID NO: 19513 - RNA, 21 nt, Artificial Sequence
  RNA Oligomer
ucacccuggaugaucaguuuu

SEQ ID NO: 19514 - RNA, 21 nt, Artificial Sequence
  RNA Oligomer
ggaaaaaauacugcuggacgc

SEQ ID NO: 19515 - RNA, 21 nt, Artificial Sequence
  RNA Oligomer
cuugcaacauagcucacugaa

SEQ ID NO: 19516 - RNA, 21 nt, Artificial Sequence
  RNA Oligomer
gcuugcaacauagcucacuga

SEQ ID NO: 19517 - RNA, 21 nt, Artificial Sequence
  RNA Oligomer
ucugaaaguuuuccuuccauc

SEQ ID NO: 19518 - RNA, 21 nt, Artificial Sequence
  RNA Oligomer
gaggaacacgagcgucaugaa

SEQ ID NO: 19519 - RNA, 21 nt, Artificial Sequence
  RNA Oligomer
acccauagcauuggagagaaa

SEQ ID NO: 19520 - RNA, 21 nt, Artificial Sequence
  RNA Oligomer
uaagcaaaucugugucuacuu

SEQ ID NO: 19521 - RNA, 21 nt, Artificial Sequence
  RNA Oligomer
gcuuuauucuaagcaaaucug

SEQ ID NO: 19522 - RNA, 21 nt, Artificial Sequence
  RNA Oligomer
gcagacaccacaagauaccaa

SEQ ID NO: 19523 - RNA, 21 nt, Artificial Sequence
  RNA Oligomer
acucuucuugcuuuugcauua

SEQ ID NO: 19524 - RNA, 21 nt, Artificial Sequence
  RNA Oligomer
ugaaacagauacccauagcau

SEQ ID NO: 19525 - RNA, 21 nt, Artificial Sequence
  RNA Oligomer
cuggaugaucaguuuucugcu

SEQ ID NO: 19526 - RNA, 21 nt, Artificial Sequence
  RNA Oligomer
caguucguacacuaaacucuu

SEQ ID NO: 19527 - RNA, 21 nt, Artificial Sequence
  RNA Oligomer
guacaguucguacacuaaacu

SEQ ID NO: 19528 - RNA, 21 nt, Artificial Sequence
  RNA Oligomer
cuacaaacucagcuguacagu

SEQ ID NO: 19529 - RNA, 21 nt, Artificial Sequence
  RNA Oligomer
agcuacaaacucagcuguaca

SEQ ID NO: 19530 - RNA, 21 nt, Artificial Sequence
  RNA Oligomer
ugcagguugucuacuaaagaa

SEQ ID NO: 19531 - RNA, 21 nt, Artificial Sequence
  RNA Oligomer
gcaaccuuaauucagcugaag

SEQ ID NO: 19532 - RNA, 21 nt, Artificial Sequence
  RNA Oligomer
cucacugaagagcuguuagau

SEQ ID NO: 19533 - RNA, 21 nt, Artificial Sequence
  RNA Oligomer
ccaccagcaccuuuugaugaa

SEQ ID NO: 19534 - RNA, 21 nt, Artificial Sequence
  RNA Oligomer
ucugcagaauuucugaaaguu

SEQ ID NO: 19535 - RNA, 21 nt, Artificial Sequence
  RNA Oligomer
cucugcagaauuucugaaagu

SEQ ID NO: 19536 - RNA, 21 nt, Artificial Sequence
  RNA Oligomer
gaacacgagcgucaugaagaa

SEQ ID NO: 19537 - RNA, 21 nt, Artificial Sequence
  RNA Oligomer
uacccauagcauuggagagaa

SEQ ID NO: 19538 - RNA, 21 nt, Artificial Sequence
  RNA Oligomer
ggaugaucaguuuucugcuga

SEQ ID NO: 19539 - RNA, 21 nt, Artificial Sequence
  RNA Oligomer
uggccacgucacuuguguuua

SEQ ID NO: 19540 - RNA, 21 nt, Artificial Sequence
  RNA Oligomer
cugaaaguuuuccuuccaucu

SEQ ID NO: 19541 - RNA, 21 nt, Artificial Sequence
  RNA Oligomer
uucugaaaguuuuccuuccau

SEQ ID NO: 19542 - RNA, 21 nt, Artificial Sequence
  RNA Oligomer
cguuccagccucgguuucuau

SEQ ID NO: 19543 - RNA, 21 nt, Artificial Sequence
  RNA Oligomer
cacaagauaccaacagggcuu

SEQ ID NO: 19544 - RNA, 21 nt, Artificial Sequence
  RNA Oligomer
guagaacugcacuucagcaau

SEQ ID NO: 19545 - RNA, 21 nt, Artificial Sequence
  RNA Oligomer
acccuggaugaucaguuuucu

SEQ ID NO: 19546 - RNA, 21 nt, Artificial Sequence
  RNA Oligomer
cgauuauuaggugaucacccu

SEQ ID NO: 19547 - RNA, 21 nt, Artificial Sequence
  RNA Oligomer
agucuccgauuauuaggugau

SEQ ID NO: 19548 - RNA, 21 nt, Artificial Sequence
  RNA Oligomer
aaacucuucuugcuuuugcau

SEQ ID NO: 19549 - RNA, 21 nt, Artificial Sequence
  RNA Oligomer
gacacuaaaaucauguugauc

SEQ ID NO: 19550 - RNA, 21 nt, Artificial Sequence
  RNA Oligomer
uucucugcagaauuucugaaa

SEQ ID NO: 19551 - RNA, 21 nt, Artificial Sequence
  RNA Oligomer
ggaacacgagcgucaugaaga

SEQ ID NO: 19552 - RNA, 21 nt, Artificial Sequence
  RNA Oligomer
agauacccauagcauuggaga

SEQ ID NO: 19553 - RNA, 21 nt, Artificial Sequence
  RNA Oligomer
gaaacagauacccauagcauu

SEQ ID NO: 19554 - RNA, 21 nt, Artificial Sequence
  RNA Oligomer
uggugaauuuaauccucuccu

SEQ ID NO: 19555 - RNA, 21 nt, Artificial Sequence
  RNA Oligomer
aucacucugcauuggugaauu

SEQ ID NO: 19556 - RNA, 21 nt, Artificial Sequence
  RNA Oligomer
gucuccgauuauuaggugauc

SEQ ID NO: 19557 - RNA, 21 nt, Artificial Sequence
  RNA Oligomer
auacugcuggacgcacagcau

SEQ ID NO: 19558 - RNA, 21 nt, Artificial Sequence
  RNA Oligomer
caaccuuaauucagcugaagu

SEQ ID NO: 19559 - RNA, 21 nt, Artificial Sequence
  RNA Oligomer
ccuccaccagcaccuuuugau

SEQ ID NO: 19560 - RNA, 21 nt, Artificial Sequence
  RNA Oligomer
ccaaggaguuccucuuuaaac

SEQ ID NO: 19561 - RNA, 21 nt, Artificial Sequence
  RNA Oligomer
acagauacccauagcauugga

SEQ ID NO: 19562 - RNA, 21 nt, Artificial Sequence
  RNA Oligomer
cugaaacagauacccauagca

SEQ ID NO: 19563 - RNA, 21 nt, Artificial Sequence
  RNA Oligomer
agauaccaacagggcuucuga

SEQ ID NO: 19564 - RNA, 21 nt, Artificial Sequence
  RNA Oligomer
ugaaggcaccuacucaguauc

SEQ ID NO: 19565 - RNA, 21 nt, Artificial Sequence
  RNA Oligomer
cuguacaguucguacacuaaa

SEQ ID NO: 19566 - RNA, 21 nt, Artificial Sequence
  RNA Oligomer
ucagcuguacaguucguacac

SEQ ID NO: 19567 - RNA, 21 nt, Artificial Sequence
  RNA Oligomer
cuacugugaaaauuugguagu

SEQ ID NO: 19568 - RNA, 21 nt, Artificial Sequence
  RNA Oligomer
acagggcuucugaaacagaua

SEQ ID NO: 19569 - RNA, 21 nt, Artificial Sequence
  RNA Oligomer
cgcagacaccacaagauacca

SEQ ID NO: 19570 - RNA, 21 nt, Artificial Sequence
  RNA Oligomer
aggcaccuacucaguaucuuu

SEQ ID NO: 19571 - RNA, 21 nt, Artificial Sequence
  RNA Oligomer
gcucgcagacaccacaagaua

SEQ ID NO: 19572 - RNA, 21 nt, Artificial Sequence
  RNA Oligomer
gugaucacccuggaugaucag

SEQ ID NO: 19573 - RNA, 21 nt, Artificial Sequence
  RNA Oligomer
uaaacucuucuugcuuuugca

SEQ ID NO: 19574 - RNA, 21 nt, Artificial Sequence
  RNA Oligomer
acacuaaacucuucuugcuuu

SEQ ID NO: 19575 - RNA, 21 nt, Artificial Sequence
  RNA Oligomer
cuuaauucagcugaaguacuu

SEQ ID NO: 19576 - RNA, 21 nt, Artificial Sequence
  RNA Oligomer
agacugauuaaugucuacugu

SEQ ID NO: 19577 - RNA, 21 nt, Artificial Sequence
  RNA Oligomer
accuaugggaucaauaagcau

SEQ ID NO: 19578 - RNA, 21 nt, Artificial Sequence
  RNA Oligomer
agcuugcaacauagcucacug

SEQ ID NO: 19579 - RNA, 21 nt, Artificial Sequence
  RNA Oligomer
cuccaccagcaccuuuugaug

SEQ ID NO: 19580 - RNA, 21 nt, Artificial Sequence
  RNA Oligomer
aaaguuuuccuuccaucucug

SEQ ID NO: 19581 - RNA, 21 nt, Artificial Sequence
  RNA Oligomer
gaaaguuuuccuuccaucucu

SEQ ID NO: 19582 - RNA, 21 nt, Artificial Sequence
  RNA Oligomer
caugaggaacacgagcgucau

SEQ ID NO: 19583 - RNA, 21 nt, Artificial Sequence
  RNA Oligomer
ggaguuccucuuuaaacaccc

SEQ ID NO: 19584 - RNA, 21 nt, Artificial Sequence
  RNA Oligomer
caagauaccaacagggcuucu

SEQ ID NO: 19585 - RNA, 21 nt, Artificial Sequence
  RNA Oligomer
ccacaagauaccaacagggcu

SEQ ID NO: 19586 - RNA, 21 nt, Artificial Sequence
  RNA Oligomer
gaugaucaguuuucugcugaa

SEQ ID NO: 19587 - RNA, 21 nt, Artificial Sequence
  RNA Oligomer
gguagaacugcacuucagcaa

SEQ ID NO: 19588 - RNA, 21 nt, Artificial Sequence
  RNA Oligomer
caccuaugggaucaauaagca

SEQ ID NO: 19589 - RNA, 21 nt, Artificial Sequence
  RNA Oligomer
caccagcaccuuuugaugaag

SEQ ID NO: 19590 - RNA, 21 nt, Artificial Sequence
  RNA Oligomer
acaagauaccaacagggcuuc

SEQ ID NO: 19591 - RNA, 21 nt, Artificial Sequence
  RNA Oligomer
ugcugaaggcaccuacucagu

SEQ ID NO: 19592 - RNA, 21 nt, Artificial Sequence
  RNA Oligomer
aucacccuggaugaucaguuu

SEQ ID NO: 19593 - RNA, 21 nt, Artificial Sequence
  RNA Oligomer
ggguagaacugcacuucagca

SEQ ID NO: 19594 - RNA, 21 nt, Artificial Sequence
  RNA Oligomer
cugcaaccuuaauucagcuga

SEQ ID NO: 19595 - RNA, 21 nt, Artificial Sequence
  RNA Oligomer
gacugauuaaugucuacugug

SEQ ID NO: 19596 - RNA, 21 nt, Artificial Sequence
  RNA Oligomer
ucagacugauuaaugucuacu

SEQ ID NO: 19597 - RNA, 21 nt, Artificial Sequence
  RNA Oligomer
cagauacccauagcauuggag

SEQ ID NO: 19598 - RNA, 21 nt, Artificial Sequence
  RNA Oligomer
agacaccacaagauaccaaca

SEQ ID NO: 19599 - RNA, 21 nt, Artificial Sequence
  RNA Oligomer
cugaaggcaccuacucaguau

SEQ ID NO: 19600 - RNA, 21 nt, Artificial Sequence
  RNA Oligomer
gcugaaggcaccuacucagua

SEQ ID NO: 19601 - RNA, 21 nt, Artificial Sequence
  RNA Oligomer
cagacugauuaaugucuacug

SEQ ID NO: 19602 - RNA, 21 nt, Artificial Sequence
  RNA Oligomer
gucagacugauuaaugucuac

SEQ ID NO: 19603 - RNA, 21 nt, Artificial Sequence
  RNA Oligomer
ugagcuugcaacauagcucac

SEQ ID NO: 19604 - RNA, 21 nt, Artificial Sequence
  RNA Oligomer
uccagccucgguuucuauuua

SEQ ID NO: 19605 - RNA, 21 nt, Artificial Sequence
  RNA Oligomer
gcaucuugaagaaaaacucag

SEQ ID NO: 19606 - RNA, 21 nt, Artificial Sequence
  RNA Oligomer
ccaaaauaaauauuguggccu

SEQ ID NO: 19607 - RNA, 21 nt, Artificial Sequence
  RNA Oligomer
ugucagacugauuaaugucua

SEQ ID NO: 19608 - RNA, 21 nt, Artificial Sequence
  RNA Oligomer
ucaauaagcaugucagacuga

SEQ ID NO: 19609 - RNA, 21 nt, Artificial Sequence
  RNA Oligomer
agcaucuugaagaaaaacuca

SEQ ID NO: 19610 - RNA, 21 nt, Artificial Sequence
  RNA Oligomer
gaaggcaccuacucaguaucu

SEQ ID NO: 19611 - RNA, 21 nt, Artificial Sequence
  RNA Oligomer
caaggaguuccucuuuaaaca

SEQ ID NO: 19612 - RNA, 21 nt, Artificial Sequence
  RNA Oligomer
ugcucucucauuugcuggcca

SEQ ID NO: 19613 - RNA, 21 nt, Artificial Sequence
  RNA Oligomer
ggcuucugaaacagauaccca

SEQ ID NO: 19614 - RNA, 21 nt, Artificial Sequence
  RNA Oligomer
cuccaagagcucucacuguga

SEQ ID NO: 19615 - RNA, 21 nt, Artificial Sequence
  RNA Oligomer
gcuucugaaacagauacccau

SEQ ID NO: 19616 - RNA, 21 nt, Artificial Sequence
  RNA Oligomer
agcucacugaagagcuguuag

SEQ ID NO: 19617 - RNA, 21 nt, Artificial Sequence
  RNA Oligomer
caacagggcuucugaaacaga

SEQ ID NO: 19618 - RNA, 21 nt, Artificial Sequence
  RNA Oligomer
uagcucacugaagagcuguua

SEQ ID NO: 19619 - RNA, 21 nt, Artificial Sequence
  RNA Oligomer
gggcuucugaaacagauaccc

SEQ ID NO: 19620 - RNA, 21 nt, Artificial Sequence
  RNA Oligomer
aucuuucuuuaguagacaacc

SEQ ID NO: 19621 - RNA, 21 nt, Artificial Sequence
  RNA Oligomer
aauagugugauauauaaggcc

SEQ ID NO: 19622 - RNA, 21 nt, Artificial Sequence
  RNA Oligomer
uugcaagcucagaaguaaucc

SEQ ID NO: 19623 - RNA, 21 nt, Artificial Sequence
  RNA Oligomer
caguauuuuuuccaugucucc

SEQ ID NO: 19624 - RNA, 21 nt, Artificial Sequence
  RNA Oligomer
aauaaucggagacuuaauucc

SEQ ID NO: 19625 - RNA, 21 nt, Artificial Sequence
  RNA Oligomer
aaaggagaggauuaaauucac

SEQ ID NO: 19626 - RNA, 21 nt, Artificial Sequence
  RNA Oligomer
auuaaauucaccaaugcagag

SEQ ID NO: 19627 - RNA, 21 nt, Artificial Sequence
  RNA Oligomer
uaaauucaccaaugcagagug

SEQ ID NO: 19628 - RNA, 21 nt, Artificial Sequence
  RNA Oligomer
caauagugugauauauaaggc

SEQ ID NO: 19629 - RNA, 21 nt, Artificial Sequence
  RNA Oligomer
uucccauuauugcugaagugc

SEQ ID NO: 19630 - RNA, 21 nt, Artificial Sequence
  RNA Oligomer
aggauuaaauucaccaaugca

SEQ ID NO: 19631 - RNA, 21 nt, Artificial Sequence
  RNA Oligomer
gauuaaauucaccaaugcaga

SEQ ID NO: 19632 - RNA, 21 nt, Artificial Sequence
  RNA Oligomer
cuuucuuuaguagacaaccug

SEQ ID NO: 19633 - RNA, 21 nt, Artificial Sequence
  RNA Oligomer
aucccauagguguaauuauag

SEQ ID NO: 19634 - RNA, 21 nt, Artificial Sequence
  RNA Oligomer
uuguagcucuaucuugguuuc

SEQ ID NO: 19635 - RNA, 21 nt, Artificial Sequence
  RNA Oligomer
auagugugauauauaaggcca

SEQ ID NO: 19636 - RNA, 21 nt, Artificial Sequence
  RNA Oligomer
uuaggaacgcagcauuuacag

SEQ ID NO: 19637 - RNA, 21 nt, Artificial Sequence
  RNA Oligomer
agcaguauuuuuuccaugucu

SEQ ID NO: 19638 - RNA, 21 nt, Artificial Sequence
  RNA Oligomer
cagcaguauuuuuuccauguc

SEQ ID NO: 19639 - RNA, 21 nt, Artificial Sequence
  RNA Oligomer
uaauccacuaacgaaccaagu

SEQ ID NO: 19640 - RNA, 21 nt, Artificial Sequence
  RNA Oligomer
aaaaggugcugguggagguug

SEQ ID NO: 19641 - RNA, 21 nt, Artificial Sequence
  RNA Oligomer
auuauaaauagaaaccgaggc

SEQ ID NO: 19642 - RNA, 21 nt, Artificial Sequence
  RNA Oligomer
uuauaaauagaaaccgaggcu

SEQ ID NO: 19643 - RNA, 21 nt, Artificial Sequence
  RNA Oligomer
uauaaauagaaaccgaggcug

SEQ ID NO: 19644 - RNA, 21 nt, Artificial Sequence
  RNA Oligomer
agaugcuuucaacuucuuucc

SEQ ID NO: 19645 - RNA, 21 nt, Artificial Sequence
  RNA Oligomer
uucaacuucuuuccuucuuuc

SEQ ID NO: 19646 - RNA, 21 nt, Artificial Sequence
  RNA Oligomer
aaaguugaacacaaaggagag

SEQ ID NO: 19647 - RNA, 21 nt, Artificial Sequence
  RNA Oligomer
acaaaggagaggauuaaauuc

SEQ ID NO: 19648 - RNA, 21 nt, Artificial Sequence
  RNA Oligomer
uagugugauauauaaggccac

SEQ ID NO: 19649 - RNA, 21 nt, Artificial Sequence
  RNA Oligomer
uucacaguagacauuaaucag

SEQ ID NO: 19650 - RNA, 21 nt, Artificial Sequence
  RNA Oligomer
uuacuaaauuaggaacgcagc

SEQ ID NO: 19651 - RNA, 21 nt, Artificial Sequence
  RNA Oligomer
augagagagcagcagagaugg

SEQ ID NO: 19652 - RNA, 21 nt, Artificial Sequence
  RNA Oligomer
uucaagaugcuuucaacuucu

SEQ ID NO: 19653 - RNA, 21 nt, Artificial Sequence
  RNA Oligomer
uagacacagauuugcuuagaa

SEQ ID NO: 19654 - RNA, 21 nt, Artificial Sequence
  RNA Oligomer
accaaugcagagugauaaaga

SEQ ID NO: 19655 - RNA, 21 nt, Artificial Sequence
  RNA Oligomer
ugucacagugagagcucuugg

SEQ ID NO: 19656 - RNA, 21 nt, Artificial Sequence
  RNA Oligomer
uguagcucuaucuugguuucu

SEQ ID NO: 19657 - RNA, 21 nt, Artificial Sequence
  RNA Oligomer
uagcucuaucuugguuucugu

SEQ ID NO: 19658 - RNA, 21 nt, Artificial Sequence
  RNA Oligomer
uaccaaauuuucacaguagac

SEQ ID NO: 19659 - RNA, 21 nt, Artificial Sequence
  RNA Oligomer
uugaucccauagguguaauua

SEQ ID NO: 19660 - RNA, 21 nt, Artificial Sequence
  RNA Oligomer
uaaauuaggaacgcagcauuu

SEQ ID NO: 19661 - RNA, 21 nt, Artificial Sequence
  RNA Oligomer
aauuaggaacgcagcauuuac

SEQ ID NO: 19662 - RNA, 21 nt, Artificial Sequence
  RNA Oligomer
aaguugaacacaaaggagagg

SEQ ID NO: 19663 - RNA, 21 nt, Artificial Sequence
  RNA Oligomer
caaaggagaggauuaaauuca

SEQ ID NO: 19664 - RNA, 21 nt, Artificial Sequence
  RNA Oligomer
guacuucagcugaauuaaggu

SEQ ID NO: 19665 - RNA, 21 nt, Artificial Sequence
  RNA Oligomer
uacaacacacaucaugacuag

SEQ ID NO: 19666 - RNA, 21 nt, Artificial Sequence
  RNA Oligomer
uuucuucaagaugcuuucaac

SEQ ID NO: 19667 - RNA, 21 nt, Artificial Sequence
  RNA Oligomer
uucuucaagaugcuuucaacu

SEQ ID NO: 19668 - RNA, 21 nt, Artificial Sequence
  RNA Oligomer
cuucuuucaauaucaucuucc

SEQ ID NO: 19669 - RNA, 21 nt, Artificial Sequence
  RNA Oligomer
aguugaacacaaaggagagga

SEQ ID NO: 19670 - RNA, 21 nt, Artificial Sequence
  RNA Oligomer
caagaagaguuuaguguacga

SEQ ID NO: 19671 - RNA, 21 nt, Artificial Sequence
  RNA Oligomer
aagaagaguuuaguguacgaa

SEQ ID NO: 19672 - RNA, 21 nt, Artificial Sequence
  RNA Oligomer
uuuacuaaauuaggaacgcag

SEQ ID NO: 19673 - RNA, 21 nt, Artificial Sequence
  RNA Oligomer
aauccacuaacgaaccaaguc

SEQ ID NO: 19674 - RNA, 21 nt, Artificial Sequence
  RNA Oligomer
auccacuaacgaaccaaguca

SEQ ID NO: 19675 - RNA, 21 nt, Artificial Sequence
  RNA Oligomer
ccaugucuccauuauaaauag

SEQ ID NO: 19676 - RNA, 21 nt, Artificial Sequence
  RNA Oligomer
auggccagcaaaugagagagc

SEQ ID NO: 19677 - RNA, 21 nt, Artificial Sequence
  RNA Oligomer
ugaagugcaguucuacccagg

SEQ ID NO: 19678 - RNA, 21 nt, Artificial Sequence
  RNA Oligomer
guucccauuauugcugaagug

SEQ ID NO: 19679 - RNA, 21 nt, Artificial Sequence
  RNA Oligomer
gaugcuuucaacuucuuuccu

SEQ ID NO: 19680 - RNA, 21 nt, Artificial Sequence
  RNA Oligomer
ucaacuucuuuccuucuuuca

SEQ ID NO: 19681 - RNA, 21 nt, Artificial Sequence
  RNA Oligomer
aagcaagaagaguuuagugua

SEQ ID NO: 19682 - RNA, 21 nt, Artificial Sequence
  RNA Oligomer
uacuccguccagacucaugcu

SEQ ID NO: 19683 - RNA, 21 nt, Artificial Sequence
  RNA Oligomer
ucugacaugcuuauugauccc

SEQ ID NO: 19684 - RNA, 21 nt, Artificial Sequence
  RNA Oligomer
uacuaaauuaggaacgcagca

SEQ ID NO: 19685 - RNA, 21 nt, Artificial Sequence
  RNA Oligomer
guuuuucuucaagaugcuuuc

SEQ ID NO: 19686 - RNA, 21 nt, Artificial Sequence
  RNA Oligomer
uccacuaacgaaccaagucag

SEQ ID NO: 19687 - RNA, 21 nt, Artificial Sequence
  RNA Oligomer
uucggguguuuaaagaggaac

SEQ ID NO: 19688 - RNA, 21 nt, Artificial Sequence
  RNA Oligomer
aagaugcuuucaacuucuuuc

SEQ ID NO: 19689 - RNA, 21 nt, Artificial Sequence
  RNA Oligomer
ugcuuucaacuucuuuccuuc

SEQ ID NO: 19690 - RNA, 21 nt, Artificial Sequence
  RNA Oligomer
ucuuucaauaucaucuuccuc

SEQ ID NO: 19691 - RNA, 21 nt, Artificial Sequence
  RNA Oligomer
agagugauaaagaggaaaaga

SEQ ID NO: 19692 - RNA, 21 nt, Artificial Sequence
  RNA Oligomer
agcaagaagaguuuaguguac

SEQ ID NO: 19693 - RNA, 21 nt, Artificial Sequence
  RNA Oligomer
uuuaguagacaaccugcaucc

SEQ ID NO: 19694 - RNA, 21 nt, Artificial Sequence
  RNA Oligomer
aauacaacacacaucaugacu

SEQ ID NO: 19695 - RNA, 21 nt, Artificial Sequence
  RNA Oligomer
caaugcagagugauaaagagg

SEQ ID NO: 19696 - RNA, 21 nt, Artificial Sequence
  RNA Oligomer
aaauacaacacacaucaugac

SEQ ID NO: 19697 - RNA, 21 nt, Artificial Sequence
  RNA Oligomer
uuaaucagucugacaugcuua

SEQ ID NO: 19698 - RNA, 21 nt, Artificial Sequence
  RNA Oligomer
gaaauucugcagagaauaugc

SEQ ID NO: 19699 - RNA, 21 nt, Artificial Sequence
  RNA Oligomer
cugugagcuguuuuucucucc

SEQ ID NO: 19700 - RNA, 21 nt, Artificial Sequence
  RNA Oligomer
gugauaaagaggaaaagauac

SEQ ID NO: 19701 - RNA, 21 nt, Artificial Sequence
  RNA Oligomer
uuucuuuaguagacaaccugc

SEQ ID NO: 19702 - RNA, 21 nt, Artificial Sequence
  RNA Oligomer
aacacacaucaugacuaguau

SEQ ID NO: 19703 - RNA, 21 nt, Artificial Sequence
  RNA Oligomer
acauuaaucagucugacaugc

SEQ ID NO: 19704 - RNA, 21 nt, Artificial Sequence
  RNA Oligomer
cauuaaucagucugacaugcu

SEQ ID NO: 19705 - RNA, 21 nt, Artificial Sequence
  RNA Oligomer
acaugcuuauugaucccauag

SEQ ID NO: 19706 - RNA, 21 nt, Artificial Sequence
  RNA Oligomer
aaauucugcagagaauaugcc

SEQ ID NO: 19707 - RNA, 21 nt, Artificial Sequence
  RNA Oligomer
ccuucuuucaauaucaucuuc

SEQ ID NO: 19708 - RNA, 21 nt, Artificial Sequence
  RNA Oligomer
aucagucugacaugcuuauug

SEQ ID NO: 19709 - RNA, 21 nt, Artificial Sequence
  RNA Oligomer
cugacaugcuuauugauccca

SEQ ID NO: 19710 - RNA, 21 nt, Artificial Sequence
  RNA Oligomer
cuccauuauaaauagaaaccg

SEQ ID NO: 19711 - RNA, 21 nt, Artificial Sequence
  RNA Oligomer
gauggccagcaaaugagagag

SEQ ID NO: 19712 - RNA, 21 nt, Artificial Sequence
  RNA Oligomer
aagcugauuuuaaaagcacac

SEQ ID NO: 19713 - RNA, 21 nt, Artificial Sequence
  RNA Oligomer
aaugcagagugauaaagagga

SEQ ID NO: 19714 - RNA, 21 nt, Artificial Sequence
  RNA Oligomer
augcagagugauaaagaggaa

SEQ ID NO: 19715 - RNA, 21 nt, Artificial Sequence
  RNA Oligomer
uuaguagacaaccugcaucca

SEQ ID NO: 19716 - RNA, 21 nt, Artificial Sequence
  RNA Oligomer
gucugacaugcuuauugaucc

SEQ ID NO: 19717 - RNA, 21 nt, Artificial Sequence
  RNA Oligomer
aaacuuucagaaauucugcag

SEQ ID NO: 19718 - RNA, 21 nt, Artificial Sequence
  RNA Oligomer
aauucugcagagaauaugccc

SEQ ID NO: 19719 - RNA, 21 nt, Artificial Sequence
  RNA Oligomer
agcuguuuuucucuccaaugc

SEQ ID NO: 19720 - RNA, 21 nt, Artificial Sequence
  RNA Oligomer
auaaugcaaaagcaagaagag

SEQ ID NO: 19721 - RNA, 21 nt, Artificial Sequence
  RNA Oligomer
aauaaacacaagugacguggc

SEQ ID NO: 19722 - RNA, 21 nt, Artificial Sequence
  RNA Oligomer
cauuauaaauagaaaccgagg

SEQ ID NO: 19723 - RNA, 21 nt, Artificial Sequence
  RNA Oligomer
auaaucggagacuuaauuccu

SEQ ID NO: 19724 - RNA, 21 nt, Artificial Sequence
  RNA Oligomer
aaucggagacuuaauuccuua

SEQ ID NO: 19725 - RNA, 21 nt, Artificial Sequence
  RNA Oligomer
gaaaacuuucagaaauucugc

SEQ ID NO: 19726 - RNA, 21 nt, Artificial Sequence
  RNA Oligomer
ucagacugugagcuguuuuuc

SEQ ID NO: 19727 - RNA, 21 nt, Artificial Sequence
  RNA Oligomer
uuauugcugaagugcaguucu

SEQ ID NO: 19728 - RNA, 21 nt, Artificial Sequence
  RNA Oligomer
aucggagacuuaauuccuuau

SEQ ID NO: 19729 - RNA, 21 nt, Artificial Sequence
  RNA Oligomer
uuaguguacgaacuguacagc

SEQ ID NO: 19730 - RNA, 21 nt, Artificial Sequence
  RNA Oligomer
uuuaaagaggaacuccuuggg

SEQ ID NO: 19731 - RNA, 21 nt, Artificial Sequence
  RNA Oligomer
gacugugagcuguuuuucucu

SEQ ID NO: 19732 - RNA, 21 nt, Artificial Sequence
  RNA Oligomer
ugugagcuguuuuucucucca

SEQ ID NO: 19733 - RNA, 21 nt, Artificial Sequence
  RNA Oligomer
auuauugcugaagugcaguuc

SEQ ID NO: 19734 - RNA, 21 nt, Artificial Sequence
  RNA Oligomer
aaauucaccaaugcagaguga

SEQ ID NO: 19735 - RNA, 21 nt, Artificial Sequence
  RNA Oligomer
aaaagcaagaagaguuuagug

SEQ ID NO: 19736 - RNA, 21 nt, Artificial Sequence
  RNA Oligomer
ugcguccagcaguauuuuuuc

SEQ ID NO: 19737 - RNA, 21 nt, Artificial Sequence
  RNA Oligomer
aaauaaacacaagugacgugg

SEQ ID NO: 19738 - RNA, 21 nt, Artificial Sequence
  RNA Oligomer
cuguuucagaagcccuguugg

SEQ ID NO: 19739 - RNA, 21 nt, Artificial Sequence
  RNA Oligomer
gauuugcuuagaauaaagcug

SEQ ID NO: 19740 - RNA, 21 nt, Artificial Sequence
  RNA Oligomer
aaggagaggauuaaauucacc

SEQ ID NO: 19741 - RNA, 21 nt, Artificial Sequence
  RNA Oligomer
gaggauuaaauucaccaaugc

SEQ ID NO: 19742 - RNA, 21 nt, Artificial Sequence
  RNA Oligomer
uaaucggagacuuaauuccuu

SEQ ID NO: 19743 - RNA, 21 nt, Artificial Sequence
  RNA Oligomer
uaguguacgaacuguacagcu

SEQ ID NO: 19744 - RNA, 21 nt, Artificial Sequence
  RNA Oligomer
uuuucucuccaaugcuauggg

SEQ ID NO: 19745 - RNA, 21 nt, Artificial Sequence
  RNA Oligomer
uauggguaucuguuucagaag

SEQ ID NO: 19746 - RNA, 21 nt, Artificial Sequence
  RNA Oligomer
gugaucaccuaauaaucggag

SEQ ID NO: 19747 - RNA, 21 nt, Artificial Sequence
  RNA Oligomer
uucagcugaauuaagguugca

SEQ ID NO: 19748 - RNA, 21 nt, Artificial Sequence
  RNA Oligomer
auaaacacaagugacguggcc

SEQ ID NO: 19749 - RNA, 21 nt, Artificial Sequence
  RNA Oligomer
cucuucagugagcuauguugc

SEQ ID NO: 19750 - RNA, 21 nt, Artificial Sequence
  RNA Oligomer
agagcagcagagauggaagga

SEQ ID NO: 19751 - RNA, 21 nt, Artificial Sequence
  RNA Oligomer
auaaauagaaaccgaggcugg

SEQ ID NO: 19752 - RNA, 21 nt, Artificial Sequence
  RNA Oligomer
uuuuucucuccaaugcuaugg

SEQ ID NO: 19753 - RNA, 21 nt, Artificial Sequence
  RNA Oligomer
cagaaaacugaucauccaggg

SEQ ID NO: 19754 - RNA, 21 nt, Artificial Sequence
  RNA Oligomer
aaaacugaucauccaggguga

SEQ ID NO: 19755 - RNA, 21 nt, Artificial Sequence
  RNA Oligomer
gcguccagcaguauuuuuucc

SEQ ID NO: 19756 - RNA, 21 nt, Artificial Sequence
  RNA Oligomer
uucagugagcuauguugcaag

SEQ ID NO: 19757 - RNA, 21 nt, Artificial Sequence
  RNA Oligomer
ucagugagcuauguugcaagc

SEQ ID NO: 19758 - RNA, 21 nt, Artificial Sequence
  RNA Oligomer
gauggaaggaaaacuuucaga

SEQ ID NO: 19759 - RNA, 21 nt, Artificial Sequence
  RNA Oligomer
uucaugacgcucguguuccuc

SEQ ID NO: 19760 - RNA, 21 nt, Artificial Sequence
  RNA Oligomer
uuucucuccaaugcuaugggu

SEQ ID NO: 19761 - RNA, 21 nt, Artificial Sequence
  RNA Oligomer
aaguagacacagauuugcuua

SEQ ID NO: 19762 - RNA, 21 nt, Artificial Sequence
  RNA Oligomer
cagauuugcuuagaauaaagc

SEQ ID NO: 19763 - RNA, 21 nt, Artificial Sequence
  RNA Oligomer
uugguaucuuguggugucugc

SEQ ID NO: 19764 - RNA, 21 nt, Artificial Sequence
  RNA Oligomer
uaaugcaaaagcaagaagagu

SEQ ID NO: 19765 - RNA, 21 nt, Artificial Sequence
  RNA Oligomer
augcuauggguaucuguuuca

SEQ ID NO: 19766 - RNA, 21 nt, Artificial Sequence
  RNA Oligomer
agcagaaaacugaucauccag

SEQ ID NO: 19767 - RNA, 21 nt, Artificial Sequence
  RNA Oligomer
aagaguuuaguguacgaacug

SEQ ID NO: 19768 - RNA, 21 nt, Artificial Sequence
  RNA Oligomer
aguuuaguguacgaacuguac

SEQ ID NO: 19769 - RNA, 21 nt, Artificial Sequence
  RNA Oligomer
acuguacagcugaguuuguag

SEQ ID NO: 19770 - RNA, 21 nt, Artificial Sequence
  RNA Oligomer
uguacagcugaguuuguagcu

SEQ ID NO: 19771 - RNA, 21 nt, Artificial Sequence
  RNA Oligomer
uucuuuaguagacaaccugca

SEQ ID NO: 19772 - RNA, 21 nt, Artificial Sequence
  RNA Oligomer
cuucagcugaauuaagguugc

SEQ ID NO: 19773 - RNA, 21 nt, Artificial Sequence
  RNA Oligomer
aucuaacagcucuucagugag

SEQ ID NO: 19774 - RNA, 21 nt, Artificial Sequence
  RNA Oligomer
uucaucaaaaggugcuggugg

SEQ ID NO: 19775 - RNA, 21 nt, Artificial Sequence
  RNA Oligomer
aacuuucagaaauucugcaga

SEQ ID NO: 19776 - RNA, 21 nt, Artificial Sequence
  RNA Oligomer
acuuucagaaauucugcagag

SEQ ID NO: 19777 - RNA, 21 nt, Artificial Sequence
  RNA Oligomer
uucuucaugacgcucguguuc

SEQ ID NO: 19778 - RNA, 21 nt, Artificial Sequence
  RNA Oligomer
uucucuccaaugcuaugggua

SEQ ID NO: 19779 - RNA, 21 nt, Artificial Sequence
  RNA Oligomer
ucagcagaaaacugaucaucc

SEQ ID NO: 19780 - RNA, 21 nt, Artificial Sequence
  RNA Oligomer
uaaacacaagugacguggcca

SEQ ID NO: 19781 - RNA, 21 nt, Artificial Sequence
  RNA Oligomer
agauggaaggaaaacuuucag

SEQ ID NO: 19782 - RNA, 21 nt, Artificial Sequence
  RNA Oligomer
auggaaggaaaacuuucagaa

SEQ ID NO: 19783 - RNA, 21 nt, Artificial Sequence
  RNA Oligomer
auagaaaccgaggcuggaacg

SEQ ID NO: 19784 - RNA, 21 nt, Artificial Sequence
  RNA Oligomer
aagcccuguugguaucuugug

SEQ ID NO: 19785 - RNA, 21 nt, Artificial Sequence
  RNA Oligomer
auugcugaagugcaguucuac

SEQ ID NO: 19786 - RNA, 21 nt, Artificial Sequence
  RNA Oligomer
agaaaacugaucauccagggu

SEQ ID NO: 19787 - RNA, 21 nt, Artificial Sequence
  RNA Oligomer
agggugaucaccuaauaaucg

SEQ ID NO: 19788 - RNA, 21 nt, Artificial Sequence
  RNA Oligomer
aucaccuaauaaucggagacu

SEQ ID NO: 19789 - RNA, 21 nt, Artificial Sequence
  RNA Oligomer
augcaaaagcaagaagaguuu

SEQ ID NO: 19790 - RNA, 21 nt, Artificial Sequence
  RNA Oligomer
gaucaacaugauuuuaguguc

SEQ ID NO: 19791 - RNA, 21 nt, Artificial Sequence
  RNA Oligomer
uuucagaaauucugcagagaa

SEQ ID NO: 19792 - RNA, 21 nt, Artificial Sequence
  RNA Oligomer
ucuucaugacgcucguguucc

SEQ ID NO: 19793 - RNA, 21 nt, Artificial Sequence
  RNA Oligomer
ucuccaaugcuauggguaucu

SEQ ID NO: 19794 - RNA, 21 nt, Artificial Sequence
  RNA Oligomer
aaugcuauggguaucuguuuc

SEQ ID NO: 19795 - RNA, 21 nt, Artificial Sequence
  RNA Oligomer
aggagaggauuaaauucacca

SEQ ID NO: 19796 - RNA, 21 nt, Artificial Sequence
  RNA Oligomer
aauucaccaaugcagagugau

SEQ ID NO: 19797 - RNA, 21 nt, Artificial Sequence
  RNA Oligomer
gaucaccuaauaaucggagac

SEQ ID NO: 19798 - RNA, 21 nt, Artificial Sequence
  RNA Oligomer
augcugugcguccagcaguau

SEQ ID NO: 19799 - RNA, 21 nt, Artificial Sequence
  RNA Oligomer
acuucagcugaauuaagguug

SEQ ID NO: 19800 - RNA, 21 nt, Artificial Sequence
  RNA Oligomer
aucaaaaggugcugguggagg

SEQ ID NO: 19801 - RNA, 21 nt, Artificial Sequence
  RNA Oligomer
guuuaaagaggaacuccuugg

SEQ ID NO: 19802 - RNA, 21 nt, Artificial Sequence
  RNA Oligomer
uccaaugcuauggguaucugu

SEQ ID NO: 19803 - RNA, 21 nt, Artificial Sequence
  RNA Oligomer
ugcuauggguaucuguuucag

SEQ ID NO: 19804 - RNA, 21 nt, Artificial Sequence
  RNA Oligomer
ucagaagcccuguugguaucu

SEQ ID NO: 19805 - RNA, 21 nt, Artificial Sequence
  RNA Oligomer
gauacugaguaggugccuuca

SEQ ID NO: 19806 - RNA, 21 nt, Artificial Sequence
  RNA Oligomer
uuuaguguacgaacuguacag

SEQ ID NO: 19807 - RNA, 21 nt, Artificial Sequence
  RNA Oligomer
guguacgaacuguacagcuga

SEQ ID NO: 19808 - RNA, 21 nt, Artificial Sequence
  RNA Oligomer
acuaccaaauuuucacaguag

SEQ ID NO: 19809 - RNA, 21 nt, Artificial Sequence
  RNA Oligomer
uaucuguuucagaagcccugu

SEQ ID NO: 19810 - RNA, 21 nt, Artificial Sequence
  RNA Oligomer
ugguaucuuguggugucugcg

SEQ ID NO: 19811 - RNA, 21 nt, Artificial Sequence
  RNA Oligomer
aaagauacugaguaggugccu

SEQ ID NO: 19812 - RNA, 21 nt, Artificial Sequence
  RNA Oligomer
uaucuuguggugucugcgagc

SEQ ID NO: 19813 - RNA, 21 nt, Artificial Sequence
  RNA Oligomer
cugaucauccagggugaucac

SEQ ID NO: 19814 - RNA, 21 nt, Artificial Sequence
  RNA Oligomer
ugcaaaagcaagaagaguuua

SEQ ID NO: 19815 - RNA, 21 nt, Artificial Sequence
  RNA Oligomer
aaagcaagaagaguuuagugu

SEQ ID NO: 19816 - RNA, 21 nt, Artificial Sequence
  RNA Oligomer
aaguacuucagcugaauuaag

SEQ ID NO: 19817 - RNA, 21 nt, Artificial Sequence
  RNA Oligomer
acaguagacauuaaucagucu

SEQ ID NO: 19818 - RNA, 21 nt, Artificial Sequence
  RNA Oligomer
augcuuauugaucccauaggu

SEQ ID NO: 19819 - RNA, 21 nt, Artificial Sequence
  RNA Oligomer
cagugagcuauguugcaagcu

SEQ ID NO: 19820 - RNA, 21 nt, Artificial Sequence
  RNA Oligomer
caucaaaaggugcugguggag

SEQ ID NO: 19821 - RNA, 21 nt, Artificial Sequence
  RNA Oligomer
cagagauggaaggaaaacuuu

SEQ ID NO: 19822 - RNA, 21 nt, Artificial Sequence
  RNA Oligomer
agagauggaaggaaaacuuuc

SEQ ID NO: 19823 - RNA, 21 nt, Artificial Sequence
  RNA Oligomer
augacgcucguguuccucaug

SEQ ID NO: 19824 - RNA, 21 nt, Artificial Sequence
  RNA Oligomer
ggguguuuaaagaggaacucc

SEQ ID NO: 19825 - RNA, 21 nt, Artificial Sequence
  RNA Oligomer
agaagcccuguugguaucuug

SEQ ID NO: 19826 - RNA, 21 nt, Artificial Sequence
  RNA Oligomer
agcccuguugguaucuugugg

SEQ ID NO: 19827 - RNA, 21 nt, Artificial Sequence
  RNA Oligomer
uucagcagaaaacugaucauc

SEQ ID NO: 19828 - RNA, 21 nt, Artificial Sequence
  RNA Oligomer
uugcugaagugcaguucuacc

SEQ ID NO: 19829 - RNA, 21 nt, Artificial Sequence
  RNA Oligomer
ugcuuauugaucccauaggug

SEQ ID NO: 19830 - RNA, 21 nt, Artificial Sequence
  RNA Oligomer
cuucaucaaaaggugcuggug

SEQ ID NO: 19831 - RNA, 21 nt, Artificial Sequence
  RNA Oligomer
gaagcccuguugguaucuugu

SEQ ID NO: 19832 - RNA, 21 nt, Artificial Sequence
  RNA Oligomer
acugaguaggugccuucagca

SEQ ID NO: 19833 - RNA, 21 nt, Artificial Sequence
  RNA Oligomer
aaacugaucauccagggugau

SEQ ID NO: 19834 - RNA, 21 nt, Artificial Sequence
  RNA Oligomer
ugcugaagugcaguucuaccc

SEQ ID NO: 19835 - RNA, 21 nt, Artificial Sequence
  RNA Oligomer
ucagcugaauuaagguugcag

SEQ ID NO: 19836 - RNA, 21 nt, Artificial Sequence
  RNA Oligomer
cacaguagacauuaaucaguc

SEQ ID NO: 19837 - RNA, 21 nt, Artificial Sequence
  RNA Oligomer
aguagacauuaaucagucuga

SEQ ID NO: 19838 - RNA, 21 nt, Artificial Sequence
  RNA Oligomer
cuccaaugcuauggguaucug

SEQ ID NO: 19839 - RNA, 21 nt, Artificial Sequence
  RNA Oligomer
uguugguaucuuguggugucu

SEQ ID NO: 19840 - RNA, 21 nt, Artificial Sequence
  RNA Oligomer
auacugaguaggugccuucag

SEQ ID NO: 19841 - RNA, 21 nt, Artificial Sequence
  RNA Oligomer
uacugaguaggugccuucagc

SEQ ID NO: 19842 - RNA, 21 nt, Artificial Sequence
  RNA Oligomer
caguagacauuaaucagucug

SEQ ID NO: 19843 - RNA, 21 nt, Artificial Sequence
  RNA Oligomer
guagacauuaaucagucugac

SEQ ID NO: 19844 - RNA, 21 nt, Artificial Sequence
  RNA Oligomer
gugagcuauguugcaagcuca

SEQ ID NO: 19845 - RNA, 21 nt, Artificial Sequence
  RNA Oligomer
uaaauagaaaccgaggcugga

SEQ ID NO: 19846 - RNA, 21 nt, Artificial Sequence
  RNA Oligomer
cugaguuuuucuucaagaugc

SEQ ID NO: 19847 - RNA, 21 nt, Artificial Sequence
  RNA Oligomer
aggccacaauauuuauuuugg

SEQ ID NO: 19848 - RNA, 21 nt, Artificial Sequence
  RNA Oligomer
uagacauuaaucagucugaca

SEQ ID NO: 19849 - RNA, 21 nt, Artificial Sequence
  RNA Oligomer
ucagucugacaugcuuauuga

SEQ ID NO: 19850 - RNA, 21 nt, Artificial Sequence
  RNA Oligomer
ugaguuuuucuucaagaugcu

SEQ ID NO: 19851 - RNA, 21 nt, Artificial Sequence
  RNA Oligomer
agauacugaguaggugccuuc

SEQ ID NO: 19852 - RNA, 21 nt, Artificial Sequence
  RNA Oligomer
uguuuaaagaggaacuccuug

SEQ ID NO: 19853 - RNA, 21 nt, Artificial Sequence
  RNA Oligomer
uggccagcaaaugagagagca

SEQ ID NO: 19854 - RNA, 21 nt, Artificial Sequence
  RNA Oligomer
uggguaucuguuucagaagcc

SEQ ID NO: 19855 - RNA, 21 nt, Artificial Sequence
  RNA Oligomer
ucacagugagagcucuuggag

SEQ ID NO: 19856 - RNA, 21 nt, Artificial Sequence
  RNA Oligomer
auggguaucuguuucagaagc

SEQ ID NO: 19857 - RNA, 21 nt, Artificial Sequence
  RNA Oligomer
cuaacagcucuucagugagcu

SEQ ID NO: 19858 - RNA, 21 nt, Artificial Sequence
  RNA Oligomer
ucuguuucagaagcccuguug

SEQ ID NO: 19859 - RNA, 21 nt, Artificial Sequence
  RNA Oligomer
uaacagcucuucagugagcua

SEQ ID NO: 19860 - RNA, 21 nt, Artificial Sequence
  RNA Oligomer
ggguaucuguuucagaagccc

SEQ ID NO: 19861 - RNA, 21 nt, Artificial Sequence
  RNA Oligomer
ggaauuauucaucgggacuua

SEQ ID NO: 19862 - RNA, 21 nt, Artificial Sequence
  RNA Oligomer
cucagaacacaacaaacuuaa

SEQ ID NO: 19863 - RNA, 21 nt, Artificial Sequence
  RNA Oligomer
gacucagaacacaacaaacuu

SEQ ID NO: 19864 - RNA, 21 nt, Artificial Sequence
  RNA Oligomer
gaauuauucaucgggacuuaa

SEQ ID NO: 19865 - RNA, 21 nt, Artificial Sequence
  RNA Oligomer
gcaaucaagaagcuaagccga

SEQ ID NO: 19866 - RNA, 21 nt, Artificial Sequence
  RNA Oligomer
ucaagaagcuaagccgaccau

SEQ ID NO: 19867 - RNA, 21 nt, Artificial Sequence
  RNA Oligomer
gcaucuaaaaggaucucugua

SEQ ID NO: 19868 - RNA, 21 nt, Artificial Sequence
  RNA Oligomer
gaccuaaauaugcuggauaua

SEQ ID NO: 19869 - RNA, 21 nt, Artificial Sequence
  RNA Oligomer
agaccuaaauaugcuggauau

SEQ ID NO: 19870 - RNA, 21 nt, Artificial Sequence
  RNA Oligomer
cguugaaaacagaccuaaaua

SEQ ID NO: 19871 - RNA, 21 nt, Artificial Sequence
  RNA Oligomer
gcccaguaauauaguaguaaa

SEQ ID NO: 19872 - RNA, 21 nt, Artificial Sequence
  RNA Oligomer
gcaccuucauucugcuggaau

SEQ ID NO: 19873 - RNA, 21 nt, Artificial Sequence
  RNA Oligomer
ccauuucagaaucagacucau

SEQ ID NO: 19874 - RNA, 21 nt, Artificial Sequence
  RNA Oligomer
caagaagcuaagccgaccauu

SEQ ID NO: 19875 - RNA, 21 nt, Artificial Sequence
  RNA Oligomer
ggagucgguuagucauugaua

SEQ ID NO: 19876 - RNA, 21 nt, Artificial Sequence
  RNA Oligomer
cugucaaugaugugucuucaa

SEQ ID NO: 19877 - RNA, 21 nt, Artificial Sequence
  RNA Oligomer
ucaggagcucaaggaauagua

SEQ ID NO: 19878 - RNA, 21 nt, Artificial Sequence
  RNA Oligomer
ucaugaagaaacugcaaccaa

SEQ ID NO: 19879 - RNA, 21 nt, Artificial Sequence
  RNA Oligomer
gaguuuuaugaugacgccuua

SEQ ID NO: 19880 - RNA, 21 nt, Artificial Sequence
  RNA Oligomer
agagagcuaguucuuaugaaa

SEQ ID NO: 19881 - RNA, 21 nt, Artificial Sequence
  RNA Oligomer
ggucuuauuuuugggugauuu

SEQ ID NO: 19882 - RNA, 21 nt, Artificial Sequence
  RNA Oligomer
ggaauaguaugcgcagcuuau

SEQ ID NO: 19883 - RNA, 21 nt, Artificial Sequence
  RNA Oligomer
caggagcucaaggaauaguau

SEQ ID NO: 19884 - RNA, 21 nt, Artificial Sequence
  RNA Oligomer
acaauagaagaguggaaagaa

SEQ ID NO: 19885 - RNA, 21 nt, Artificial Sequence
  RNA Oligomer
agauucuacauucacaguccu

SEQ ID NO: 19886 - RNA, 21 nt, Artificial Sequence
  RNA Oligomer
ggagauucuacauucacaguc

SEQ ID NO: 19887 - RNA, 21 nt, Artificial Sequence
  RNA Oligomer
agauuggagauucuacauuca

SEQ ID NO: 19888 - RNA, 21 nt, Artificial Sequence
  RNA Oligomer
guaaaaucugauugcacuuug

SEQ ID NO: 19889 - RNA, 21 nt, Artificial Sequence
  RNA Oligomer
ggagcuagaucaugaaagaau

SEQ ID NO: 19890 - RNA, 21 nt, Artificial Sequence
  RNA Oligomer
gaaagaaauguugcaaucaag

SEQ ID NO: 19891 - RNA, 21 nt, Artificial Sequence
  RNA Oligomer
gggagucgguuagucauugau

SEQ ID NO: 19892 - RNA, 21 nt, Artificial Sequence
  RNA Oligomer
aggaauaguaugcgcagcuua

SEQ ID NO: 19893 - RNA, 21 nt, Artificial Sequence
  RNA Oligomer
cgucugucaaugaugugucuu

SEQ ID NO: 19894 - RNA, 21 nt, Artificial Sequence
  RNA Oligomer
gaagaguggaaagaauugaua

SEQ ID NO: 19895 - RNA, 21 nt, Artificial Sequence
  RNA Oligomer
agaagaguggaaagaauugau

SEQ ID NO: 19896 - RNA, 21 nt, Artificial Sequence
  RNA Oligomer
ccagucaggcaagggauuugu

SEQ ID NO: 19897 - RNA, 21 nt, Artificial Sequence
  RNA Oligomer
cagaccuaaauaugcuggaua

SEQ ID NO: 19898 - RNA, 21 nt, Artificial Sequence
  RNA Oligomer
uggagauucuacauucacagu

SEQ ID NO: 19899 - RNA, 21 nt, Artificial Sequence
  RNA Oligomer
cgaguuuuaugaugacgccuu

SEQ ID NO: 19900 - RNA, 21 nt, Artificial Sequence
  RNA Oligomer
guguagagauuggagauucua

SEQ ID NO: 19901 - RNA, 21 nt, Artificial Sequence
  RNA Oligomer
gaagcaagcgugacaacaauu

SEQ ID NO: 19902 - RNA, 21 nt, Artificial Sequence
  RNA Oligomer
uggucuuauuuuugggugauu

SEQ ID NO: 19903 - RNA, 21 nt, Artificial Sequence
  RNA Oligomer
guggucuuauuuuugggugau

SEQ ID NO: 19904 - RNA, 21 nt, Artificial Sequence
  RNA Oligomer
caaggaauaguaugcgcagcu

SEQ ID NO: 19905 - RNA, 21 nt, Artificial Sequence
  RNA Oligomer
ugcaucuaaaaggaucucugu

SEQ ID NO: 19906 - RNA, 21 nt, Artificial Sequence
  RNA Oligomer
cugacucagaacacaacaaac

SEQ ID NO: 19907 - RNA, 21 nt, Artificial Sequence
  RNA Oligomer
agcuagaucaugaaagaaugu

SEQ ID NO: 19908 - RNA, 21 nt, Artificial Sequence
  RNA Oligomer
uggagcuagaucaugaaagaa

SEQ ID NO: 19909 - RNA, 21 nt, Artificial Sequence
  RNA Oligomer
gagagcuaguucuuaugaaau

SEQ ID NO: 19910 - RNA, 21 nt, Artificial Sequence
  RNA Oligomer
gcagugaucaauggcucucag

SEQ ID NO: 19911 - RNA, 21 nt, Artificial Sequence
  RNA Oligomer
gggaacacacaauagaagagu

SEQ ID NO: 19912 - RNA, 21 nt, Artificial Sequence
  RNA Oligomer
gaaagggaacacacaauagaa

SEQ ID NO: 19913 - RNA, 21 nt, Artificial Sequence
  RNA Oligomer
cagucaggcaagggauuuguu

SEQ ID NO: 19914 - RNA, 21 nt, Artificial Sequence
  RNA Oligomer
aguuuuaugaugacgccuuau

SEQ ID NO: 19915 - RNA, 21 nt, Artificial Sequence
  RNA Oligomer
gagauuggagauucuacauuc

SEQ ID NO: 19916 - RNA, 21 nt, Artificial Sequence
  RNA Oligomer
agagauuggagauucuacauu

SEQ ID NO: 19917 - RNA, 21 nt, Artificial Sequence
  RNA Oligomer
cacuuugaagauucuugacuu

SEQ ID NO: 19918 - RNA, 21 nt, Artificial Sequence
  RNA Oligomer
cuggaauuauucaucgggacu

SEQ ID NO: 19919 - RNA, 21 nt, Artificial Sequence
  RNA Oligomer
gcgugacaacaauuuuuauag

SEQ ID NO: 19920 - RNA, 21 nt, Artificial Sequence
  RNA Oligomer
gagcuagaucaugaaagaaug

SEQ ID NO: 19921 - RNA, 21 nt, Artificial Sequence
  RNA Oligomer
agauggagcuagaucaugaaa

SEQ ID NO: 19922 - RNA, 21 nt, Artificial Sequence
  RNA Oligomer
cagauggagcuagaucaugaa

SEQ ID NO: 19923 - RNA, 21 nt, Artificial Sequence
  RNA Oligomer
ucgguuagucauugauagaac

SEQ ID NO: 19924 - RNA, 21 nt, Artificial Sequence
  RNA Oligomer
gagaaccaagaauggaguuau

SEQ ID NO: 19925 - RNA, 21 nt, Artificial Sequence
  RNA Oligomer
caauagaagaguggaaagaau

SEQ ID NO: 19926 - RNA, 21 nt, Artificial Sequence
  RNA Oligomer
gccuuauguagugacucgcua

SEQ ID NO: 19927 - RNA, 21 nt, Artificial Sequence
  RNA Oligomer
ugcaggaacgaguuuuaugau

SEQ ID NO: 19928 - RNA, 21 nt, Artificial Sequence
  RNA Oligomer
uagagauuggagauucuacau

SEQ ID NO: 19929 - RNA, 21 nt, Artificial Sequence
  RNA Oligomer
guaguaaaaucugauugcacu

SEQ ID NO: 19930 - RNA, 21 nt, Artificial Sequence
  RNA Oligomer
agcccaguaauauaguaguaa

SEQ ID NO: 19931 - RNA, 21 nt, Artificial Sequence
  RNA Oligomer
uggaauuauucaucgggacuu

SEQ ID NO: 19932 - RNA, 21 nt, Artificial Sequence
  RNA Oligomer
gcuggaauuauucaucgggac

SEQ ID NO: 19933 - RNA, 21 nt, Artificial Sequence
  RNA Oligomer
caagcgugacaacaauuuuua

SEQ ID NO: 19934 - RNA, 21 nt, Artificial Sequence
  RNA Oligomer
agcaagcgugacaacaauuuu

SEQ ID NO: 19935 - RNA, 21 nt, Artificial Sequence
  RNA Oligomer
agaagcaagcgugacaacaau

SEQ ID NO: 19936 - RNA, 21 nt, Artificial Sequence
  RNA Oligomer
gcuaguucuuaugaaaugugu

SEQ ID NO: 19937 - RNA, 21 nt, Artificial Sequence
  RNA Oligomer
gagcuaguucuuaugaaaugu

SEQ ID NO: 19938 - RNA, 21 nt, Artificial Sequence
  RNA Oligomer
aaggaauaguaugcgcagcuu

SEQ ID NO: 19939 - RNA, 21 nt, Artificial Sequence
  RNA Oligomer
augaugugucuucaaugucaa

SEQ ID NO: 19940 - RNA, 21 nt, Artificial Sequence
  RNA Oligomer
ugucaaugaugugucuucaau

SEQ ID NO: 19941 - RNA, 21 nt, Artificial Sequence
  RNA Oligomer
ucgucugucaaugaugugucu

SEQ ID NO: 19942 - RNA, 21 nt, Artificial Sequence
  RNA Oligomer
gcucucagcauccaucaucau

SEQ ID NO: 19943 - RNA, 21 nt, Artificial Sequence
  RNA Oligomer
cacaguccugaaacgauauca

SEQ ID NO: 19944 - RNA, 21 nt, Artificial Sequence
  RNA Oligomer
ugaugacgccuuauguaguga

SEQ ID NO: 19945 - RNA, 21 nt, Artificial Sequence
  RNA Oligomer
caggaacgaguuuuaugauga

SEQ ID NO: 19946 - RNA, 21 nt, Artificial Sequence
  RNA Oligomer
aguguagagauuggagauucu

SEQ ID NO: 19947 - RNA, 21 nt, Artificial Sequence
  RNA Oligomer
gcaagcgugacaacaauuuuu

SEQ ID NO: 19948 - RNA, 21 nt, Artificial Sequence
  RNA Oligomer
caagugauucagauggagcua

SEQ ID NO: 19949 - RNA, 21 nt, Artificial Sequence
  RNA Oligomer
cagaagcaagcgugacaacaa

SEQ ID NO: 19950 - RNA, 21 nt, Artificial Sequence
  RNA Oligomer
accauuucagaaucagacuca

SEQ ID NO: 19951 - RNA, 21 nt, Artificial Sequence
  RNA Oligomer
gaaaacaauucaguggucuua

SEQ ID NO: 19952 - RNA, 21 nt, Artificial Sequence
  RNA Oligomer
ugaugugucuucaaugucaac

SEQ ID NO: 19953 - RNA, 21 nt, Artificial Sequence
  RNA Oligomer
gucgucugucaaugauguguc

SEQ ID NO: 19954 - RNA, 21 nt, Artificial Sequence
  RNA Oligomer
gaugaaagggaacacacaaua

SEQ ID NO: 19955 - RNA, 21 nt, Artificial Sequence
  RNA Oligomer
agcucuccaacacccguacau

SEQ ID NO: 19956 - RNA, 21 nt, Artificial Sequence
  RNA Oligomer
gucaggcaagggauuuguuau

SEQ ID NO: 19957 - RNA, 21 nt, Artificial Sequence
  RNA Oligomer
gaauucaugaagaaacugcaa

SEQ ID NO: 19958 - RNA, 21 nt, Artificial Sequence
  RNA Oligomer
uccugaauucaugaagaaacu

SEQ ID NO: 19959 - RNA, 21 nt, Artificial Sequence
  RNA Oligomer
uggcaugggcuacaaggaaaa

SEQ ID NO: 19960 - RNA, 21 nt, Artificial Sequence
  RNA Oligomer
ggaacgaguuuuaugaugacg

SEQ ID NO: 19961 - RNA, 21 nt, Artificial Sequence
  RNA Oligomer
aggaacgaguuuuaugaugac

SEQ ID NO: 19962 - RNA, 21 nt, Artificial Sequence
  RNA Oligomer
gcaggaacgaguuuuaugaug

SEQ ID NO: 19963 - RNA, 21 nt, Artificial Sequence
  RNA Oligomer
ugauugcacuuugaagauucu

SEQ ID NO: 19964 - RNA, 21 nt, Artificial Sequence
  RNA Oligomer
cugauugcacuuugaagauuc

SEQ ID NO: 19965 - RNA, 21 nt, Artificial Sequence
  RNA Oligomer
aucugauugcacuuugaagau

SEQ ID NO: 19966 - RNA, 21 nt, Artificial Sequence
  RNA Oligomer
gugauucagauggagcuagau

SEQ ID NO: 19967 - RNA, 21 nt, Artificial Sequence
  RNA Oligomer
agcuaguucuuaugaaaugug

SEQ ID NO: 19968 - RNA, 21 nt, Artificial Sequence
  RNA Oligomer
ucaguggucuuauuuuugggu

SEQ ID NO: 19969 - RNA, 21 nt, Artificial Sequence
  RNA Oligomer
gucgguuagucauugauagaa

SEQ ID NO: 19970 - RNA, 21 nt, Artificial Sequence
  RNA Oligomer
agucgguuagucauugauaga

SEQ ID NO: 19971 - RNA, 21 nt, Artificial Sequence
  RNA Oligomer
ucgucgucugucaaugaugug

SEQ ID NO: 19972 - RNA, 21 nt, Artificial Sequence
  RNA Oligomer
ucagcauccaucaucaucguc

SEQ ID NO: 19973 - RNA, 21 nt, Artificial Sequence
  RNA Oligomer
agaugaaagggaacacacaau

SEQ ID NO: 19974 - RNA, 21 nt, Artificial Sequence
  RNA Oligomer
gcacuuugaagauucuugacu

SEQ ID NO: 19975 - RNA, 21 nt, Artificial Sequence
  RNA Oligomer
cagagagcuaguucuuaugaa

SEQ ID NO: 19976 - RNA, 21 nt, Artificial Sequence
  RNA Oligomer
cucagcauccaucaucaucgu

SEQ ID NO: 19977 - RNA, 21 nt, Artificial Sequence
  RNA Oligomer
agagaaccaagaauggaguua

SEQ ID NO: 19978 - RNA, 21 nt, Artificial Sequence
  RNA Oligomer
ccugaauucaugaagaaacug

SEQ ID NO: 19979 - RNA, 21 nt, Artificial Sequence
  RNA Oligomer
aaguuauugaacagcuuggaa

SEQ ID NO: 19980 - RNA, 21 nt, Artificial Sequence
  RNA Oligomer
ggaauaaaguuauugaacagc

SEQ ID NO: 19981 - RNA, 21 nt, Artificial Sequence
  RNA Oligomer
ggcaugggcuacaaggaaaac

SEQ ID NO: 19982 - RNA, 21 nt, Artificial Sequence
  RNA Oligomer
acgaguuuuaugaugacgccu

SEQ ID NO: 19983 - RNA, 21 nt, Artificial Sequence
  RNA Oligomer
aagcccaguaauauaguagua

SEQ ID NO: 19984 - RNA, 21 nt, Artificial Sequence
  RNA Oligomer
ugcuggaauuauucaucggga

SEQ ID NO: 19985 - RNA, 21 nt, Artificial Sequence
  RNA Oligomer
acaccacagaaaucccuagaa

SEQ ID NO: 19986 - RNA, 21 nt, Artificial Sequence
  RNA Oligomer
agagcuaguucuuaugaaaug

SEQ ID NO: 19987 - RNA, 21 nt, Artificial Sequence
  RNA Oligomer
cuugaaagaaauguugcaauc

SEQ ID NO: 19988 - RNA, 21 nt, Artificial Sequence
  RNA Oligomer
gcaguuagaugaaagggaaca

SEQ ID NO: 19989 - RNA, 21 nt, Artificial Sequence
  RNA Oligomer
ugacaagcaguuagaugaaag

SEQ ID NO: 19990 - RNA, 21 nt, Artificial Sequence
  RNA Oligomer
gguaugauccuucugaagcag

SEQ ID NO: 19991 - RNA, 21 nt, Artificial Sequence
  RNA Oligomer
guaaggacuuacguugaaaac

SEQ ID NO: 19992 - RNA, 21 nt, Artificial Sequence
  RNA Oligomer
ugaauucaugaagaaacugca

SEQ ID NO: 19993 - RNA, 21 nt, Artificial Sequence
  RNA Oligomer
gauugcacuuugaagauucuu

SEQ ID NO: 19994 - RNA, 21 nt, Artificial Sequence
  RNA Oligomer
agcagugaucaauggcucuca

SEQ ID NO: 19995 - RNA, 21 nt, Artificial Sequence
  RNA Oligomer
agaaccaagaauggaguuaua

SEQ ID NO: 19996 - RNA, 21 nt, Artificial Sequence
  RNA Oligomer
ggaaguuauggacuuggagga

SEQ ID NO: 19997 - RNA, 21 nt, Artificial Sequence
  RNA Oligomer
caguuagaugaaagggaacac

SEQ ID NO: 19998 - RNA, 21 nt, Artificial Sequence
  RNA Oligomer
agcaguuagaugaaagggaac

SEQ ID NO: 19999 - RNA, 21 nt, Artificial Sequence
  RNA Oligomer
aagcaguuagaugaaagggaa

SEQ ID NO: 20000 - RNA, 21 nt, Artificial Sequence
  RNA Oligomer
cucuucccugauguccuuuuc

SEQ ID NO: 20001 - RNA, 21 nt, Artificial Sequence
  RNA Oligomer
ugcacuuugaagauucuugac

SEQ ID NO: 20002 - RNA, 21 nt, Artificial Sequence
  RNA Oligomer
gaaguuauggacuuggaggag

SEQ ID NO: 20003 - RNA, 21 nt, Artificial Sequence
  RNA Oligomer
ugauguccuuuucccagcuga

SEQ ID NO: 20004 - RNA, 21 nt, Artificial Sequence
  RNA Oligomer
agugauucagauggagcuaga

SEQ ID NO: 20005 - RNA, 21 nt, Artificial Sequence
  RNA Oligomer
caccacagaaaucccuagaag

SEQ ID NO: 20006 - RNA, 21 nt, Artificial Sequence
  RNA Oligomer
cugacaagcaguuagaugaaa

SEQ ID NO: 20007 - RNA, 21 nt, Artificial Sequence
  RNA Oligomer
cuauaggcucaggagcucaag

SEQ ID NO: 20008 - RNA, 21 nt, Artificial Sequence
  RNA Oligomer
uggaacaccauguccugaauu

SEQ ID NO: 20009 - RNA, 21 nt, Artificial Sequence
  RNA Oligomer
cgggacuuaaagcccaguaau

SEQ ID NO: 20010 - RNA, 21 nt, Artificial Sequence
  RNA Oligomer
gaaccaagaauggaguuauac

SEQ ID NO: 20011 - RNA, 21 nt, Artificial Sequence
  RNA Oligomer
cguacaucaaugucugguaug

SEQ ID NO: 20012 - RNA, 21 nt, Artificial Sequence
  RNA Oligomer
ggacugcaggaacgaguuuua

SEQ ID NO: 20013 - RNA, 21 nt, Artificial Sequence
  RNA Oligomer
ccacagaaaucccuagaagaa

SEQ ID NO: 20014 - RNA, 21 nt, Artificial Sequence
  RNA Oligomer
cugguaauagaugcaucuaaa

SEQ ID NO: 20015 - RNA, 21 nt, Artificial Sequence
  RNA Oligomer
acguugaaaacagaccuaaau

SEQ ID NO: 20016 - RNA, 21 nt, Artificial Sequence
  RNA Oligomer
uguccugaauucaugaagaaa

SEQ ID NO: 20017 - RNA, 21 nt, Artificial Sequence
  RNA Oligomer
gcaagggauuuguuauccaaa

SEQ ID NO: 20018 - RNA, 21 nt, Artificial Sequence
  RNA Oligomer
caacaaacuuaaagccaguca

SEQ ID NO: 20019 - RNA, 21 nt, Artificial Sequence
  RNA Oligomer
cacaacaaacuuaaagccagu

SEQ ID NO: 20020 - RNA, 21 nt, Artificial Sequence
  RNA Oligomer
ggacuuacguugaaaacagac

SEQ ID NO: 20021 - RNA, 21 nt, Artificial Sequence
  RNA Oligomer
auguccugaauucaugaagaa

SEQ ID NO: 20022 - RNA, 21 nt, Artificial Sequence
  RNA Oligomer
ggagagaaccaagaauggagu

SEQ ID NO: 20023 - RNA, 21 nt, Artificial Sequence
  RNA Oligomer
ggcaagggauuuguuauccaa

SEQ ID NO: 20024 - RNA, 21 nt, Artificial Sequence
  RNA Oligomer
ccugaaacgauaucagaauuu

SEQ ID NO: 20025 - RNA, 21 nt, Artificial Sequence
  RNA Oligomer
uacguugaaaacagaccuaaa

SEQ ID NO: 20026 - RNA, 21 nt, Artificial Sequence
  RNA Oligomer
agaaacugcaaccaacaguaa

SEQ ID NO: 20027 - RNA, 21 nt, Artificial Sequence
  RNA Oligomer
cuacauucacaguccugaaac

SEQ ID NO: 20028 - RNA, 21 nt, Artificial Sequence
  RNA Oligomer
uuggaacaccauguccugaau

SEQ ID NO: 20029 - RNA, 21 nt, Artificial Sequence
  RNA Oligomer
caugaaagaauguccuaccuu

SEQ ID NO: 20030 - RNA, 21 nt, Artificial Sequence
  RNA Oligomer
gagcucauggaugcaaaucuu

SEQ ID NO: 20031 - RNA, 21 nt, Artificial Sequence
  RNA Oligomer
cagaaaucccuagaagaauuu

SEQ ID NO: 20032 - RNA, 21 nt, Artificial Sequence
  RNA Oligomer
gaauguuuucacaccacagaa

SEQ ID NO: 20033 - RNA, 21 nt, Artificial Sequence
  RNA Oligomer
acagagagcuaguucuuauga

SEQ ID NO: 20034 - RNA, 21 nt, Artificial Sequence
  RNA Oligomer
gagagaaccaagaauggaguu

SEQ ID NO: 20035 - RNA, 21 nt, Artificial Sequence
  RNA Oligomer
guacaucaaugucugguauga

SEQ ID NO: 20036 - RNA, 21 nt, Artificial Sequence
  RNA Oligomer
acaacaaacuuaaagccaguc

SEQ ID NO: 20037 - RNA, 21 nt, Artificial Sequence
  RNA Oligomer
gcugacucagaacacaacaaa

SEQ ID NO: 20038 - RNA, 21 nt, Artificial Sequence
  RNA Oligomer
caguaaggacuuacguugaaa

SEQ ID NO: 20039 - RNA, 21 nt, Artificial Sequence
  RNA Oligomer
gcaaccaacaguaaggacuua

SEQ ID NO: 20040 - RNA, 21 nt, Artificial Sequence
  RNA Oligomer
accuucauucugcuggaauua

SEQ ID NO: 20041 - RNA, 21 nt, Artificial Sequence
  RNA Oligomer
accacagaaaucccuagaaga

SEQ ID NO: 20042 - RNA, 21 nt, Artificial Sequence
  RNA Oligomer
cuacagagagcuaguucuuau

SEQ ID NO: 20043 - RNA, 21 nt, Artificial Sequence
  RNA Oligomer
gcuuaugaugccauucuugaa

SEQ ID NO: 20044 - RNA, 21 nt, Artificial Sequence
  RNA Oligomer
ccguacaucaaugucugguau

SEQ ID NO: 20045 - RNA, 21 nt, Artificial Sequence
  RNA Oligomer
agggauuuguuauccaaaaug

SEQ ID NO: 20046 - RNA, 21 nt, Artificial Sequence
  RNA Oligomer
ggauauagcuuugagaaacuc

SEQ ID NO: 20047 - RNA, 21 nt, Artificial Sequence
  RNA Oligomer
cuuacguugaaaacagaccua

SEQ ID NO: 20048 - RNA, 21 nt, Artificial Sequence
  RNA Oligomer
ccauguccugaauucaugaag

SEQ ID NO: 20049 - RNA, 21 nt, Artificial Sequence
  RNA Oligomer
ggaugcaaaucuuugccaagu

SEQ ID NO: 20050 - RNA, 21 nt, Artificial Sequence
  RNA Oligomer
ggagcucauggaugcaaaucu

SEQ ID NO: 20051 - RNA, 21 nt, Artificial Sequence
  RNA Oligomer
acagaaaucccuagaagaauu

SEQ ID NO: 20052 - RNA, 21 nt, Artificial Sequence
  RNA Oligomer
cacaccacagaaaucccuaga

SEQ ID NO: 20053 - RNA, 21 nt, Artificial Sequence
  RNA Oligomer
auguuuucacaccacagaaau

SEQ ID NO: 20054 - RNA, 21 nt, Artificial Sequence
  RNA Oligomer
cccguacaucaaugucuggua

SEQ ID NO: 20055 - RNA, 21 nt, Artificial Sequence
  RNA Oligomer
ggaucucuguagaugaagcuc

SEQ ID NO: 20056 - RNA, 21 nt, Artificial Sequence
  RNA Oligomer
uccugaaacgauaucagaauu

SEQ ID NO: 20057 - RNA, 21 nt, Artificial Sequence
  RNA Oligomer
cccagcugacucagaacacaa

SEQ ID NO: 20058 - RNA, 21 nt, Artificial Sequence
  RNA Oligomer
aggacuuacguugaaaacaga

SEQ ID NO: 20059 - RNA, 21 nt, Artificial Sequence
  RNA Oligomer
gaacaccauguccugaauuca

SEQ ID NO: 20060 - RNA, 21 nt, Artificial Sequence
  RNA Oligomer
ggaacaccauguccugaauuc

SEQ ID NO: 20061 - RNA, 21 nt, Artificial Sequence
  RNA Oligomer
ggacuuaaagcccaguaauau

SEQ ID NO: 20062 - RNA, 21 nt, Artificial Sequence
  RNA Oligomer
ucaucgggacuuaaagcccag

SEQ ID NO: 20063 - RNA, 21 nt, Artificial Sequence
  RNA Oligomer
cucuaucagaugcugugugga

SEQ ID NO: 20064 - RNA, 21 nt, Artificial Sequence
  RNA Oligomer
uggaugcaaaucuuugccaag

SEQ ID NO: 20065 - RNA, 21 nt, Artificial Sequence
  RNA Oligomer
gagcagaagcaagcgugacaa

SEQ ID NO: 20066 - RNA, 21 nt, Artificial Sequence
  RNA Oligomer
ucagaaucagacucaugccaa

SEQ ID NO: 20067 - RNA, 21 nt, Artificial Sequence
  RNA Oligomer
gguuagucauugauagaacua

SEQ ID NO: 20068 - RNA, 21 nt, Artificial Sequence
  RNA Oligomer
ucaauggcucucagcauccau

SEQ ID NO: 20069 - RNA, 21 nt, Artificial Sequence
  RNA Oligomer
aggaucucuguagaugaagcu

SEQ ID NO: 20070 - RNA, 21 nt, Artificial Sequence
  RNA Oligomer
ggauuuguuauccaaaaugcu

SEQ ID NO: 20071 - RNA, 21 nt, Artificial Sequence
  RNA Oligomer
caagggauuuguuauccaaaa

SEQ ID NO: 20072 - RNA, 21 nt, Artificial Sequence
  RNA Oligomer
gggacuuaaagcccaguaaua

SEQ ID NO: 20073 - RNA, 21 nt, Artificial Sequence
  RNA Oligomer
ugaaagaauguccuaccuucu

SEQ ID NO: 20074 - RNA, 21 nt, Artificial Sequence
  RNA Oligomer
gaugcaaaucuuugccaagug

SEQ ID NO: 20075 - RNA, 21 nt, Artificial Sequence
  RNA Oligomer
cacagaaaucccuagaagaau

SEQ ID NO: 20076 - RNA, 21 nt, Artificial Sequence
  RNA Oligomer
ggccuuuugaauguuuucaca

SEQ ID NO: 20077 - RNA, 21 nt, Artificial Sequence
  RNA Oligomer
cuaagccgaccauuucagaau

SEQ ID NO: 20078 - RNA, 21 nt, Artificial Sequence
  RNA Oligomer
gcgcagcuuaugaugccauuc

SEQ ID NO: 20079 - RNA, 21 nt, Artificial Sequence
  RNA Oligomer
cgguuagucauugauagaacu

SEQ ID NO: 20080 - RNA, 21 nt, Artificial Sequence
  RNA Oligomer
ccgacuuuggccucugauaca

SEQ ID NO: 20081 - RNA, 21 nt, Artificial Sequence
  RNA Oligomer
caaugucaacagauccgacuu

SEQ ID NO: 20082 - RNA, 21 nt, Artificial Sequence
  RNA Oligomer
gcagcagugaucaauggcucu

SEQ ID NO: 20083 - RNA, 21 nt, Artificial Sequence
  RNA Oligomer
ggcucaggagcucaaggaaua

SEQ ID NO: 20084 - RNA, 21 nt, Artificial Sequence
  RNA Oligomer
accuauaggcucaggagcuca

SEQ ID NO: 20085 - RNA, 21 nt, Artificial Sequence
  RNA Oligomer
ccaacacccguacaucaaugu

SEQ ID NO: 20086 - RNA, 21 nt, Artificial Sequence
  RNA Oligomer
guuauccaaaaugcugguaau

SEQ ID NO: 20087 - RNA, 21 nt, Artificial Sequence
  RNA Oligomer
uggauauagcuuugagaaacu

SEQ ID NO: 20088 - RNA, 21 nt, Artificial Sequence
  RNA Oligomer
acagaccuaaauaugcuggau

SEQ ID NO: 20089 - RNA, 21 nt, Artificial Sequence
  RNA Oligomer
acaguaaggacuuacguugaa

SEQ ID NO: 20090 - RNA, 21 nt, Artificial Sequence
  RNA Oligomer
caccauguccugaauucauga

SEQ ID NO: 20091 - RNA, 21 nt, Artificial Sequence
  RNA Oligomer
agcuuggaacaccauguccug

SEQ ID NO: 20092 - RNA, 21 nt, Artificial Sequence
  RNA Oligomer
ucgggacuuaaagcccaguaa

SEQ ID NO: 20093 - RNA, 21 nt, Artificial Sequence
  RNA Oligomer
ucaugaaagaauguccuaccu

SEQ ID NO: 20094 - RNA, 21 nt, Artificial Sequence
  RNA Oligomer
ccuacagagagcuaguucuua

SEQ ID NO: 20095 - RNA, 21 nt, Artificial Sequence
  RNA Oligomer
cgaccauuucagaaucagacu

SEQ ID NO: 20096 - RNA, 21 nt, Artificial Sequence
  RNA Oligomer
gccgaccauuucagaaucaga

SEQ ID NO: 20097 - RNA, 21 nt, Artificial Sequence
  RNA Oligomer
ugcgcagcuuaugaugccauu

SEQ ID NO: 20098 - RNA, 21 nt, Artificial Sequence
  RNA Oligomer
ccuauaggcucaggagcucaa

SEQ ID NO: 20099 - RNA, 21 nt, Artificial Sequence
  RNA Oligomer
gucugguaugauccuucugaa

SEQ ID NO: 20100 - RNA, 21 nt, Artificial Sequence
  RNA Oligomer
uccaaaaugcugguaauagau

SEQ ID NO: 20101 - RNA, 21 nt, Artificial Sequence
  RNA Oligomer
acauucacaguccugaaacga

SEQ ID NO: 20102 - RNA, 21 nt, Artificial Sequence
  RNA Oligomer
uuauguagugacucgcuacua

SEQ ID NO: 20103 - RNA, 21 nt, Artificial Sequence
  RNA Oligomer
ccuucauucugcuggaauuau

SEQ ID NO: 20104 - RNA, 21 nt, Artificial Sequence
  RNA Oligomer
ggaaucaagcaccuucauucu

SEQ ID NO: 20105 - RNA, 21 nt, Artificial Sequence
  RNA Oligomer
guggaaucaagcaccuucauu

SEQ ID NO: 20106 - RNA, 21 nt, Artificial Sequence
  RNA Oligomer
cuaccuucucuaucagaugcu

SEQ ID NO: 20107 - RNA, 21 nt, Artificial Sequence
  RNA Oligomer
gcaaaucuuugccaagugauu

SEQ ID NO: 20108 - RNA, 21 nt, Artificial Sequence
  RNA Oligomer
ugcaaaucuuugccaagugau

SEQ ID NO: 20109 - RNA, 21 nt, Artificial Sequence
  RNA Oligomer
augcaaaucuuugccaaguga

SEQ ID NO: 20110 - RNA, 21 nt, Artificial Sequence
  RNA Oligomer
auggagcucauggaugcaaau

SEQ ID NO: 20111 - RNA, 21 nt, Artificial Sequence
  RNA Oligomer
ugaaaacaauucaguggucuu

SEQ ID NO: 20112 - RNA, 21 nt, Artificial Sequence
  RNA Oligomer
caaugaugugucuucaauguc

SEQ ID NO: 20113 - RNA, 21 nt, Artificial Sequence
  RNA Oligomer
gucaaugaugugucuucaaug

SEQ ID NO: 20114 - RNA, 21 nt, Artificial Sequence
  RNA Oligomer
ccaagaauggaguuauacggg

SEQ ID NO: 20115 - RNA, 21 nt, Artificial Sequence
  RNA Oligomer
cacacaauagaagaguggaaa

SEQ ID NO: 20116 - RNA, 21 nt, Artificial Sequence
  RNA Oligomer
ggaacacacaauagaagagug

SEQ ID NO: 20117 - RNA, 21 nt, Artificial Sequence
  RNA Oligomer
ucaaugucugguaugauccuu

SEQ ID NO: 20118 - RNA, 21 nt, Artificial Sequence
  RNA Oligomer
ucuguagaugaagcucuccaa

SEQ ID NO: 20119 - RNA, 21 nt, Artificial Sequence
  RNA Oligomer
ucuaaaaggaucucuguagau

SEQ ID NO: 20120 - RNA, 21 nt, Artificial Sequence
  RNA Oligomer
gguaauagaugcaucuaaaag

SEQ ID NO: 20121 - RNA, 21 nt, Artificial Sequence
  RNA Oligomer
ugcugguaauagaugcaucua

SEQ ID NO: 20122 - RNA, 21 nt, Artificial Sequence
  RNA Oligomer
uguuauccaaaaugcugguaa

SEQ ID NO: 20123 - RNA, 21 nt, Artificial Sequence
  RNA Oligomer
gggauuuguuauccaaaaugc

SEQ ID NO: 20124 - RNA, 21 nt, Artificial Sequence
  RNA Oligomer
gcuuugagaaacucuucccug

SEQ ID NO: 20125 - RNA, 21 nt, Artificial Sequence
  RNA Oligomer
accaacaguaaggacuuacgu

SEQ ID NO: 20126 - RNA, 21 nt, Artificial Sequence
  RNA Oligomer
ugcaaccaacaguaaggacuu

SEQ ID NO: 20127 - RNA, 21 nt, Artificial Sequence
  RNA Oligomer
accauguccugaauucaugaa

SEQ ID NO: 20128 - RNA, 21 nt, Artificial Sequence
  RNA Oligomer
uucuacauucacaguccugaa

SEQ ID NO: 20129 - RNA, 21 nt, Artificial Sequence
  RNA Oligomer
cuguguggaaucaagcaccuu

SEQ ID NO: 20130 - RNA, 21 nt, Artificial Sequence
  RNA Oligomer
auagucauggagcucauggau

SEQ ID NO: 20131 - RNA, 21 nt, Artificial Sequence
  RNA Oligomer
cccuagaagaauuucaagaug

SEQ ID NO: 20132 - RNA, 21 nt, Artificial Sequence
  RNA Oligomer
ucccuagaagaauuucaagau

SEQ ID NO: 20133 - RNA, 21 nt, Artificial Sequence
  RNA Oligomer
agaaaucccuagaagaauuuc

SEQ ID NO: 20134 - RNA, 21 nt, Artificial Sequence
  RNA Oligomer
gcagcuuaugaugccauucuu

SEQ ID NO: 20135 - RNA, 21 nt, Artificial Sequence
  RNA Oligomer
guagaugacuacuugggccau

SEQ ID NO: 20136 - RNA, 21 nt, Artificial Sequence
  RNA Oligomer
gugucuucaaugucaacagau

SEQ ID NO: 20137 - RNA, 21 nt, Artificial Sequence
  RNA Oligomer
uggaggagagaaccaagaaug

SEQ ID NO: 20138 - RNA, 21 nt, Artificial Sequence
  RNA Oligomer
gcucaggagcucaaggaauag

SEQ ID NO: 20139 - RNA, 21 nt, Artificial Sequence
  RNA Oligomer
acacaauagaagaguggaaag

SEQ ID NO: 20140 - RNA, 21 nt, Artificial Sequence
  RNA Oligomer
caaugucugguaugauccuuc

SEQ ID NO: 20141 - RNA, 21 nt, Artificial Sequence
  RNA Oligomer
gcugguaauagaugcaucuaa

SEQ ID NO: 20142 - RNA, 21 nt, Artificial Sequence
  RNA Oligomer
agcugacucagaacacaacaa

SEQ ID NO: 20143 - RNA, 21 nt, Artificial Sequence
  RNA Oligomer
guccugaaacgauaucagaau

SEQ ID NO: 20144 - RNA, 21 nt, Artificial Sequence
  RNA Oligomer
cagcugacucagaacacaaca

SEQ ID NO: 20145 - RNA, 21 nt, Artificial Sequence
  RNA Oligomer
ugcuggauauagcuuugagaa

SEQ ID NO: 20146 - RNA, 21 nt, Artificial Sequence
  RNA Oligomer
uucacaguccugaaacgauau

SEQ ID NO: 20147 - RNA, 21 nt, Artificial Sequence
  RNA Oligomer
cgccuuauguagugacucgcu

SEQ ID NO: 20148 - RNA, 21 nt, Artificial Sequence
  RNA Oligomer
caggacugcaggaacgaguuu

SEQ ID NO: 20149 - RNA, 21 nt, Artificial Sequence
  RNA Oligomer
gacuuaaagcccaguaauaua

SEQ ID NO: 20150 - RNA, 21 nt, Artificial Sequence
  RNA Oligomer
cuucauucugcuggaauuauu

SEQ ID NO: 20151 - RNA, 21 nt, Artificial Sequence
  RNA Oligomer
gucauggagcucauggaugca

SEQ ID NO: 20152 - RNA, 21 nt, Artificial Sequence
  RNA Oligomer
ugauacagacagcagucuaga

SEQ ID NO: 20153 - RNA, 21 nt, Artificial Sequence
  RNA Oligomer
cgacuuuggccucugauacag

SEQ ID NO: 20154 - RNA, 21 nt, Artificial Sequence
  RNA Oligomer
gcucaaggaauaguaugcgca

SEQ ID NO: 20155 - RNA, 21 nt, Artificial Sequence
  RNA Oligomer
gugaucaauggcucucagcau

SEQ ID NO: 20156 - RNA, 21 nt, Artificial Sequence
  RNA Oligomer
acacacaauagaagaguggaa

SEQ ID NO: 20157 - RNA, 21 nt, Artificial Sequence
  RNA Oligomer
ccaccaaagaucccugacaag

SEQ ID NO: 20158 - RNA, 21 nt, Artificial Sequence
  RNA Oligomer
gcuugccaucaugagcagaag

SEQ ID NO: 20159 - RNA, 21 nt, Artificial Sequence
  RNA Oligomer
ccagcugacucagaacacaac

SEQ ID NO: 20160 - RNA, 21 nt, Artificial Sequence
  RNA Oligomer
acaguccugaaacgauaucag

SEQ ID NO: 20161 - RNA, 21 nt, Artificial Sequence
  RNA Oligomer
gcuggauauagcuuugagaaa

SEQ ID NO: 20162 - RNA, 21 nt, Artificial Sequence
  RNA Oligomer
cuaaauaugcuggauauagcu

SEQ ID NO: 20163 - RNA, 21 nt, Artificial Sequence
  RNA Oligomer
aguaaggacuuacguugaaaa

SEQ ID NO: 20164 - RNA, 21 nt, Artificial Sequence
  RNA Oligomer
ccaacaguaaggacuuacguu

SEQ ID NO: 20165 - RNA, 21 nt, Artificial Sequence
  RNA Oligomer
caaccaacaguaaggacuuac

SEQ ID NO: 20166 - RNA, 21 nt, Artificial Sequence
  RNA Oligomer
aagaaacugcaaccaacagua

SEQ ID NO: 20167 - RNA, 21 nt, Artificial Sequence
  RNA Oligomer
gacugcaggaacgaguuuuau

SEQ ID NO: 20168 - RNA, 21 nt, Artificial Sequence
  RNA Oligomer
guguggaaucaagcaccuuca

SEQ ID NO: 20169 - RNA, 21 nt, Artificial Sequence
  RNA Oligomer
gcuguguggaaucaagcaccu

SEQ ID NO: 20170 - RNA, 21 nt, Artificial Sequence
  RNA Oligomer
agcuaagccgaccauuucaga

SEQ ID NO: 20171 - RNA, 21 nt, Artificial Sequence
  RNA Oligomer
gccauucuugaaagaaauguu

SEQ ID NO: 20172 - RNA, 21 nt, Artificial Sequence
  RNA Oligomer
gccaucaugagcagaagcaag

SEQ ID NO: 20173 - RNA, 21 nt, Artificial Sequence
  RNA Oligomer
gacuuuggccucugauacaga

SEQ ID NO: 20174 - RNA, 21 nt, Artificial Sequence
  RNA Oligomer
ucaaugaugugucuucaaugu

SEQ ID NO: 20175 - RNA, 21 nt, Artificial Sequence
  RNA Oligomer
acacccguacaucaaugucug

SEQ ID NO: 20176 - RNA, 21 nt, Artificial Sequence
  RNA Oligomer
cuccaacacccguacaucaau

SEQ ID NO: 20177 - RNA, 21 nt, Artificial Sequence
  RNA Oligomer
agaugcaucuaaaaggaucuc

SEQ ID NO: 20178 - RNA, 21 nt, Artificial Sequence
  RNA Oligomer
agccagucaggcaagggauuu

SEQ ID NO: 20179 - RNA, 21 nt, Artificial Sequence
  RNA Oligomer
caguccugaaacgauaucaga

SEQ ID NO: 20180 - RNA, 21 nt, Artificial Sequence
  RNA Oligomer
cauccuuggcaugggcuacaa

SEQ ID NO: 20181 - RNA, 21 nt, Artificial Sequence
  RNA Oligomer
ugacgccuuauguagugacuc

SEQ ID NO: 20182 - RNA, 21 nt, Artificial Sequence
  RNA Oligomer
caccuucauucugcuggaauu

SEQ ID NO: 20183 - RNA, 21 nt, Artificial Sequence
  RNA Oligomer
uccuaccuucucuaucagaug

SEQ ID NO: 20184 - RNA, 21 nt, Artificial Sequence
  RNA Oligomer
ugccaagugauucagauggag

SEQ ID NO: 20185 - RNA, 21 nt, Artificial Sequence
  RNA Oligomer
gcagaagcaagcgugacaaca

SEQ ID NO: 20186 - RNA, 21 nt, Artificial Sequence
  RNA Oligomer
uggccuuuugaauguuuucac

SEQ ID NO: 20187 - RNA, 21 nt, Artificial Sequence
  RNA Oligomer
agccgaccauuucagaaucag

SEQ ID NO: 20188 - RNA, 21 nt, Artificial Sequence
  RNA Oligomer
ugccaucaugagcagaagcaa

SEQ ID NO: 20189 - RNA, 21 nt, Artificial Sequence
  RNA Oligomer
ggcucucagcauccaucauca

SEQ ID NO: 20190 - RNA, 21 nt, Artificial Sequence
  RNA Oligomer
ggaggagagaaccaagaaugg

SEQ ID NO: 20191 - RNA, 21 nt, Artificial Sequence
  RNA Oligomer
ccugacaagcaguuagaugaa

SEQ ID NO: 20192 - RNA, 21 nt, Artificial Sequence
  RNA Oligomer
accaccaaagaucccugacaa

SEQ ID NO: 20193 - RNA, 21 nt, Artificial Sequence
  RNA Oligomer
ccaaaaugcugguaauagaug

SEQ ID NO: 20194 - RNA, 21 nt, Artificial Sequence
  RNA Oligomer
uugaacagcuuggaacaccau

SEQ ID NO: 20195 - RNA, 21 nt, Artificial Sequence
  RNA Oligomer
ccuuauguagugacucgcuac

SEQ ID NO: 20196 - RNA, 21 nt, Artificial Sequence
  RNA Oligomer
guccuaccuucucuaucagau

SEQ ID NO: 20197 - RNA, 21 nt, Artificial Sequence
  RNA Oligomer
agcagaagcaagcgugacaac

SEQ ID NO: 20198 - RNA, 21 nt, Artificial Sequence
  RNA Oligomer
ccgaccauuucagaaucagac

SEQ ID NO: 20199 - RNA, 21 nt, Artificial Sequence
  RNA Oligomer
ucugauacagacagcagucua

SEQ ID NO: 20200 - RNA, 21 nt, Artificial Sequence
  RNA Oligomer
ccucugauacagacagcaguc

SEQ ID NO: 20201 - RNA, 21 nt, Artificial Sequence
  RNA Oligomer
caacacccguacaucaauguc

SEQ ID NO: 20202 - RNA, 21 nt, Artificial Sequence
  RNA Oligomer
aggcaagggauuuguuaucca

SEQ ID NO: 20203 - RNA, 21 nt, Artificial Sequence
  RNA Oligomer
agcuuugagaaacucuucccu

SEQ ID NO: 20204 - RNA, 21 nt, Artificial Sequence
  RNA Oligomer
uguggaaucaagcaccuucau

SEQ ID NO: 20205 - RNA, 21 nt, Artificial Sequence
  RNA Oligomer
cauggagcucauggaugcaaa

SEQ ID NO: 20206 - RNA, 21 nt, Artificial Sequence
  RNA Oligomer
ugaugccauucuugaaagaaa

SEQ ID NO: 20207 - RNA, 21 nt, Artificial Sequence
  RNA Oligomer
cgcagcuuaugaugccauucu

SEQ ID NO: 20208 - RNA, 21 nt, Artificial Sequence
  RNA Oligomer
aagcagaagcuccaccaccaa

SEQ ID NO: 20209 - RNA, 21 nt, Artificial Sequence
  RNA Oligomer
acuuugaagauucuugacuuc

SEQ ID NO: 20210 - RNA, 21 nt, Artificial Sequence
  RNA Oligomer
accuucucuaucagaugcugu

SEQ ID NO: 20211 - RNA, 21 nt, Artificial Sequence
  RNA Oligomer
gccucugauacagacagcagu

SEQ ID NO: 20212 - RNA, 21 nt, Artificial Sequence
  RNA Oligomer
guaugauccuucugaagcaga

SEQ ID NO: 20213 - RNA, 21 nt, Artificial Sequence
  RNA Oligomer
ugaagauucuugacuucgguc

SEQ ID NO: 20214 - RNA, 21 nt, Artificial Sequence
  RNA Oligomer
ccaagugauucagauggagcu

SEQ ID NO: 20215 - RNA, 21 nt, Artificial Sequence
  RNA Oligomer
gccaagugauucagauggagc

SEQ ID NO: 20216 - RNA, 21 nt, Artificial Sequence
  RNA Oligomer
auggaugcaaaucuuugccaa

SEQ ID NO: 20217 - RNA, 21 nt, Artificial Sequence
  RNA Oligomer
gccuuuugaauguuuucacac

SEQ ID NO: 20218 - RNA, 21 nt, Artificial Sequence
  RNA Oligomer
augaugccauucuugaaagaa

SEQ ID NO: 20219 - RNA, 21 nt, Artificial Sequence
  RNA Oligomer
ccaaagaucccugacaagcag

SEQ ID NO: 20220 - RNA, 21 nt, Artificial Sequence
  RNA Oligomer
cagaagcuccaccaccaaaga

SEQ ID NO: 20221 - RNA, 21 nt, Artificial Sequence
  RNA Oligomer
agaucaugaaagaauguccua

SEQ ID NO: 20222 - RNA, 21 nt, Artificial Sequence
  RNA Oligomer
gaugccauucuugaaagaaau

SEQ ID NO: 20223 - RNA, 21 nt, Artificial Sequence
  RNA Oligomer
cccugacaagcaguuagauga

SEQ ID NO: 20224 - RNA, 21 nt, Artificial Sequence
  RNA Oligomer
caaagaucccugacaagcagu

SEQ ID NO: 20225 - RNA, 21 nt, Artificial Sequence
  RNA Oligomer
agaagcuccaccaccaaagau

SEQ ID NO: 20226 - RNA, 21 nt, Artificial Sequence
  RNA Oligomer
ccugauguccuuuucccagcu

SEQ ID NO: 20227 - RNA, 21 nt, Artificial Sequence
  RNA Oligomer
agaauguccuaccuucucuau

SEQ ID NO: 20228 - RNA, 21 nt, Artificial Sequence
  RNA Oligomer
agcucauggaugcaaaucuuu

SEQ ID NO: 20229 - RNA, 21 nt, Artificial Sequence
  RNA Oligomer
ggccuacagagagcuaguucu

SEQ ID NO: 20230 - RNA, 21 nt, Artificial Sequence
  RNA Oligomer
ugagaaacucuucccugaugu

SEQ ID NO: 20231 - RNA, 21 nt, Artificial Sequence
  RNA Oligomer
cugauguccuuuucccagcug

SEQ ID NO: 20232 - RNA, 21 nt, Artificial Sequence
  RNA Oligomer
agcaccuucauucugcuggaa

SEQ ID NO: 20233 - RNA, 21 nt, Artificial Sequence
  RNA Oligomer
cuuuugaauguuuucacacca

SEQ ID NO: 20234 - RNA, 21 nt, Artificial Sequence
  RNA Oligomer
gccuacagagagcuaguucuu

SEQ ID NO: 20235 - RNA, 21 nt, Artificial Sequence
  RNA Oligomer
ccauucuugaaagaaauguug

SEQ ID NO: 20236 - RNA, 21 nt, Artificial Sequence
  RNA Oligomer
cuguagaugaagcucuccaac

SEQ ID NO: 20237 - RNA, 21 nt, Artificial Sequence
  RNA Oligomer
aagaauguccuaccuucucua

SEQ ID NO: 20238 - RNA, 21 nt, Artificial Sequence
  RNA Oligomer
uacaucaaugucugguaugau

SEQ ID NO: 20239 - RNA, 21 nt, Artificial Sequence
  RNA Oligomer
guagaugaagcucuccaacac

SEQ ID NO: 20240 - RNA, 21 nt, Artificial Sequence
  RNA Oligomer
gagaaacucuucccugauguc

SEQ ID NO: 20241 - RNA, 21 nt, Artificial Sequence
  RNA Oligomer
ucagaugcuguguggaaucaa

SEQ ID NO: 20242 - RNA, 21 nt, Artificial Sequence
  RNA Oligomer
ggacuuggaggagagaaccaa

SEQ ID NO: 20243 - RNA, 21 nt, Artificial Sequence
  RNA Oligomer
gauccgacuuuggccucugau

SEQ ID NO: 20244 - RNA, 21 nt, Artificial Sequence
  RNA Oligomer
agauccgacuuuggccucuga

SEQ ID NO: 20245 - RNA, 21 nt, Artificial Sequence
  RNA Oligomer
cuuggaggagagaaccaagaa

SEQ ID NO: 20246 - RNA, 21 nt, Artificial Sequence
  RNA Oligomer
cuaucagaugcuguguggaau

SEQ ID NO: 20247 - RNA, 21 nt, Artificial Sequence
  RNA Oligomer
cagcuuaugaugccauucuug

SEQ ID NO: 20248 - RNA, 21 nt, Artificial Sequence
  RNA Oligomer
ucaagcaccuucauucugcug

SEQ ID NO: 20249 - RNA, 21 nt, Artificial Sequence
  RNA Oligomer
uuacguugaaaacagaccuaa

SEQ ID NO: 20250 - RNA, 21 nt, Artificial Sequence
  RNA Oligomer
uaagucccgaugaauaauucc

SEQ ID NO: 20251 - RNA, 21 nt, Artificial Sequence
  RNA Oligomer
uuaaguuuguuguguucugag

SEQ ID NO: 20252 - RNA, 21 nt, Artificial Sequence
  RNA Oligomer
aaguuuguuguguucugaguc

SEQ ID NO: 20253 - RNA, 21 nt, Artificial Sequence
  RNA Oligomer
uuaagucccgaugaauaauuc

SEQ ID NO: 20254 - RNA, 21 nt, Artificial Sequence
  RNA Oligomer
ucggcuuagcuucuugauugc

SEQ ID NO: 20255 - RNA, 21 nt, Artificial Sequence
  RNA Oligomer
auggucggcuuagcuucuuga

SEQ ID NO: 20256 - RNA, 21 nt, Artificial Sequence
  RNA Oligomer
uacagagauccuuuuagaugc

SEQ ID NO: 20257 - RNA, 21 nt, Artificial Sequence
  RNA Oligomer
uauauccagcauauuuagguc

SEQ ID NO: 20258 - RNA, 21 nt, Artificial Sequence
  RNA Oligomer
auauccagcauauuuaggucu

SEQ ID NO: 20259 - RNA, 21 nt, Artificial Sequence
  RNA Oligomer
uauuuaggucuguuuucaacg

SEQ ID NO: 20260 - RNA, 21 nt, Artificial Sequence
  RNA Oligomer
uuuacuacuauauuacugggc

SEQ ID NO: 20261 - RNA, 21 nt, Artificial Sequence
  RNA Oligomer
auuccagcagaaugaaggugc

SEQ ID NO: 20262 - RNA, 21 nt, Artificial Sequence
  RNA Oligomer
augagucugauucugaaaugg

SEQ ID NO: 20263 - RNA, 21 nt, Artificial Sequence
  RNA Oligomer
aauggucggcuuagcuucuug

SEQ ID NO: 20264 - RNA, 21 nt, Artificial Sequence
  RNA Oligomer
uaucaaugacuaaccgacucc

SEQ ID NO: 20265 - RNA, 21 nt, Artificial Sequence
  RNA Oligomer
uugaagacacaucauugacag

SEQ ID NO: 20266 - RNA, 21 nt, Artificial Sequence
  RNA Oligomer
uacuauuccuugagcuccuga

SEQ ID NO: 20267 - RNA, 21 nt, Artificial Sequence
  RNA Oligomer
uugguugcaguuucuucauga

SEQ ID NO: 20268 - RNA, 21 nt, Artificial Sequence
  RNA Oligomer
uaaggcgucaucauaaaacuc

SEQ ID NO: 20269 - RNA, 21 nt, Artificial Sequence
  RNA Oligomer
uuucauaagaacuagcucucu

SEQ ID NO: 20270 - RNA, 21 nt, Artificial Sequence
  RNA Oligomer
aaaucacccaaaaauaagacc

SEQ ID NO: 20271 - RNA, 21 nt, Artificial Sequence
  RNA Oligomer
auaagcugcgcauacuauucc

SEQ ID NO: 20272 - RNA, 21 nt, Artificial Sequence
  RNA Oligomer
auacuauuccuugagcuccug

SEQ ID NO: 20273 - RNA, 21 nt, Artificial Sequence
  RNA Oligomer
uucuuuccacucuucuauugu

SEQ ID NO: 20274 - RNA, 21 nt, Artificial Sequence
  RNA Oligomer
aggacugugaauguagaaucu

SEQ ID NO: 20275 - RNA, 21 nt, Artificial Sequence
  RNA Oligomer
gacugugaauguagaaucucc

SEQ ID NO: 20276 - RNA, 21 nt, Artificial Sequence
  RNA Oligomer
ugaauguagaaucuccaaucu

SEQ ID NO: 20277 - RNA, 21 nt, Artificial Sequence
  RNA Oligomer
caaagugcaaucagauuuuac

SEQ ID NO: 20278 - RNA, 21 nt, Artificial Sequence
  RNA Oligomer
auucuuucaugaucuagcucc

SEQ ID NO: 20279 - RNA, 21 nt, Artificial Sequence
  RNA Oligomer
cuugauugcaacauuucuuuc

SEQ ID NO: 20280 - RNA, 21 nt, Artificial Sequence
  RNA Oligomer
aucaaugacuaaccgacuccc

SEQ ID NO: 20281 - RNA, 21 nt, Artificial Sequence
  RNA Oligomer
uaagcugcgcauacuauuccu

SEQ ID NO: 20282 - RNA, 21 nt, Artificial Sequence
  RNA Oligomer
aagacacaucauugacagacg

SEQ ID NO: 20283 - RNA, 21 nt, Artificial Sequence
  RNA Oligomer
uaucaauucuuuccacucuuc

SEQ ID NO: 20284 - RNA, 21 nt, Artificial Sequence
  RNA Oligomer
aucaauucuuuccacucuucu

SEQ ID NO: 20285 - RNA, 21 nt, Artificial Sequence
  RNA Oligomer
acaaaucccuugccugacugg

SEQ ID NO: 20286 - RNA, 21 nt, Artificial Sequence
  RNA Oligomer
uauccagcauauuuaggucug

SEQ ID NO: 20287 - RNA, 21 nt, Artificial Sequence
  RNA Oligomer
acugugaauguagaaucucca

SEQ ID NO: 20288 - RNA, 21 nt, Artificial Sequence
  RNA Oligomer
aaggcgucaucauaaaacucg

SEQ ID NO: 20289 - RNA, 21 nt, Artificial Sequence
  RNA Oligomer
uagaaucuccaaucucuacac

SEQ ID NO: 20290 - RNA, 21 nt, Artificial Sequence
  RNA Oligomer
aauuguugucacgcuugcuuc

SEQ ID NO: 20291 - RNA, 21 nt, Artificial Sequence
  RNA Oligomer
aaucacccaaaaauaagacca

SEQ ID NO: 20292 - RNA, 21 nt, Artificial Sequence
  RNA Oligomer
aucacccaaaaauaagaccac

SEQ ID NO: 20293 - RNA, 21 nt, Artificial Sequence
  RNA Oligomer
agcugcgcauacuauuccuug

SEQ ID NO: 20294 - RNA, 21 nt, Artificial Sequence
  RNA Oligomer
acagagauccuuuuagaugca

SEQ ID NO: 20295 - RNA, 21 nt, Artificial Sequence
  RNA Oligomer
guuuguuguguucugagucag

SEQ ID NO: 20296 - RNA, 21 nt, Artificial Sequence
  RNA Oligomer
acauucuuucaugaucuagcu

SEQ ID NO: 20297 - RNA, 21 nt, Artificial Sequence
  RNA Oligomer
uucuuucaugaucuagcucca

SEQ ID NO: 20298 - RNA, 21 nt, Artificial Sequence
  RNA Oligomer
auuucauaagaacuagcucuc

SEQ ID NO: 20299 - RNA, 21 nt, Artificial Sequence
  RNA Oligomer
cugagagccauugaucacugc

SEQ ID NO: 20300 - RNA, 21 nt, Artificial Sequence
  RNA Oligomer
acucuucuauuguguguuccc

SEQ ID NO: 20301 - RNA, 21 nt, Artificial Sequence
  RNA Oligomer
uucuauuguguguucccuuuc

SEQ ID NO: 20302 - RNA, 21 nt, Artificial Sequence
  RNA Oligomer
aacaaaucccuugccugacug

SEQ ID NO: 20303 - RNA, 21 nt, Artificial Sequence
  RNA Oligomer
auaaggcgucaucauaaaacu

SEQ ID NO: 20304 - RNA, 21 nt, Artificial Sequence
  RNA Oligomer
gaauguagaaucuccaaucuc

SEQ ID NO: 20305 - RNA, 21 nt, Artificial Sequence
  RNA Oligomer
aauguagaaucuccaaucucu

SEQ ID NO: 20306 - RNA, 21 nt, Artificial Sequence
  RNA Oligomer
aagucaagaaucuucaaagug

SEQ ID NO: 20307 - RNA, 21 nt, Artificial Sequence
  RNA Oligomer
agucccgaugaauaauuccag

SEQ ID NO: 20308 - RNA, 21 nt, Artificial Sequence
  RNA Oligomer
cuauaaaaauuguugucacgc

SEQ ID NO: 20309 - RNA, 21 nt, Artificial Sequence
  RNA Oligomer
cauucuuucaugaucuagcuc

SEQ ID NO: 20310 - RNA, 21 nt, Artificial Sequence
  RNA Oligomer
uuucaugaucuagcuccaucu

SEQ ID NO: 20311 - RNA, 21 nt, Artificial Sequence
  RNA Oligomer
uucaugaucuagcuccaucug

SEQ ID NO: 20312 - RNA, 21 nt, Artificial Sequence
  RNA Oligomer
guucuaucaaugacuaaccga

SEQ ID NO: 20313 - RNA, 21 nt, Artificial Sequence
  RNA Oligomer
auaacuccauucuugguucuc

SEQ ID NO: 20314 - RNA, 21 nt, Artificial Sequence
  RNA Oligomer
auucuuuccacucuucuauug

SEQ ID NO: 20315 - RNA, 21 nt, Artificial Sequence
  RNA Oligomer
uagcgagucacuacauaaggc

SEQ ID NO: 20316 - RNA, 21 nt, Artificial Sequence
  RNA Oligomer
aucauaaaacucguuccugca

SEQ ID NO: 20317 - RNA, 21 nt, Artificial Sequence
  RNA Oligomer
auguagaaucuccaaucucua

SEQ ID NO: 20318 - RNA, 21 nt, Artificial Sequence
  RNA Oligomer
agugcaaucagauuuuacuac

SEQ ID NO: 20319 - RNA, 21 nt, Artificial Sequence
  RNA Oligomer
uuacuacuauauuacugggcu

SEQ ID NO: 20320 - RNA, 21 nt, Artificial Sequence
  RNA Oligomer
aagucccgaugaauaauucca

SEQ ID NO: 20321 - RNA, 21 nt, Artificial Sequence
  RNA Oligomer
gucccgaugaauaauuccagc

SEQ ID NO: 20322 - RNA, 21 nt, Artificial Sequence
  RNA Oligomer
uaaaaauuguugucacgcuug

SEQ ID NO: 20323 - RNA, 21 nt, Artificial Sequence
  RNA Oligomer
aaaauuguugucacgcuugcu

SEQ ID NO: 20324 - RNA, 21 nt, Artificial Sequence
  RNA Oligomer
auuguugucacgcuugcuucu

SEQ ID NO: 20325 - RNA, 21 nt, Artificial Sequence
  RNA Oligomer
acacauuucauaagaacuagc

SEQ ID NO: 20326 - RNA, 21 nt, Artificial Sequence
  RNA Oligomer
acauuucauaagaacuagcuc

SEQ ID NO: 20327 - RNA, 21 nt, Artificial Sequence
  RNA Oligomer
aagcugcgcauacuauuccuu

SEQ ID NO: 20328 - RNA, 21 nt, Artificial Sequence
  RNA Oligomer
uugacauugaagacacaucau

SEQ ID NO: 20329 - RNA, 21 nt, Artificial Sequence
  RNA Oligomer
auugaagacacaucauugaca

SEQ ID NO: 20330 - RNA, 21 nt, Artificial Sequence
  RNA Oligomer
agacacaucauugacagacga

SEQ ID NO: 20331 - RNA, 21 nt, Artificial Sequence
  RNA Oligomer
augaugauggaugcugagagc

SEQ ID NO: 20332 - RNA, 21 nt, Artificial Sequence
  RNA Oligomer
ugauaucguuucaggacugug

SEQ ID NO: 20333 - RNA, 21 nt, Artificial Sequence
  RNA Oligomer
ucacuacauaaggcgucauca

SEQ ID NO: 20334 - RNA, 21 nt, Artificial Sequence
  RNA Oligomer
ucaucauaaaacucguuccug

SEQ ID NO: 20335 - RNA, 21 nt, Artificial Sequence
  RNA Oligomer
agaaucuccaaucucuacacu

SEQ ID NO: 20336 - RNA, 21 nt, Artificial Sequence
  RNA Oligomer
aaaaauuguugucacgcuugc

SEQ ID NO: 20337 - RNA, 21 nt, Artificial Sequence
  RNA Oligomer
uagcuccaucugaaucacuug

SEQ ID NO: 20338 - RNA, 21 nt, Artificial Sequence
  RNA Oligomer
uuguugucacgcuugcuucug

SEQ ID NO: 20339 - RNA, 21 nt, Artificial Sequence
  RNA Oligomer
ugagucugauucugaaauggu

SEQ ID NO: 20340 - RNA, 21 nt, Artificial Sequence
  RNA Oligomer
uaagaccacugaauuguuuuc

SEQ ID NO: 20341 - RNA, 21 nt, Artificial Sequence
  RNA Oligomer
guugacauugaagacacauca

SEQ ID NO: 20342 - RNA, 21 nt, Artificial Sequence
  RNA Oligomer
gacacaucauugacagacgac

SEQ ID NO: 20343 - RNA, 21 nt, Artificial Sequence
  RNA Oligomer
uauuguguguucccuuucauc

SEQ ID NO: 20344 - RNA, 21 nt, Artificial Sequence
  RNA Oligomer
auguacggguguuggagagcu

SEQ ID NO: 20345 - RNA, 21 nt, Artificial Sequence
  RNA Oligomer
auaacaaaucccuugccugac

SEQ ID NO: 20346 - RNA, 21 nt, Artificial Sequence
  RNA Oligomer
uugcaguuucuucaugaauuc

SEQ ID NO: 20347 - RNA, 21 nt, Artificial Sequence
  RNA Oligomer
aguuucuucaugaauucagga

SEQ ID NO: 20348 - RNA, 21 nt, Artificial Sequence
  RNA Oligomer
uuuuccuuguagcccaugcca

SEQ ID NO: 20349 - RNA, 21 nt, Artificial Sequence
  RNA Oligomer
cgucaucauaaaacucguucc

SEQ ID NO: 20350 - RNA, 21 nt, Artificial Sequence
  RNA Oligomer
gucaucauaaaacucguuccu

SEQ ID NO: 20351 - RNA, 21 nt, Artificial Sequence
  RNA Oligomer
caucauaaaacucguuccugc

SEQ ID NO: 20352 - RNA, 21 nt, Artificial Sequence
  RNA Oligomer
agaaucuucaaagugcaauca

SEQ ID NO: 20353 - RNA, 21 nt, Artificial Sequence
  RNA Oligomer
gaaucuucaaagugcaaucag

SEQ ID NO: 20354 - RNA, 21 nt, Artificial Sequence
  RNA Oligomer
aucuucaaagugcaaucagau

SEQ ID NO: 20355 - RNA, 21 nt, Artificial Sequence
  RNA Oligomer
aucuagcuccaucugaaucac

SEQ ID NO: 20356 - RNA, 21 nt, Artificial Sequence
  RNA Oligomer
cacauuucauaagaacuagcu

SEQ ID NO: 20357 - RNA, 21 nt, Artificial Sequence
  RNA Oligomer
acccaaaaauaagaccacuga

SEQ ID NO: 20358 - RNA, 21 nt, Artificial Sequence
  RNA Oligomer
uucuaucaaugacuaaccgac

SEQ ID NO: 20359 - RNA, 21 nt, Artificial Sequence
  RNA Oligomer
ucuaucaaugacuaaccgacu

SEQ ID NO: 20360 - RNA, 21 nt, Artificial Sequence
  RNA Oligomer
cacaucauugacagacgacga

SEQ ID NO: 20361 - RNA, 21 nt, Artificial Sequence
  RNA Oligomer
gacgaugaugauggaugcuga

SEQ ID NO: 20362 - RNA, 21 nt, Artificial Sequence
  RNA Oligomer
auuguguguucccuuucaucu

SEQ ID NO: 20363 - RNA, 21 nt, Artificial Sequence
  RNA Oligomer
agucaagaaucuucaaagugc

SEQ ID NO: 20364 - RNA, 21 nt, Artificial Sequence
  RNA Oligomer
uucauaagaacuagcucucug

SEQ ID NO: 20365 - RNA, 21 nt, Artificial Sequence
  RNA Oligomer
acgaugaugauggaugcugag

SEQ ID NO: 20366 - RNA, 21 nt, Artificial Sequence
  RNA Oligomer
uaacuccauucuugguucucu

SEQ ID NO: 20367 - RNA, 21 nt, Artificial Sequence
  RNA Oligomer
caguuucuucaugaauucagg

SEQ ID NO: 20368 - RNA, 21 nt, Artificial Sequence
  RNA Oligomer
uuccaagcuguucaauaacuu

SEQ ID NO: 20369 - RNA, 21 nt, Artificial Sequence
  RNA Oligomer
gcuguucaauaacuuuauucc

SEQ ID NO: 20370 - RNA, 21 nt, Artificial Sequence
  RNA Oligomer
guuuuccuuguagcccaugcc

SEQ ID NO: 20371 - RNA, 21 nt, Artificial Sequence
  RNA Oligomer
aggcgucaucauaaaacucgu

SEQ ID NO: 20372 - RNA, 21 nt, Artificial Sequence
  RNA Oligomer
uacuacuauauuacugggcuu

SEQ ID NO: 20373 - RNA, 21 nt, Artificial Sequence
  RNA Oligomer
ucccgaugaauaauuccagca

SEQ ID NO: 20374 - RNA, 21 nt, Artificial Sequence
  RNA Oligomer
uucuagggauuucuguggugu

SEQ ID NO: 20375 - RNA, 21 nt, Artificial Sequence
  RNA Oligomer
cauuucauaagaacuagcucu

SEQ ID NO: 20376 - RNA, 21 nt, Artificial Sequence
  RNA Oligomer
gauugcaacauuucuuucaag

SEQ ID NO: 20377 - RNA, 21 nt, Artificial Sequence
  RNA Oligomer
uguucccuuucaucuaacugc

SEQ ID NO: 20378 - RNA, 21 nt, Artificial Sequence
  RNA Oligomer
cuuucaucuaacugcuuguca

SEQ ID NO: 20379 - RNA, 21 nt, Artificial Sequence
  RNA Oligomer
cugcuucagaaggaucauacc

SEQ ID NO: 20380 - RNA, 21 nt, Artificial Sequence
  RNA Oligomer
guuuucaacguaaguccuuac

SEQ ID NO: 20381 - RNA, 21 nt, Artificial Sequence
  RNA Oligomer
ugcaguuucuucaugaauuca

SEQ ID NO: 20382 - RNA, 21 nt, Artificial Sequence
  RNA Oligomer
aagaaucuucaaagugcaauc

SEQ ID NO: 20383 - RNA, 21 nt, Artificial Sequence
  RNA Oligomer
ugagagccauugaucacugcu

SEQ ID NO: 20384 - RNA, 21 nt, Artificial Sequence
  RNA Oligomer
uauaacuccauucuugguucu

SEQ ID NO: 20385 - RNA, 21 nt, Artificial Sequence
  RNA Oligomer
uccuccaaguccauaacuucc

SEQ ID NO: 20386 - RNA, 21 nt, Artificial Sequence
  RNA Oligomer
guguucccuuucaucuaacug

SEQ ID NO: 20387 - RNA, 21 nt, Artificial Sequence
  RNA Oligomer
guucccuuucaucuaacugcu

SEQ ID NO: 20388 - RNA, 21 nt, Artificial Sequence
  RNA Oligomer
uucccuuucaucuaacugcuu

SEQ ID NO: 20389 - RNA, 21 nt, Artificial Sequence
  RNA Oligomer
gaaaaggacaucagggaagag

SEQ ID NO: 20390 - RNA, 21 nt, Artificial Sequence
  RNA Oligomer
gucaagaaucuucaaagugca

SEQ ID NO: 20391 - RNA, 21 nt, Artificial Sequence
  RNA Oligomer
cuccuccaaguccauaacuuc

SEQ ID NO: 20392 - RNA, 21 nt, Artificial Sequence
  RNA Oligomer
ucagcugggaaaaggacauca

SEQ ID NO: 20393 - RNA, 21 nt, Artificial Sequence
  RNA Oligomer
ucuagcuccaucugaaucacu

SEQ ID NO: 20394 - RNA, 21 nt, Artificial Sequence
  RNA Oligomer
cuucuagggauuucuguggug

SEQ ID NO: 20395 - RNA, 21 nt, Artificial Sequence
  RNA Oligomer
uuucaucuaacugcuugucag

SEQ ID NO: 20396 - RNA, 21 nt, Artificial Sequence
  RNA Oligomer
cuugagcuccugagccuauag

SEQ ID NO: 20397 - RNA, 21 nt, Artificial Sequence
  RNA Oligomer
aauucaggacaugguguucca

SEQ ID NO: 20398 - RNA, 21 nt, Artificial Sequence
  RNA Oligomer
auuacugggcuuuaagucccg

SEQ ID NO: 20399 - RNA, 21 nt, Artificial Sequence
  RNA Oligomer
guauaacuccauucuugguuc

SEQ ID NO: 20400 - RNA, 21 nt, Artificial Sequence
  RNA Oligomer
cauaccagacauugauguacg

SEQ ID NO: 20401 - RNA, 21 nt, Artificial Sequence
  RNA Oligomer
uaaaacucguuccugcagucc

SEQ ID NO: 20402 - RNA, 21 nt, Artificial Sequence
  RNA Oligomer
uucuucuagggauuucugugg

SEQ ID NO: 20403 - RNA, 21 nt, Artificial Sequence
  RNA Oligomer
uuuagaugcaucuauuaccag

SEQ ID NO: 20404 - RNA, 21 nt, Artificial Sequence
  RNA Oligomer
auuuaggucuguuuucaacgu

SEQ ID NO: 20405 - RNA, 21 nt, Artificial Sequence
  RNA Oligomer
uuucuucaugaauucaggaca

SEQ ID NO: 20406 - RNA, 21 nt, Artificial Sequence
  RNA Oligomer
uuuggauaacaaaucccuugc

SEQ ID NO: 20407 - RNA, 21 nt, Artificial Sequence
  RNA Oligomer
ugacuggcuuuaaguuuguug

SEQ ID NO: 20408 - RNA, 21 nt, Artificial Sequence
  RNA Oligomer
acuggcuuuaaguuuguugug

SEQ ID NO: 20409 - RNA, 21 nt, Artificial Sequence
  RNA Oligomer
gucuguuuucaacguaagucc

SEQ ID NO: 20410 - RNA, 21 nt, Artificial Sequence
  RNA Oligomer
uucuucaugaauucaggacau

SEQ ID NO: 20411 - RNA, 21 nt, Artificial Sequence
  RNA Oligomer
acuccauucuugguucucucc

SEQ ID NO: 20412 - RNA, 21 nt, Artificial Sequence
  RNA Oligomer
uuggauaacaaaucccuugcc

SEQ ID NO: 20413 - RNA, 21 nt, Artificial Sequence
  RNA Oligomer
aaauucugauaucguuucagg

SEQ ID NO: 20414 - RNA, 21 nt, Artificial Sequence
  RNA Oligomer
uuuaggucuguuuucaacgua

SEQ ID NO: 20415 - RNA, 21 nt, Artificial Sequence
  RNA Oligomer
uuacuguugguugcaguuucu

SEQ ID NO: 20416 - RNA, 21 nt, Artificial Sequence
  RNA Oligomer
guuucaggacugugaauguag

SEQ ID NO: 20417 - RNA, 21 nt, Artificial Sequence
  RNA Oligomer
auucaggacaugguguuccaa

SEQ ID NO: 20418 - RNA, 21 nt, Artificial Sequence
  RNA Oligomer
aagguaggacauucuuucaug

SEQ ID NO: 20419 - RNA, 21 nt, Artificial Sequence
  RNA Oligomer
aagauuugcauccaugagcuc

SEQ ID NO: 20420 - RNA, 21 nt, Artificial Sequence
  RNA Oligomer
aaauucuucuagggauuucug

SEQ ID NO: 20421 - RNA, 21 nt, Artificial Sequence
  RNA Oligomer
uucuguggugugaaaacauuc

SEQ ID NO: 20422 - RNA, 21 nt, Artificial Sequence
  RNA Oligomer
ucauaagaacuagcucucugu

SEQ ID NO: 20423 - RNA, 21 nt, Artificial Sequence
  RNA Oligomer
aacuccauucuugguucucuc

SEQ ID NO: 20424 - RNA, 21 nt, Artificial Sequence
  RNA Oligomer
ucauaccagacauugauguac

SEQ ID NO: 20425 - RNA, 21 nt, Artificial Sequence
  RNA Oligomer
gacuggcuuuaaguuuguugu

SEQ ID NO: 20426 - RNA, 21 nt, Artificial Sequence
  RNA Oligomer
uuuguuguguucugagucagc

SEQ ID NO: 20427 - RNA, 21 nt, Artificial Sequence
  RNA Oligomer
uuucaacguaaguccuuacug

SEQ ID NO: 20428 - RNA, 21 nt, Artificial Sequence
  RNA Oligomer
uaaguccuuacuguugguugc

SEQ ID NO: 20429 - RNA, 21 nt, Artificial Sequence
  RNA Oligomer
uaauuccagcagaaugaaggu

SEQ ID NO: 20430 - RNA, 21 nt, Artificial Sequence
  RNA Oligomer
ucuucuagggauuucuguggu

SEQ ID NO: 20431 - RNA, 21 nt, Artificial Sequence
  RNA Oligomer
auaagaacuagcucucuguag

SEQ ID NO: 20432 - RNA, 21 nt, Artificial Sequence
  RNA Oligomer
uucaagaauggcaucauaagc

SEQ ID NO: 20433 - RNA, 21 nt, Artificial Sequence
  RNA Oligomer
auaccagacauugauguacgg

SEQ ID NO: 20434 - RNA, 21 nt, Artificial Sequence
  RNA Oligomer
cauuuuggauaacaaaucccu

SEQ ID NO: 20435 - RNA, 21 nt, Artificial Sequence
  RNA Oligomer
gaguuucucaaagcuauaucc

SEQ ID NO: 20436 - RNA, 21 nt, Artificial Sequence
  RNA Oligomer
uaggucuguuuucaacguaag

SEQ ID NO: 20437 - RNA, 21 nt, Artificial Sequence
  RNA Oligomer
cuucaugaauucaggacaugg

SEQ ID NO: 20438 - RNA, 21 nt, Artificial Sequence
  RNA Oligomer
acuuggcaaagauuugcaucc

SEQ ID NO: 20439 - RNA, 21 nt, Artificial Sequence
  RNA Oligomer
agauuugcauccaugagcucc

SEQ ID NO: 20440 - RNA, 21 nt, Artificial Sequence
  RNA Oligomer
aauucuucuagggauuucugu

SEQ ID NO: 20441 - RNA, 21 nt, Artificial Sequence
  RNA Oligomer
ucuagggauuucuguggugug

SEQ ID NO: 20442 - RNA, 21 nt, Artificial Sequence
  RNA Oligomer
auuucuguggugugaaaacau

SEQ ID NO: 20443 - RNA, 21 nt, Artificial Sequence
  RNA Oligomer
uaccagacauugauguacggg

SEQ ID NO: 20444 - RNA, 21 nt, Artificial Sequence
  RNA Oligomer
gagcuucaucuacagagaucc

SEQ ID NO: 20445 - RNA, 21 nt, Artificial Sequence
  RNA Oligomer
aauucugauaucguuucagga

SEQ ID NO: 20446 - RNA, 21 nt, Artificial Sequence
  RNA Oligomer
uuguguucugagucagcuggg

SEQ ID NO: 20447 - RNA, 21 nt, Artificial Sequence
  RNA Oligomer
ucuguuuucaacguaaguccu

SEQ ID NO: 20448 - RNA, 21 nt, Artificial Sequence
  RNA Oligomer
ugaauucaggacaugguguuc

SEQ ID NO: 20449 - RNA, 21 nt, Artificial Sequence
  RNA Oligomer
gaauucaggacaugguguucc

SEQ ID NO: 20450 - RNA, 21 nt, Artificial Sequence
  RNA Oligomer
auauuacugggcuuuaagucc

SEQ ID NO: 20451 - RNA, 21 nt, Artificial Sequence
  RNA Oligomer
cugggcuuuaagucccgauga

SEQ ID NO: 20452 - RNA, 21 nt, Artificial Sequence
  RNA Oligomer
uccacacagcaucugauagag

SEQ ID NO: 20453 - RNA, 21 nt, Artificial Sequence
  RNA Oligomer
cuuggcaaagauuugcaucca

SEQ ID NO: 20454 - RNA, 21 nt, Artificial Sequence
  RNA Oligomer
uugucacgcuugcuucugcuc

SEQ ID NO: 20455 - RNA, 21 nt, Artificial Sequence
  RNA Oligomer
uuggcaugagucugauucuga

SEQ ID NO: 20456 - RNA, 21 nt, Artificial Sequence
  RNA Oligomer
uaguucuaucaaugacuaacc

SEQ ID NO: 20457 - RNA, 21 nt, Artificial Sequence
  RNA Oligomer
auggaugcugagagccauuga

SEQ ID NO: 20458 - RNA, 21 nt, Artificial Sequence
  RNA Oligomer
agcuucaucuacagagauccu

SEQ ID NO: 20459 - RNA, 21 nt, Artificial Sequence
  RNA Oligomer
agcauuuuggauaacaaaucc

SEQ ID NO: 20460 - RNA, 21 nt, Artificial Sequence
  RNA Oligomer
uuuuggauaacaaaucccuug

SEQ ID NO: 20461 - RNA, 21 nt, Artificial Sequence
  RNA Oligomer
uauuacugggcuuuaaguccc

SEQ ID NO: 20462 - RNA, 21 nt, Artificial Sequence
  RNA Oligomer
agaagguaggacauucuuuca

SEQ ID NO: 20463 - RNA, 21 nt, Artificial Sequence
  RNA Oligomer
cacuuggcaaagauuugcauc

SEQ ID NO: 20464 - RNA, 21 nt, Artificial Sequence
  RNA Oligomer
auucuucuagggauuucugug

SEQ ID NO: 20465 - RNA, 21 nt, Artificial Sequence
  RNA Oligomer
ugugaaaacauucaaaaggcc

SEQ ID NO: 20466 - RNA, 21 nt, Artificial Sequence
  RNA Oligomer
auucugaaauggucggcuuag

SEQ ID NO: 20467 - RNA, 21 nt, Artificial Sequence
  RNA Oligomer
gaauggcaucauaagcugcgc

SEQ ID NO: 20468 - RNA, 21 nt, Artificial Sequence
  RNA Oligomer
aguucuaucaaugacuaaccg

SEQ ID NO: 20469 - RNA, 21 nt, Artificial Sequence
  RNA Oligomer
uguaucagaggccaaagucgg

SEQ ID NO: 20470 - RNA, 21 nt, Artificial Sequence
  RNA Oligomer
aagucggaucuguugacauug

SEQ ID NO: 20471 - RNA, 21 nt, Artificial Sequence
  RNA Oligomer
agagccauugaucacugcugc

SEQ ID NO: 20472 - RNA, 21 nt, Artificial Sequence
  RNA Oligomer
uauuccuugagcuccugagcc

SEQ ID NO: 20473 - RNA, 21 nt, Artificial Sequence
  RNA Oligomer
ugagcuccugagccuauaggu

SEQ ID NO: 20474 - RNA, 21 nt, Artificial Sequence
  RNA Oligomer
acauugauguacggguguugg

SEQ ID NO: 20475 - RNA, 21 nt, Artificial Sequence
  RNA Oligomer
auuaccagcauuuuggauaac

SEQ ID NO: 20476 - RNA, 21 nt, Artificial Sequence
  RNA Oligomer
aguuucucaaagcuauaucca

SEQ ID NO: 20477 - RNA, 21 nt, Artificial Sequence
  RNA Oligomer
auccagcauauuuaggucugu

SEQ ID NO: 20478 - RNA, 21 nt, Artificial Sequence
  RNA Oligomer
uucaacguaaguccuuacugu

SEQ ID NO: 20479 - RNA, 21 nt, Artificial Sequence
  RNA Oligomer
ucaugaauucaggacauggug

SEQ ID NO: 20480 - RNA, 21 nt, Artificial Sequence
  RNA Oligomer
caggacaugguguuccaagcu

SEQ ID NO: 20481 - RNA, 21 nt, Artificial Sequence
  RNA Oligomer
uuacugggcuuuaagucccga

SEQ ID NO: 20482 - RNA, 21 nt, Artificial Sequence
  RNA Oligomer
agguaggacauucuuucauga

SEQ ID NO: 20483 - RNA, 21 nt, Artificial Sequence
  RNA Oligomer
uaagaacuagcucucuguagg

SEQ ID NO: 20484 - RNA, 21 nt, Artificial Sequence
  RNA Oligomer
agucugauucugaaauggucg

SEQ ID NO: 20485 - RNA, 21 nt, Artificial Sequence
  RNA Oligomer
ucugauucugaaauggucggc

SEQ ID NO: 20486 - RNA, 21 nt, Artificial Sequence
  RNA Oligomer
aauggcaucauaagcugcgca

SEQ ID NO: 20487 - RNA, 21 nt, Artificial Sequence
  RNA Oligomer
uugagcuccugagccuauagg

SEQ ID NO: 20488 - RNA, 21 nt, Artificial Sequence
  RNA Oligomer
uucagaaggaucauaccagac

SEQ ID NO: 20489 - RNA, 21 nt, Artificial Sequence
  RNA Oligomer
aucuauuaccagcauuuugga

SEQ ID NO: 20490 - RNA, 21 nt, Artificial Sequence
  RNA Oligomer
ucguuucaggacugugaaugu

SEQ ID NO: 20491 - RNA, 21 nt, Artificial Sequence
  RNA Oligomer
uaguagcgagucacuacauaa

SEQ ID NO: 20492 - RNA, 21 nt, Artificial Sequence
  RNA Oligomer
auaauuccagcagaaugaagg

SEQ ID NO: 20493 - RNA, 21 nt, Artificial Sequence
  RNA Oligomer
agaaugaaggugcuugauucc

SEQ ID NO: 20494 - RNA, 21 nt, Artificial Sequence
  RNA Oligomer
aaugaaggugcuugauuccac

SEQ ID NO: 20495 - RNA, 21 nt, Artificial Sequence
  RNA Oligomer
agcaucugauagagaagguag

SEQ ID NO: 20496 - RNA, 21 nt, Artificial Sequence
  RNA Oligomer
aaucacuuggcaaagauuugc

SEQ ID NO: 20497 - RNA, 21 nt, Artificial Sequence
  RNA Oligomer
aucacuuggcaaagauuugca

SEQ ID NO: 20498 - RNA, 21 nt, Artificial Sequence
  RNA Oligomer
ucacuuggcaaagauuugcau

SEQ ID NO: 20499 - RNA, 21 nt, Artificial Sequence
  RNA Oligomer
auuugcauccaugagcuccau

SEQ ID NO: 20500 - RNA, 21 nt, Artificial Sequence
  RNA Oligomer
aagaccacugaauuguuuuca

SEQ ID NO: 20501 - RNA, 21 nt, Artificial Sequence
  RNA Oligomer
gacauugaagacacaucauug

SEQ ID NO: 20502 - RNA, 21 nt, Artificial Sequence
  RNA Oligomer
cauugaagacacaucauugac

SEQ ID NO: 20503 - RNA, 21 nt, Artificial Sequence
  RNA Oligomer
cccguauaacuccauucuugg

SEQ ID NO: 20504 - RNA, 21 nt, Artificial Sequence
  RNA Oligomer
uuuccacucuucuauugugug

SEQ ID NO: 20505 - RNA, 21 nt, Artificial Sequence
  RNA Oligomer
cacucuucuauuguguguucc

SEQ ID NO: 20506 - RNA, 21 nt, Artificial Sequence
  RNA Oligomer
aaggaucauaccagacauuga

SEQ ID NO: 20507 - RNA, 21 nt, Artificial Sequence
  RNA Oligomer
uuggagagcuucaucuacaga

SEQ ID NO: 20508 - RNA, 21 nt, Artificial Sequence
  RNA Oligomer
aucuacagagauccuuuuaga

SEQ ID NO: 20509 - RNA, 21 nt, Artificial Sequence
  RNA Oligomer
cuuuuagaugcaucuauuacc

SEQ ID NO: 20510 - RNA, 21 nt, Artificial Sequence
  RNA Oligomer
uagaugcaucuauuaccagca

SEQ ID NO: 20511 - RNA, 21 nt, Artificial Sequence
  RNA Oligomer
uuaccagcauuuuggauaaca

SEQ ID NO: 20512 - RNA, 21 nt, Artificial Sequence
  RNA Oligomer
gcauuuuggauaacaaauccc

SEQ ID NO: 20513 - RNA, 21 nt, Artificial Sequence
  RNA Oligomer
cagggaagaguuucucaaagc

SEQ ID NO: 20514 - RNA, 21 nt, Artificial Sequence
  RNA Oligomer
acguaaguccuuacuguuggu

SEQ ID NO: 20515 - RNA, 21 nt, Artificial Sequence
  RNA Oligomer
aaguccuuacuguugguugca

SEQ ID NO: 20516 - RNA, 21 nt, Artificial Sequence
  RNA Oligomer
uucaugaauucaggacauggu

SEQ ID NO: 20517 - RNA, 21 nt, Artificial Sequence
  RNA Oligomer
uucaggacugugaauguagaa

SEQ ID NO: 20518 - RNA, 21 nt, Artificial Sequence
  RNA Oligomer
aaggugcuugauuccacacag

SEQ ID NO: 20519 - RNA, 21 nt, Artificial Sequence
  RNA Oligomer
auccaugagcuccaugacuau

SEQ ID NO: 20520 - RNA, 21 nt, Artificial Sequence
  RNA Oligomer
caucuugaaauucuucuaggg

SEQ ID NO: 20521 - RNA, 21 nt, Artificial Sequence
  RNA Oligomer
aucuugaaauucuucuaggga

SEQ ID NO: 20522 - RNA, 21 nt, Artificial Sequence
  RNA Oligomer
gaaauucuucuagggauuucu

SEQ ID NO: 20523 - RNA, 21 nt, Artificial Sequence
  RNA Oligomer
aagaauggcaucauaagcugc

SEQ ID NO: 20524 - RNA, 21 nt, Artificial Sequence
  RNA Oligomer
auggcccaaguagucaucuac

SEQ ID NO: 20525 - RNA, 21 nt, Artificial Sequence
  RNA Oligomer
aucuguugacauugaagacac

SEQ ID NO: 20526 - RNA, 21 nt, Artificial Sequence
  RNA Oligomer
cauucuugguucucuccucca

SEQ ID NO: 20527 - RNA, 21 nt, Artificial Sequence
  RNA Oligomer
cuauuccuugagcuccugagc

SEQ ID NO: 20528 - RNA, 21 nt, Artificial Sequence
  RNA Oligomer
cuuuccacucuucuauugugu

SEQ ID NO: 20529 - RNA, 21 nt, Artificial Sequence
  RNA Oligomer
gaaggaucauaccagacauug

SEQ ID NO: 20530 - RNA, 21 nt, Artificial Sequence
  RNA Oligomer
uuagaugcaucuauuaccagc

SEQ ID NO: 20531 - RNA, 21 nt, Artificial Sequence
  RNA Oligomer
uuguuguguucugagucagcu

SEQ ID NO: 20532 - RNA, 21 nt, Artificial Sequence
  RNA Oligomer
auucugauaucguuucaggac

SEQ ID NO: 20533 - RNA, 21 nt, Artificial Sequence
  RNA Oligomer
uguuguguucugagucagcug

SEQ ID NO: 20534 - RNA, 21 nt, Artificial Sequence
  RNA Oligomer
uucucaaagcuauauccagca

SEQ ID NO: 20535 - RNA, 21 nt, Artificial Sequence
  RNA Oligomer
auaucguuucaggacugugaa

SEQ ID NO: 20536 - RNA, 21 nt, Artificial Sequence
  RNA Oligomer
agcgagucacuacauaaggcg

SEQ ID NO: 20537 - RNA, 21 nt, Artificial Sequence
  RNA Oligomer
aaacucguuccugcaguccug

SEQ ID NO: 20538 - RNA, 21 nt, Artificial Sequence
  RNA Oligomer
uauauuacugggcuuuaaguc

SEQ ID NO: 20539 - RNA, 21 nt, Artificial Sequence
  RNA Oligomer
aauaauuccagcagaaugaag

SEQ ID NO: 20540 - RNA, 21 nt, Artificial Sequence
  RNA Oligomer
ugcauccaugagcuccaugac

SEQ ID NO: 20541 - RNA, 21 nt, Artificial Sequence
  RNA Oligomer
ucuagacugcugucuguauca

SEQ ID NO: 20542 - RNA, 21 nt, Artificial Sequence
  RNA Oligomer
cuguaucagaggccaaagucg

SEQ ID NO: 20543 - RNA, 21 nt, Artificial Sequence
  RNA Oligomer
ugcgcauacuauuccuugagc

SEQ ID NO: 20544 - RNA, 21 nt, Artificial Sequence
  RNA Oligomer
augcugagagccauugaucac

SEQ ID NO: 20545 - RNA, 21 nt, Artificial Sequence
  RNA Oligomer
uuccacucuucuauugugugu

SEQ ID NO: 20546 - RNA, 21 nt, Artificial Sequence
  RNA Oligomer
cuugucagggaucuuuggugg

SEQ ID NO: 20547 - RNA, 21 nt, Artificial Sequence
  RNA Oligomer
cuucugcucaugauggcaagc

SEQ ID NO: 20548 - RNA, 21 nt, Artificial Sequence
  RNA Oligomer
guuguguucugagucagcugg

SEQ ID NO: 20549 - RNA, 21 nt, Artificial Sequence
  RNA Oligomer
cugauaucguuucaggacugu

SEQ ID NO: 20550 - RNA, 21 nt, Artificial Sequence
  RNA Oligomer
uuucucaaagcuauauccagc

SEQ ID NO: 20551 - RNA, 21 nt, Artificial Sequence
  RNA Oligomer
agcuauauccagcauauuuag

SEQ ID NO: 20552 - RNA, 21 nt, Artificial Sequence
  RNA Oligomer
uuuucaacguaaguccuuacu

SEQ ID NO: 20553 - RNA, 21 nt, Artificial Sequence
  RNA Oligomer
aacguaaguccuuacuguugg

SEQ ID NO: 20554 - RNA, 21 nt, Artificial Sequence
  RNA Oligomer
guaaguccuuacuguugguug

SEQ ID NO: 20555 - RNA, 21 nt, Artificial Sequence
  RNA Oligomer
uacuguugguugcaguuucuu

SEQ ID NO: 20556 - RNA, 21 nt, Artificial Sequence
  RNA Oligomer
auaaaacucguuccugcaguc

SEQ ID NO: 20557 - RNA, 21 nt, Artificial Sequence
  RNA Oligomer
ugaaggugcuugauuccacac

SEQ ID NO: 20558 - RNA, 21 nt, Artificial Sequence
  RNA Oligomer
aggugcuugauuccacacagc

SEQ ID NO: 20559 - RNA, 21 nt, Artificial Sequence
  RNA Oligomer
ucugaaauggucggcuuagcu

SEQ ID NO: 20560 - RNA, 21 nt, Artificial Sequence
  RNA Oligomer
aacauuucuuucaagaauggc

SEQ ID NO: 20561 - RNA, 21 nt, Artificial Sequence
  RNA Oligomer
cuugcuucugcucaugauggc

SEQ ID NO: 20562 - RNA, 21 nt, Artificial Sequence
  RNA Oligomer
ucuguaucagaggccaaaguc

SEQ ID NO: 20563 - RNA, 21 nt, Artificial Sequence
  RNA Oligomer
acauugaagacacaucauuga

SEQ ID NO: 20564 - RNA, 21 nt, Artificial Sequence
  RNA Oligomer
cagacauugauguacgggugu

SEQ ID NO: 20565 - RNA, 21 nt, Artificial Sequence
  RNA Oligomer
auugauguacggguguuggag

SEQ ID NO: 20566 - RNA, 21 nt, Artificial Sequence
  RNA Oligomer
gagauccuuuuagaugcaucu

SEQ ID NO: 20567 - RNA, 21 nt, Artificial Sequence
  RNA Oligomer
aaaucccuugccugacuggcu

SEQ ID NO: 20568 - RNA, 21 nt, Artificial Sequence
  RNA Oligomer
ucugauaucguuucaggacug

SEQ ID NO: 20569 - RNA, 21 nt, Artificial Sequence
  RNA Oligomer
uuguagcccaugccaaggaug

SEQ ID NO: 20570 - RNA, 21 nt, Artificial Sequence
  RNA Oligomer
gagucacuacauaaggcguca

SEQ ID NO: 20571 - RNA, 21 nt, Artificial Sequence
  RNA Oligomer
aauuccagcagaaugaaggug

SEQ ID NO: 20572 - RNA, 21 nt, Artificial Sequence
  RNA Oligomer
caucugauagagaagguagga

SEQ ID NO: 20573 - RNA, 21 nt, Artificial Sequence
  RNA Oligomer
cuccaucugaaucacuuggca

SEQ ID NO: 20574 - RNA, 21 nt, Artificial Sequence
  RNA Oligomer
uguugucacgcuugcuucugc

SEQ ID NO: 20575 - RNA, 21 nt, Artificial Sequence
  RNA Oligomer
gugaaaacauucaaaaggcca

SEQ ID NO: 20576 - RNA, 21 nt, Artificial Sequence
  RNA Oligomer
cugauucugaaauggucggcu

SEQ ID NO: 20577 - RNA, 21 nt, Artificial Sequence
  RNA Oligomer
uugcuucugcucaugauggca

SEQ ID NO: 20578 - RNA, 21 nt, Artificial Sequence
  RNA Oligomer
ugaugauggaugcugagagcc

SEQ ID NO: 20579 - RNA, 21 nt, Artificial Sequence
  RNA Oligomer
ccauucuugguucucuccucc

SEQ ID NO: 20580 - RNA, 21 nt, Artificial Sequence
  RNA Oligomer
uucaucuaacugcuugucagg

SEQ ID NO: 20581 - RNA, 21 nt, Artificial Sequence
  RNA Oligomer
uugucagggaucuuugguggu

SEQ ID NO: 20582 - RNA, 21 nt, Artificial Sequence
  RNA Oligomer
caucuauuaccagcauuuugg

SEQ ID NO: 20583 - RNA, 21 nt, Artificial Sequence
  RNA Oligomer
augguguuccaagcuguucaa

SEQ ID NO: 20584 - RNA, 21 nt, Artificial Sequence
  RNA Oligomer
guagcgagucacuacauaagg

SEQ ID NO: 20585 - RNA, 21 nt, Artificial Sequence
  RNA Oligomer
aucugauagagaagguaggac

SEQ ID NO: 20586 - RNA, 21 nt, Artificial Sequence
  RNA Oligomer
guugucacgcuugcuucugcu

SEQ ID NO: 20587 - RNA, 21 nt, Artificial Sequence
  RNA Oligomer
gucugauucugaaauggucgg

SEQ ID NO: 20588 - RNA, 21 nt, Artificial Sequence
  RNA Oligomer
uagacugcugucuguaucaga

SEQ ID NO: 20589 - RNA, 21 nt, Artificial Sequence
  RNA Oligomer
gacugcugucuguaucagagg

SEQ ID NO: 20590 - RNA, 21 nt, Artificial Sequence
  RNA Oligomer
gacauugauguacggguguug

SEQ ID NO: 20591 - RNA, 21 nt, Artificial Sequence
  RNA Oligomer
uggauaacaaaucccuugccu

SEQ ID NO: 20592 - RNA, 21 nt, Artificial Sequence
  RNA Oligomer
agggaagaguuucucaaagcu

SEQ ID NO: 20593 - RNA, 21 nt, Artificial Sequence
  RNA Oligomer
augaaggugcuugauuccaca

SEQ ID NO: 20594 - RNA, 21 nt, Artificial Sequence
  RNA Oligomer
uuugcauccaugagcuccaug

SEQ ID NO: 20595 - RNA, 21 nt, Artificial Sequence
  RNA Oligomer
uuucuuucaagaauggcauca

SEQ ID NO: 20596 - RNA, 21 nt, Artificial Sequence
  RNA Oligomer
agaauggcaucauaagcugcg

SEQ ID NO: 20597 - RNA, 21 nt, Artificial Sequence
  RNA Oligomer
uuggugguggagcuucugcuu

SEQ ID NO: 20598 - RNA, 21 nt, Artificial Sequence
  RNA Oligomer
gaagucaagaaucuucaaagu

SEQ ID NO: 20599 - RNA, 21 nt, Artificial Sequence
  RNA Oligomer
acagcaucugauagagaaggu

SEQ ID NO: 20600 - RNA, 21 nt, Artificial Sequence
  RNA Oligomer
acugcugucuguaucagaggc

SEQ ID NO: 20601 - RNA, 21 nt, Artificial Sequence
  RNA Oligomer
ucugcuucagaaggaucauac

SEQ ID NO: 20602 - RNA, 21 nt, Artificial Sequence
  RNA Oligomer
gaccgaagucaagaaucuuca

SEQ ID NO: 20603 - RNA, 21 nt, Artificial Sequence
  RNA Oligomer
agcuccaucugaaucacuugg

SEQ ID NO: 20604 - RNA, 21 nt, Artificial Sequence
  RNA Oligomer
gcuccaucugaaucacuuggc

SEQ ID NO: 20605 - RNA, 21 nt, Artificial Sequence
  RNA Oligomer
uuggcaaagauuugcauccau

SEQ ID NO: 20606 - RNA, 21 nt, Artificial Sequence
  RNA Oligomer
gugugaaaacauucaaaaggc

SEQ ID NO: 20607 - RNA, 21 nt, Artificial Sequence
  RNA Oligomer
uucuuucaagaauggcaucau

SEQ ID NO: 20608 - RNA, 21 nt, Artificial Sequence
  RNA Oligomer
cugcuugucagggaucuuugg

SEQ ID NO: 20609 - RNA, 21 nt, Artificial Sequence
  RNA Oligomer
ucuuuggugguggagcuucug

SEQ ID NO: 20610 - RNA, 21 nt, Artificial Sequence
  RNA Oligomer
uaggacauucuuucaugaucu

SEQ ID NO: 20611 - RNA, 21 nt, Artificial Sequence
  RNA Oligomer
auuucuuucaagaauggcauc

SEQ ID NO: 20612 - RNA, 21 nt, Artificial Sequence
  RNA Oligomer
ucaucuaacugcuugucaggg

SEQ ID NO: 20613 - RNA, 21 nt, Artificial Sequence
  RNA Oligomer
acugcuugucagggaucuuug

SEQ ID NO: 20614 - RNA, 21 nt, Artificial Sequence
  RNA Oligomer
aucuuuggugguggagcuucu

SEQ ID NO: 20615 - RNA, 21 nt, Artificial Sequence
  RNA Oligomer
agcugggaaaaggacaucagg

SEQ ID NO: 20616 - RNA, 21 nt, Artificial Sequence
  RNA Oligomer
auagagaagguaggacauucu

SEQ ID NO: 20617 - RNA, 21 nt, Artificial Sequence
  RNA Oligomer
aaagauuugcauccaugagcu

SEQ ID NO: 20618 - RNA, 21 nt, Artificial Sequence
  RNA Oligomer
agaacuagcucucuguaggcc

SEQ ID NO: 20619 - RNA, 21 nt, Artificial Sequence
  RNA Oligomer
acaucagggaagaguuucuca

SEQ ID NO: 20620 - RNA, 21 nt, Artificial Sequence
  RNA Oligomer
cagcugggaaaaggacaucag

SEQ ID NO: 20621 - RNA, 21 nt, Artificial Sequence
  RNA Oligomer
uuccagcagaaugaaggugcu

SEQ ID NO: 20622 - RNA, 21 nt, Artificial Sequence
  RNA Oligomer
uggugugaaaacauucaaaag

SEQ ID NO: 20623 - RNA, 21 nt, Artificial Sequence
  RNA Oligomer
aagaacuagcucucuguaggc

SEQ ID NO: 20624 - RNA, 21 nt, Artificial Sequence
  RNA Oligomer
caacauuucuuucaagaaugg

SEQ ID NO: 20625 - RNA, 21 nt, Artificial Sequence
  RNA Oligomer
guuggagagcuucaucuacag

SEQ ID NO: 20626 - RNA, 21 nt, Artificial Sequence
  RNA Oligomer
uagagaagguaggacauucuu

SEQ ID NO: 20627 - RNA, 21 nt, Artificial Sequence
  RNA Oligomer
aucauaccagacauugaugua

SEQ ID NO: 20628 - RNA, 21 nt, Artificial Sequence
  RNA Oligomer
guguuggagagcuucaucuac

SEQ ID NO: 20629 - RNA, 21 nt, Artificial Sequence
  RNA Oligomer
gacaucagggaagaguuucuc

SEQ ID NO: 20630 - RNA, 21 nt, Artificial Sequence
  RNA Oligomer
uugauuccacacagcaucuga

SEQ ID NO: 20631 - RNA, 21 nt, Artificial Sequence
  RNA Oligomer
uugguucucuccuccaagucc

SEQ ID NO: 20632 - RNA, 21 nt, Artificial Sequence
  RNA Oligomer
aucagaggccaaagucggauc

SEQ ID NO: 20633 - RNA, 21 nt, Artificial Sequence
  RNA Oligomer
ucagaggccaaagucggaucu

SEQ ID NO: 20634 - RNA, 21 nt, Artificial Sequence
  RNA Oligomer
uucuugguucucuccuccaag

SEQ ID NO: 20635 - RNA, 21 nt, Artificial Sequence
  RNA Oligomer
auuccacacagcaucugauag

SEQ ID NO: 20636 - RNA, 21 nt, Artificial Sequence
  RNA Oligomer
caagaauggcaucauaagcug

SEQ ID NO: 20637 - RNA, 21 nt, Artificial Sequence
  RNA Oligomer
cagcagaaugaaggugcuuga

SEQ ID NO: 20638 - RNA, 21 nt, Artificial Sequence
  RNA Oligomer
uuaggucuguuuucaacguaa

SEQ ID NO: 20639 - RNA, 21 nt, Artificial Sequence
  RNA Oligomer
ggaggaauucaaugaugugua

SEQ ID NO: 20640 - RNA, 21 nt, Artificial Sequence
  RNA Oligomer
ccaucauucaugcgaaaagaa

SEQ ID NO: 20641 - RNA, 21 nt, Artificial Sequence
  RNA Oligomer
gaggaauucaaugauguguau

SEQ ID NO: 20642 - RNA, 21 nt, Artificial Sequence
  RNA Oligomer
gaccuaaaaccuaguaaucua

SEQ ID NO: 20643 - RNA, 21 nt, Artificial Sequence
  RNA Oligomer
ggaccuaaaaccuaguaaucu

SEQ ID NO: 20644 - RNA, 21 nt, Artificial Sequence
  RNA Oligomer
ccauuucaguccaucauucau

SEQ ID NO: 20645 - RNA, 21 nt, Artificial Sequence
  RNA Oligomer
agcuguugacuggaagaacau

SEQ ID NO: 20646 - RNA, 21 nt, Artificial Sequence
  RNA Oligomer
cgaggucuaaaguauauacau

SEQ ID NO: 20647 - RNA, 21 nt, Artificial Sequence
  RNA Oligomer
caguuccuuaucuaccaaauu

SEQ ID NO: 20648 - RNA, 21 nt, Artificial Sequence
  RNA Oligomer
gcugaacuggaugcauuacaa

SEQ ID NO: 20649 - RNA, 21 nt, Artificial Sequence
  RNA Oligomer
gagcugaagauucuggauuuu

SEQ ID NO: 20650 - RNA, 21 nt, Artificial Sequence
  RNA Oligomer
ugagcugaagauucuggauuu

SEQ ID NO: 20651 - RNA, 21 nt, Artificial Sequence
  RNA Oligomer
gaagacugugagcugaagauu

SEQ ID NO: 20652 - RNA, 21 nt, Artificial Sequence
  RNA Oligomer
ucaguuccuuaucuaccaaau

SEQ ID NO: 20653 - RNA, 21 nt, Artificial Sequence
  RNA Oligomer
gcagaucugaacaacauugug

SEQ ID NO: 20654 - RNA, 21 nt, Artificial Sequence
  RNA Oligomer
ggcagaucugaacaacauugu

SEQ ID NO: 20655 - RNA, 21 nt, Artificial Sequence
  RNA Oligomer
gcgguuacuuaaacauaugaa

SEQ ID NO: 20656 - RNA, 21 nt, Artificial Sequence
  RNA Oligomer
accauuucaguccaucauuca

SEQ ID NO: 20657 - RNA, 21 nt, Artificial Sequence
  RNA Oligomer
ccaaauucuccgaggucuaaa

SEQ ID NO: 20658 - RNA, 21 nt, Artificial Sequence
  RNA Oligomer
ccauguucaguuccuuaucua

SEQ ID NO: 20659 - RNA, 21 nt, Artificial Sequence
  RNA Oligomer
agaucugaacaacauugugaa

SEQ ID NO: 20660 - RNA, 21 nt, Artificial Sequence
  RNA Oligomer
aggaauucaaugauguguauc

SEQ ID NO: 20661 - RNA, 21 nt, Artificial Sequence
  RNA Oligomer
gcaaggucucuggaggaauuc

SEQ ID NO: 20662 - RNA, 21 nt, Artificial Sequence
  RNA Oligomer
gcgaaaagaaccuacagagaa

SEQ ID NO: 20663 - RNA, 21 nt, Artificial Sequence
  RNA Oligomer
gaagaacauuguuuccuggua

SEQ ID NO: 20664 - RNA, 21 nt, Artificial Sequence
  RNA Oligomer
cgagcuguugacuggaagaac

SEQ ID NO: 20665 - RNA, 21 nt, Artificial Sequence
  RNA Oligomer
cggcacacagaugaugaaaug

SEQ ID NO: 20666 - RNA, 21 nt, Artificial Sequence
  RNA Oligomer
aggucucuggaggaauucaau

SEQ ID NO: 20667 - RNA, 21 nt, Artificial Sequence
  RNA Oligomer
gaacugcgguuacuuaaacau

SEQ ID NO: 20668 - RNA, 21 nt, Artificial Sequence
  RNA Oligomer
cgaaaagaaccuacagagaac

SEQ ID NO: 20669 - RNA, 21 nt, Artificial Sequence
  RNA Oligomer
uccaucauucaugcgaaaaga

SEQ ID NO: 20670 - RNA, 21 nt, Artificial Sequence
  RNA Oligomer
agaacauuguuuccugguaca

SEQ ID NO: 20671 - RNA, 21 nt, Artificial Sequence
  RNA Oligomer
ugacuggaagaacauuguuuc

SEQ ID NO: 20672 - RNA, 21 nt, Artificial Sequence
  RNA Oligomer
agaugaugaaaugacaggcua

SEQ ID NO: 20673 - RNA, 21 nt, Artificial Sequence
  RNA Oligomer
gaaugaagacugugagcugaa

SEQ ID NO: 20674 - RNA, 21 nt, Artificial Sequence
  RNA Oligomer
guuccuuaucuaccaaauucu

SEQ ID NO: 20675 - RNA, 21 nt, Artificial Sequence
  RNA Oligomer
gaucugaacaacauugugaaa

SEQ ID NO: 20676 - RNA, 21 nt, Artificial Sequence
  RNA Oligomer
cugcaaggucucuggaggaau

SEQ ID NO: 20677 - RNA, 21 nt, Artificial Sequence
  RNA Oligomer
ggagcugaacaagacaaucug

SEQ ID NO: 20678 - RNA, 21 nt, Artificial Sequence
  RNA Oligomer
ugaaaaugugauuggucuguu

SEQ ID NO: 20679 - RNA, 21 nt, Artificial Sequence
  RNA Oligomer
agaacugcgguuacuuaaaca

SEQ ID NO: 20680 - RNA, 21 nt, Artificial Sequence
  RNA Oligomer
guugacuggaagaacauuguu

SEQ ID NO: 20681 - RNA, 21 nt, Artificial Sequence
  RNA Oligomer
gcuguugacuggaagaacauu

SEQ ID NO: 20682 - RNA, 21 nt, Artificial Sequence
  RNA Oligomer
ggcacacagaugaugaaauga

SEQ ID NO: 20683 - RNA, 21 nt, Artificial Sequence
  RNA Oligomer
ccgaggucuaaaguauauaca

SEQ ID NO: 20684 - RNA, 21 nt, Artificial Sequence
  RNA Oligomer
cuccgaggucuaaaguauaua

SEQ ID NO: 20685 - RNA, 21 nt, Artificial Sequence
  RNA Oligomer
ucugaacaacauugugaaaug

SEQ ID NO: 20686 - RNA, 21 nt, Artificial Sequence
  RNA Oligomer
guaucuggugacccaucucau

SEQ ID NO: 20687 - RNA, 21 nt, Artificial Sequence
  RNA Oligomer
cuggaggaauucaaugaugug

SEQ ID NO: 20688 - RNA, 21 nt, Artificial Sequence
  RNA Oligomer
agagaacugcgguuacuuaaa

SEQ ID NO: 20689 - RNA, 21 nt, Artificial Sequence
  RNA Oligomer
gaacauuguuuccugguacag

SEQ ID NO: 20690 - RNA, 21 nt, Artificial Sequence
  RNA Oligomer
ugagaucaugcugaacuggau

SEQ ID NO: 20691 - RNA, 21 nt, Artificial Sequence
  RNA Oligomer
acacagaugaugaaaugacag

SEQ ID NO: 20692 - RNA, 21 nt, Artificial Sequence
  RNA Oligomer
cacacagaugaugaaaugaca

SEQ ID NO: 20693 - RNA, 21 nt, Artificial Sequence
  RNA Oligomer
cugaagauucuggauuuugga

SEQ ID NO: 20694 - RNA, 21 nt, Artificial Sequence
  RNA Oligomer
gacugugagcugaagauucug

SEQ ID NO: 20695 - RNA, 21 nt, Artificial Sequence
  RNA Oligomer
agacugugagcugaagauucu

SEQ ID NO: 20696 - RNA, 21 nt, Artificial Sequence
  RNA Oligomer
ugaagacugugagcugaagau

SEQ ID NO: 20697 - RNA, 21 nt, Artificial Sequence
  RNA Oligomer
guaaucuagcugugaaugaag

SEQ ID NO: 20698 - RNA, 21 nt, Artificial Sequence
  RNA Oligomer
gggcagaucugaacaacauug

SEQ ID NO: 20699 - RNA, 21 nt, Artificial Sequence
  RNA Oligomer
gaaaaugugauuggucuguug

SEQ ID NO: 20700 - RNA, 21 nt, Artificial Sequence
  RNA Oligomer
ugcgaaaagaaccuacagaga

SEQ ID NO: 20701 - RNA, 21 nt, Artificial Sequence
  RNA Oligomer
cugaacuggaugcauuacaac

SEQ ID NO: 20702 - RNA, 21 nt, Artificial Sequence
  RNA Oligomer
ugaugaaaugacaggcuacgu

SEQ ID NO: 20703 - RNA, 21 nt, Artificial Sequence
  RNA Oligomer
gcacacagaugaugaaaugac

SEQ ID NO: 20704 - RNA, 21 nt, Artificial Sequence
  RNA Oligomer
cucggcacacagaugaugaaa

SEQ ID NO: 20705 - RNA, 21 nt, Artificial Sequence
  RNA Oligomer
agcugaagauucuggauuuug

SEQ ID NO: 20706 - RNA, 21 nt, Artificial Sequence
  RNA Oligomer
gcugacauaauucacagggac

SEQ ID NO: 20707 - RNA, 21 nt, Artificial Sequence
  RNA Oligomer
ucagaagcuuacagaugacca

SEQ ID NO: 20708 - RNA, 21 nt, Artificial Sequence
  RNA Oligomer
uugugaaaugucagaagcuua

SEQ ID NO: 20709 - RNA, 21 nt, Artificial Sequence
  RNA Oligomer
ugcaaggucucuggaggaauu

SEQ ID NO: 20710 - RNA, 21 nt, Artificial Sequence
  RNA Oligomer
cugcgguuacuuaaacauaug

SEQ ID NO: 20711 - RNA, 21 nt, Artificial Sequence
  RNA Oligomer
uccugagaucaugcugaacug

SEQ ID NO: 20712 - RNA, 21 nt, Artificial Sequence
  RNA Oligomer
cagaugaugaaaugacaggcu

SEQ ID NO: 20713 - RNA, 21 nt, Artificial Sequence
  RNA Oligomer
ugugagcugaagauucuggau

SEQ ID NO: 20714 - RNA, 21 nt, Artificial Sequence
  RNA Oligomer
gcugugaaugaagacugugag

SEQ ID NO: 20715 - RNA, 21 nt, Artificial Sequence
  RNA Oligomer
aagcuuacagaugaccauguu

SEQ ID NO: 20716 - RNA, 21 nt, Artificial Sequence
  RNA Oligomer
gaaaugucagaagcuuacaga

SEQ ID NO: 20717 - RNA, 21 nt, Artificial Sequence
  RNA Oligomer
gugaaaugucagaagcuuaca

SEQ ID NO: 20718 - RNA, 21 nt, Artificial Sequence
  RNA Oligomer
cucuggaggaauucaaugaug

SEQ ID NO: 20719 - RNA, 21 nt, Artificial Sequence
  RNA Oligomer
ucucuggaggaauucaaugau

SEQ ID NO: 20720 - RNA, 21 nt, Artificial Sequence
  RNA Oligomer
ugcgguuacuuaaacauauga

SEQ ID NO: 20721 - RNA, 21 nt, Artificial Sequence
  RNA Oligomer
gcauaauggccgagcuguuga

SEQ ID NO: 20722 - RNA, 21 nt, Artificial Sequence
  RNA Oligomer
gagaucaugcugaacuggaug

SEQ ID NO: 20723 - RNA, 21 nt, Artificial Sequence
  RNA Oligomer
gugaaugaagacugugagcug

SEQ ID NO: 20724 - RNA, 21 nt, Artificial Sequence
  RNA Oligomer
cuagcugugaaugaagacugu

SEQ ID NO: 20725 - RNA, 21 nt, Artificial Sequence
  RNA Oligomer
aguauauacauucagcugaca

SEQ ID NO: 20726 - RNA, 21 nt, Artificial Sequence
  RNA Oligomer
uccgaggucuaaaguauauac

SEQ ID NO: 20727 - RNA, 21 nt, Artificial Sequence
  RNA Oligomer
cagaagcuuacagaugaccau

SEQ ID NO: 20728 - RNA, 21 nt, Artificial Sequence
  RNA Oligomer
aaaugucagaagcuuacagau

SEQ ID NO: 20729 - RNA, 21 nt, Artificial Sequence
  RNA Oligomer
gaacaagacaaucugggaggu

SEQ ID NO: 20730 - RNA, 21 nt, Artificial Sequence
  RNA Oligomer
gcugaacaagacaaucuggga

SEQ ID NO: 20731 - RNA, 21 nt, Artificial Sequence
  RNA Oligomer
ucggcacacagaugaugaaau

SEQ ID NO: 20732 - RNA, 21 nt, Artificial Sequence
  RNA Oligomer
gcucggcacacagaugaugaa

SEQ ID NO: 20733 - RNA, 21 nt, Artificial Sequence
  RNA Oligomer
agcugacauaauucacaggga

SEQ ID NO: 20734 - RNA, 21 nt, Artificial Sequence
  RNA Oligomer
uucuccgaggucuaaaguaua

SEQ ID NO: 20735 - RNA, 21 nt, Artificial Sequence
  RNA Oligomer
gaccauguucaguuccuuauc

SEQ ID NO: 20736 - RNA, 21 nt, Artificial Sequence
  RNA Oligomer
ugaccauguucaguuccuuau

SEQ ID NO: 20737 - RNA, 21 nt, Artificial Sequence
  RNA Oligomer
gaugaccauguucaguuccuu

SEQ ID NO: 20738 - RNA, 21 nt, Artificial Sequence
  RNA Oligomer
acagaugaccauguucaguuc

SEQ ID NO: 20739 - RNA, 21 nt, Artificial Sequence
  RNA Oligomer
agcuuacagaugaccauguuc

SEQ ID NO: 20740 - RNA, 21 nt, Artificial Sequence
  RNA Oligomer
agaagcuuacagaugaccaug

SEQ ID NO: 20741 - RNA, 21 nt, Artificial Sequence
  RNA Oligomer
ugauauuuggucagugggaug

SEQ ID NO: 20742 - RNA, 21 nt, Artificial Sequence
  RNA Oligomer
acaguugauauuuggucagug

SEQ ID NO: 20743 - RNA, 21 nt, Artificial Sequence
  RNA Oligomer
gcucugugugugcugcuuuug

SEQ ID NO: 20744 - RNA, 21 nt, Artificial Sequence
  RNA Oligomer
gcaggagcugaacaagacaau

SEQ ID NO: 20745 - RNA, 21 nt, Artificial Sequence
  RNA Oligomer
augaccauguucaguuccuua

SEQ ID NO: 20746 - RNA, 21 nt, Artificial Sequence
  RNA Oligomer
caugaaaaugugauuggucug

SEQ ID NO: 20747 - RNA, 21 nt, Artificial Sequence
  RNA Oligomer
gacaguugauauuuggucagu

SEQ ID NO: 20748 - RNA, 21 nt, Artificial Sequence
  RNA Oligomer
agacaguugauauuuggucag

SEQ ID NO: 20749 - RNA, 21 nt, Artificial Sequence
  RNA Oligomer
cugugugugcugcuuuugaca

SEQ ID NO: 20750 - RNA, 21 nt, Artificial Sequence
  RNA Oligomer
agggaccuaaaaccuaguaau

SEQ ID NO: 20751 - RNA, 21 nt, Artificial Sequence
  RNA Oligomer
ccagaccauuucaguccauca

SEQ ID NO: 20752 - RNA, 21 nt, Artificial Sequence
  RNA Oligomer
ggaagaacauuguuuccuggu

SEQ ID NO: 20753 - RNA, 21 nt, Artificial Sequence
  RNA Oligomer
cagacaguugauauuugguca

SEQ ID NO: 20754 - RNA, 21 nt, Artificial Sequence
  RNA Oligomer
caguugauauuuggucagugg

SEQ ID NO: 20755 - RNA, 21 nt, Artificial Sequence
  RNA Oligomer
caguccaucauucaugcgaaa

SEQ ID NO: 20756 - RNA, 21 nt, Artificial Sequence
  RNA Oligomer
gaauucaaugauguguaucug

SEQ ID NO: 20757 - RNA, 21 nt, Artificial Sequence
  RNA Oligomer
gauuggucuguuggacguuuu

SEQ ID NO: 20758 - RNA, 21 nt, Artificial Sequence
  RNA Oligomer
gggaccuaaaaccuaguaauc

SEQ ID NO: 20759 - RNA, 21 nt, Artificial Sequence
  RNA Oligomer
gaaaagaaccuacagagaacu

SEQ ID NO: 20760 - RNA, 21 nt, Artificial Sequence
  RNA Oligomer
cuccagaccauuucaguccau

SEQ ID NO: 20761 - RNA, 21 nt, Artificial Sequence
  RNA Oligomer
uggcucugugugugcugcuuu

SEQ ID NO: 20762 - RNA, 21 nt, Artificial Sequence
  RNA Oligomer
aguccaucauucaugcgaaaa

SEQ ID NO: 20763 - RNA, 21 nt, Artificial Sequence
  RNA Oligomer
ggcucugugugugcugcuuuu

SEQ ID NO: 20764 - RNA, 21 nt, Artificial Sequence
  RNA Oligomer
cauaauucacagggaccuaaa

SEQ ID NO: 20765 - RNA, 21 nt, Artificial Sequence
  RNA Oligomer
agaccauuucaguccaucauu

SEQ ID NO: 20766 - RNA, 21 nt, Artificial Sequence
  RNA Oligomer
cuggaagaacauuguuuccug

SEQ ID NO: 20767 - RNA, 21 nt, Artificial Sequence
  RNA Oligomer
cagggaccuaaaaccuaguaa

SEQ ID NO: 20768 - RNA, 21 nt, Artificial Sequence
  RNA Oligomer
caaugauguguaucuggugac

SEQ ID NO: 20769 - RNA, 21 nt, Artificial Sequence
  RNA Oligomer
ggaauucaaugauguguaucu

SEQ ID NO: 20770 - RNA, 21 nt, Artificial Sequence
  RNA Oligomer
ucaguccaucauucaugcgaa

SEQ ID NO: 20771 - RNA, 21 nt, Artificial Sequence
  RNA Oligomer
acagggaccuaaaaccuagua

SEQ ID NO: 20772 - RNA, 21 nt, Artificial Sequence
  RNA Oligomer
uccagaccauuucaguccauc

SEQ ID NO: 20773 - RNA, 21 nt, Artificial Sequence
  RNA Oligomer
accuaaaaccuaguaaucuag

SEQ ID NO: 20774 - RNA, 21 nt, Artificial Sequence
  RNA Oligomer
guauauacauucagcugacau

SEQ ID NO: 20775 - RNA, 21 nt, Artificial Sequence
  RNA Oligomer
ggcuccugagaucaugcugaa

SEQ ID NO: 20776 - RNA, 21 nt, Artificial Sequence
  RNA Oligomer
gacauaauucacagggaccua

SEQ ID NO: 20777 - RNA, 21 nt, Artificial Sequence
  RNA Oligomer
gugcugcuuuugacacaaaaa

SEQ ID NO: 20778 - RNA, 21 nt, Artificial Sequence
  RNA Oligomer
cauuacaaccagacaguugau

SEQ ID NO: 20779 - RNA, 21 nt, Artificial Sequence
  RNA Oligomer
caacauugugaaaugucagaa

SEQ ID NO: 20780 - RNA, 21 nt, Artificial Sequence
  RNA Oligomer
ugaacaacauugugaaauguc

SEQ ID NO: 20781 - RNA, 21 nt, Artificial Sequence
  RNA Oligomer
cugaacaacauugugaaaugu

SEQ ID NO: 20782 - RNA, 21 nt, Artificial Sequence
  RNA Oligomer
uuacaaccagacaguugauau

SEQ ID NO: 20783 - RNA, 21 nt, Artificial Sequence
  RNA Oligomer
ccuaguaaucuagcugugaau

SEQ ID NO: 20784 - RNA, 21 nt, Artificial Sequence
  RNA Oligomer
accuaguaaucuagcugugaa

SEQ ID NO: 20785 - RNA, 21 nt, Artificial Sequence
  RNA Oligomer
uaccaaauucuccgaggucua

SEQ ID NO: 20786 - RNA, 21 nt, Artificial Sequence
  RNA Oligomer
gagcguuaccagaaccugucu

SEQ ID NO: 20787 - RNA, 21 nt, Artificial Sequence
  RNA Oligomer
ccgcuggaaaaugucucagga

SEQ ID NO: 20788 - RNA, 21 nt, Artificial Sequence
  RNA Oligomer
gugauuggucuguuggacguu

SEQ ID NO: 20789 - RNA, 21 nt, Artificial Sequence
  RNA Oligomer
cagaccauuucaguccaucau

SEQ ID NO: 20790 - RNA, 21 nt, Artificial Sequence
  RNA Oligomer
gcagugaagaagcucuccaga

SEQ ID NO: 20791 - RNA, 21 nt, Artificial Sequence
  RNA Oligomer
caugcugaacuggaugcauua

SEQ ID NO: 20792 - RNA, 21 nt, Artificial Sequence
  RNA Oligomer
guacagggcuccugagaucau

SEQ ID NO: 20793 - RNA, 21 nt, Artificial Sequence
  RNA Oligomer
cacagggaccuaaaaccuagu

SEQ ID NO: 20794 - RNA, 21 nt, Artificial Sequence
  RNA Oligomer
ggacguuuuuacaccugcaag

SEQ ID NO: 20795 - RNA, 21 nt, Artificial Sequence
  RNA Oligomer
gaagcucuccagaccauuuca

SEQ ID NO: 20796 - RNA, 21 nt, Artificial Sequence
  RNA Oligomer
ccgagcuguugacuggaagaa

SEQ ID NO: 20797 - RNA, 21 nt, Artificial Sequence
  RNA Oligomer
gugugcugcuuuugacacaaa

SEQ ID NO: 20798 - RNA, 21 nt, Artificial Sequence
  RNA Oligomer
acauaauucacagggaccuaa

SEQ ID NO: 20799 - RNA, 21 nt, Artificial Sequence
  RNA Oligomer
accaaauucuccgaggucuaa

SEQ ID NO: 20800 - RNA, 21 nt, Artificial Sequence
  RNA Oligomer
guguaucuggugacccaucuc

SEQ ID NO: 20801 - RNA, 21 nt, Artificial Sequence
  RNA Oligomer
uggacguuuuuacaccugcaa

SEQ ID NO: 20802 - RNA, 21 nt, Artificial Sequence
  RNA Oligomer
accuacagagaacugcgguua

SEQ ID NO: 20803 - RNA, 21 nt, Artificial Sequence
  RNA Oligomer
guuuccugguacagaccauau

SEQ ID NO: 20804 - RNA, 21 nt, Artificial Sequence
  RNA Oligomer
ugugcugcuuuugacacaaaa

SEQ ID NO: 20805 - RNA, 21 nt, Artificial Sequence
  RNA Oligomer
gcauuacaaccagacaguuga

SEQ ID NO: 20806 - RNA, 21 nt, Artificial Sequence
  RNA Oligomer
guucaguuccuuaucuaccaa

SEQ ID NO: 20807 - RNA, 21 nt, Artificial Sequence
  RNA Oligomer
gaacaacauugugaaauguca

SEQ ID NO: 20808 - RNA, 21 nt, Artificial Sequence
  RNA Oligomer
acagagaacugcgguuacuua

SEQ ID NO: 20809 - RNA, 21 nt, Artificial Sequence
  RNA Oligomer
gaagaagcucuccagaccauu

SEQ ID NO: 20810 - RNA, 21 nt, Artificial Sequence
  RNA Oligomer
acaaccagacaguugauauuu

SEQ ID NO: 20811 - RNA, 21 nt, Artificial Sequence
  RNA Oligomer
ggaugcauuacaaccagacag

SEQ ID NO: 20812 - RNA, 21 nt, Artificial Sequence
  RNA Oligomer
uggaugcauuacaaccagaca

SEQ ID NO: 20813 - RNA, 21 nt, Artificial Sequence
  RNA Oligomer
cuggaugcauuacaaccagac

SEQ ID NO: 20814 - RNA, 21 nt, Artificial Sequence
  RNA Oligomer
ucaugcugaacuggaugcauu

SEQ ID NO: 20815 - RNA, 21 nt, Artificial Sequence
  RNA Oligomer
ugucagaagcuuacagaugac

SEQ ID NO: 20816 - RNA, 21 nt, Artificial Sequence
  RNA Oligomer
ugauuggucuguuggacguuu

SEQ ID NO: 20817 - RNA, 21 nt, Artificial Sequence
  RNA Oligomer
cagagaacugcgguuacuuaa

SEQ ID NO: 20818 - RNA, 21 nt, Artificial Sequence
  RNA Oligomer
uacagagaacugcgguuacuu

SEQ ID NO: 20819 - RNA, 21 nt, Artificial Sequence
  RNA Oligomer
ccuacagagaacugcgguuac

SEQ ID NO: 20820 - RNA, 21 nt, Artificial Sequence
  RNA Oligomer
gcugcuuuugacacaaaaacg

SEQ ID NO: 20821 - RNA, 21 nt, Artificial Sequence
  RNA Oligomer
gcuccugagaucaugcugaac

SEQ ID NO: 20822 - RNA, 21 nt, Artificial Sequence
  RNA Oligomer
uucaguuccuuaucuaccaaa

SEQ ID NO: 20823 - RNA, 21 nt, Artificial Sequence
  RNA Oligomer
acguuuuuacaccugcaaggu

SEQ ID NO: 20824 - RNA, 21 nt, Artificial Sequence
  RNA Oligomer
cuaguaaucuagcugugaaug

SEQ ID NO: 20825 - RNA, 21 nt, Artificial Sequence
  RNA Oligomer
ggucuguuggacguuuuuaca

SEQ ID NO: 20826 - RNA, 21 nt, Artificial Sequence
  RNA Oligomer
ucaugcgaaaagaaccuacag

SEQ ID NO: 20827 - RNA, 21 nt, Artificial Sequence
  RNA Oligomer
agcucuccagaccauuucagu

SEQ ID NO: 20828 - RNA, 21 nt, Artificial Sequence
  RNA Oligomer
ugugugcugcuuuugacacaa

SEQ ID NO: 20829 - RNA, 21 nt, Artificial Sequence
  RNA Oligomer
cuguuggacguuuuuacaccu

SEQ ID NO: 20830 - RNA, 21 nt, Artificial Sequence
  RNA Oligomer
ugaagaagcucuccagaccau

SEQ ID NO: 20831 - RNA, 21 nt, Artificial Sequence
  RNA Oligomer
uguuuccugguacagaccaua

SEQ ID NO: 20832 - RNA, 21 nt, Artificial Sequence
  RNA Oligomer
accagacaguugauauuuggu

SEQ ID NO: 20833 - RNA, 21 nt, Artificial Sequence
  RNA Oligomer
gugaagaagcucuccagacca

SEQ ID NO: 20834 - RNA, 21 nt, Artificial Sequence
  RNA Oligomer
ccagacaguugauauuugguc

SEQ ID NO: 20835 - RNA, 21 nt, Artificial Sequence
  RNA Oligomer
gauguguaucuggugacccau

SEQ ID NO: 20836 - RNA, 21 nt, Artificial Sequence
  RNA Oligomer
ggcaggagcugaacaagacaa

SEQ ID NO: 20837 - RNA, 21 nt, Artificial Sequence
  RNA Oligomer
gaaccuacagagaacugcggu

SEQ ID NO: 20838 - RNA, 21 nt, Artificial Sequence
  RNA Oligomer
uacacaucauugaauuccucc

SEQ ID NO: 20839 - RNA, 21 nt, Artificial Sequence
  RNA Oligomer
uucuuuucgcaugaaugaugg

SEQ ID NO: 20840 - RNA, 21 nt, Artificial Sequence
  RNA Oligomer
auacacaucauugaauuccuc

SEQ ID NO: 20841 - RNA, 21 nt, Artificial Sequence
  RNA Oligomer
uagauuacuagguuuuagguc

SEQ ID NO: 20842 - RNA, 21 nt, Artificial Sequence
  RNA Oligomer
agauuacuagguuuuaggucc

SEQ ID NO: 20843 - RNA, 21 nt, Artificial Sequence
  RNA Oligomer
augaaugauggacugaaaugg

SEQ ID NO: 20844 - RNA, 21 nt, Artificial Sequence
  RNA Oligomer
auguucuuccagucaacagcu

SEQ ID NO: 20845 - RNA, 21 nt, Artificial Sequence
  RNA Oligomer
auguauauacuuuagaccucg

SEQ ID NO: 20846 - RNA, 21 nt, Artificial Sequence
  RNA Oligomer
aauuugguagauaaggaacug

SEQ ID NO: 20847 - RNA, 21 nt, Artificial Sequence
  RNA Oligomer
uuguaaugcauccaguucagc

SEQ ID NO: 20848 - RNA, 21 nt, Artificial Sequence
  RNA Oligomer
aaaauccagaaucuucagcuc

SEQ ID NO: 20849 - RNA, 21 nt, Artificial Sequence
  RNA Oligomer
aaauccagaaucuucagcuca

SEQ ID NO: 20850 - RNA, 21 nt, Artificial Sequence
  RNA Oligomer
aaucuucagcucacagucuuc

SEQ ID NO: 20851 - RNA, 21 nt, Artificial Sequence
  RNA Oligomer
auuugguagauaaggaacuga

SEQ ID NO: 20852 - RNA, 21 nt, Artificial Sequence
  RNA Oligomer
cacaauguuguucagaucugc

SEQ ID NO: 20853 - RNA, 21 nt, Artificial Sequence
  RNA Oligomer
acaauguuguucagaucugcc

SEQ ID NO: 20854 - RNA, 21 nt, Artificial Sequence
  RNA Oligomer
uucauauguuuaaguaaccgc

SEQ ID NO: 20855 - RNA, 21 nt, Artificial Sequence
  RNA Oligomer
ugaaugauggacugaaauggu

SEQ ID NO: 20856 - RNA, 21 nt, Artificial Sequence
  RNA Oligomer
uuuagaccucggagaauuugg

SEQ ID NO: 20857 - RNA, 21 nt, Artificial Sequence
  RNA Oligomer
uagauaaggaacugaacaugg

SEQ ID NO: 20858 - RNA, 21 nt, Artificial Sequence
  RNA Oligomer
uucacaauguuguucagaucu

SEQ ID NO: 20859 - RNA, 21 nt, Artificial Sequence
  RNA Oligomer
gauacacaucauugaauuccu

SEQ ID NO: 20860 - RNA, 21 nt, Artificial Sequence
  RNA Oligomer
gaauuccuccagagaccuugc

SEQ ID NO: 20861 - RNA, 21 nt, Artificial Sequence
  RNA Oligomer
uucucuguagguucuuuucgc

SEQ ID NO: 20862 - RNA, 21 nt, Artificial Sequence
  RNA Oligomer
uaccaggaaacaauguucuuc

SEQ ID NO: 20863 - RNA, 21 nt, Artificial Sequence
  RNA Oligomer
guucuuccagucaacagcucg

SEQ ID NO: 20864 - RNA, 21 nt, Artificial Sequence
  RNA Oligomer
cauuucaucaucugugugccg

SEQ ID NO: 20865 - RNA, 21 nt, Artificial Sequence
  RNA Oligomer
auugaauuccuccagagaccu

SEQ ID NO: 20866 - RNA, 21 nt, Artificial Sequence
  RNA Oligomer
auguuuaaguaaccgcaguuc

SEQ ID NO: 20867 - RNA, 21 nt, Artificial Sequence
  RNA Oligomer
guucucuguagguucuuuucg

SEQ ID NO: 20868 - RNA, 21 nt, Artificial Sequence
  RNA Oligomer
ucuuuucgcaugaaugaugga

SEQ ID NO: 20869 - RNA, 21 nt, Artificial Sequence
  RNA Oligomer
uguaccaggaaacaauguucu

SEQ ID NO: 20870 - RNA, 21 nt, Artificial Sequence
  RNA Oligomer
gaaacaauguucuuccaguca

SEQ ID NO: 20871 - RNA, 21 nt, Artificial Sequence
  RNA Oligomer
uagccugucauuucaucaucu

SEQ ID NO: 20872 - RNA, 21 nt, Artificial Sequence
  RNA Oligomer
uucagcucacagucuucauuc

SEQ ID NO: 20873 - RNA, 21 nt, Artificial Sequence
  RNA Oligomer
agaauuugguagauaaggaac

SEQ ID NO: 20874 - RNA, 21 nt, Artificial Sequence
  RNA Oligomer
uuucacaauguuguucagauc

SEQ ID NO: 20875 - RNA, 21 nt, Artificial Sequence
  RNA Oligomer
auuccuccagagaccuugcag

SEQ ID NO: 20876 - RNA, 21 nt, Artificial Sequence
  RNA Oligomer
cagauugucuuguucagcucc

SEQ ID NO: 20877 - RNA, 21 nt, Artificial Sequence
  RNA Oligomer
aacagaccaaucacauuuuca

SEQ ID NO: 20878 - RNA, 21 nt, Artificial Sequence
  RNA Oligomer
uguuuaaguaaccgcaguucu

SEQ ID NO: 20879 - RNA, 21 nt, Artificial Sequence
  RNA Oligomer
aacaauguucuuccagucaac

SEQ ID NO: 20880 - RNA, 21 nt, Artificial Sequence
  RNA Oligomer
aauguucuuccagucaacagc

SEQ ID NO: 20881 - RNA, 21 nt, Artificial Sequence
  RNA Oligomer
ucauuucaucaucugugugcc

SEQ ID NO: 20882 - RNA, 21 nt, Artificial Sequence
  RNA Oligomer
uguauauacuuuagaccucgg

SEQ ID NO: 20883 - RNA, 21 nt, Artificial Sequence
  RNA Oligomer
uauauacuuuagaccucggag

SEQ ID NO: 20884 - RNA, 21 nt, Artificial Sequence
  RNA Oligomer
cauuucacaauguuguucaga

SEQ ID NO: 20885 - RNA, 21 nt, Artificial Sequence
  RNA Oligomer
augagaugggucaccagauac

SEQ ID NO: 20886 - RNA, 21 nt, Artificial Sequence
  RNA Oligomer
cacaucauugaauuccuccag

SEQ ID NO: 20887 - RNA, 21 nt, Artificial Sequence
  RNA Oligomer
uuuaaguaaccgcaguucucu

SEQ ID NO: 20888 - RNA, 21 nt, Artificial Sequence
  RNA Oligomer
cuguaccaggaaacaauguuc

SEQ ID NO: 20889 - RNA, 21 nt, Artificial Sequence
  RNA Oligomer
auccaguucagcaugaucuca

SEQ ID NO: 20890 - RNA, 21 nt, Artificial Sequence
  RNA Oligomer
cugucauuucaucaucugugu

SEQ ID NO: 20891 - RNA, 21 nt, Artificial Sequence
  RNA Oligomer
ugucauuucaucaucugugug

SEQ ID NO: 20892 - RNA, 21 nt, Artificial Sequence
  RNA Oligomer
uccaaaauccagaaucuucag

SEQ ID NO: 20893 - RNA, 21 nt, Artificial Sequence
  RNA Oligomer
cagaaucuucagcucacaguc

SEQ ID NO: 20894 - RNA, 21 nt, Artificial Sequence
  RNA Oligomer
agaaucuucagcucacagucu

SEQ ID NO: 20895 - RNA, 21 nt, Artificial Sequence
  RNA Oligomer
aucuucagcucacagucuuca

SEQ ID NO: 20896 - RNA, 21 nt, Artificial Sequence
  RNA Oligomer
cuucauucacagcuagauuac

SEQ ID NO: 20897 - RNA, 21 nt, Artificial Sequence
  RNA Oligomer
caauguuguucagaucugccc

SEQ ID NO: 20898 - RNA, 21 nt, Artificial Sequence
  RNA Oligomer
caacagaccaaucacauuuuc

SEQ ID NO: 20899 - RNA, 21 nt, Artificial Sequence
  RNA Oligomer
ucucuguagguucuuuucgca

SEQ ID NO: 20900 - RNA, 21 nt, Artificial Sequence
  RNA Oligomer
guuguaaugcauccaguucag

SEQ ID NO: 20901 - RNA, 21 nt, Artificial Sequence
  RNA Oligomer
acguagccugucauuucauca

SEQ ID NO: 20902 - RNA, 21 nt, Artificial Sequence
  RNA Oligomer
gucauuucaucaucugugugc

SEQ ID NO: 20903 - RNA, 21 nt, Artificial Sequence
  RNA Oligomer
uuucaucaucugugugccgag

SEQ ID NO: 20904 - RNA, 21 nt, Artificial Sequence
  RNA Oligomer
caaaauccagaaucuucagcu

SEQ ID NO: 20905 - RNA, 21 nt, Artificial Sequence
  RNA Oligomer
gucccugugaauuaugucagc

SEQ ID NO: 20906 - RNA, 21 nt, Artificial Sequence
  RNA Oligomer
uggucaucuguaagcuucuga

SEQ ID NO: 20907 - RNA, 21 nt, Artificial Sequence
  RNA Oligomer
uaagcuucugacauuucacaa

SEQ ID NO: 20908 - RNA, 21 nt, Artificial Sequence
  RNA Oligomer
aauuccuccagagaccuugca

SEQ ID NO: 20909 - RNA, 21 nt, Artificial Sequence
  RNA Oligomer
cauauguuuaaguaaccgcag

SEQ ID NO: 20910 - RNA, 21 nt, Artificial Sequence
  RNA Oligomer
caguucagcaugaucucagga

SEQ ID NO: 20911 - RNA, 21 nt, Artificial Sequence
  RNA Oligomer
agccugucauuucaucaucug

SEQ ID NO: 20912 - RNA, 21 nt, Artificial Sequence
  RNA Oligomer
auccagaaucuucagcucaca

SEQ ID NO: 20913 - RNA, 21 nt, Artificial Sequence
  RNA Oligomer
cucacagucuucauucacagc

SEQ ID NO: 20914 - RNA, 21 nt, Artificial Sequence
  RNA Oligomer
aacauggucaucuguaagcuu

SEQ ID NO: 20915 - RNA, 21 nt, Artificial Sequence
  RNA Oligomer
ucuguaagcuucugacauuuc

SEQ ID NO: 20916 - RNA, 21 nt, Artificial Sequence
  RNA Oligomer
uguaagcuucugacauuucac

SEQ ID NO: 20917 - RNA, 21 nt, Artificial Sequence
  RNA Oligomer
caucauugaauuccuccagag

SEQ ID NO: 20918 - RNA, 21 nt, Artificial Sequence
  RNA Oligomer
aucauugaauuccuccagaga

SEQ ID NO: 20919 - RNA, 21 nt, Artificial Sequence
  RNA Oligomer
ucauauguuuaaguaaccgca

SEQ ID NO: 20920 - RNA, 21 nt, Artificial Sequence
  RNA Oligomer
ucaacagcucggccauuaugc

SEQ ID NO: 20921 - RNA, 21 nt, Artificial Sequence
  RNA Oligomer
cauccaguucagcaugaucuc

SEQ ID NO: 20922 - RNA, 21 nt, Artificial Sequence
  RNA Oligomer
cagcucacagucuucauucac

SEQ ID NO: 20923 - RNA, 21 nt, Artificial Sequence
  RNA Oligomer
acagucuucauucacagcuag

SEQ ID NO: 20924 - RNA, 21 nt, Artificial Sequence
  RNA Oligomer
ugucagcugaauguauauacu

SEQ ID NO: 20925 - RNA, 21 nt, Artificial Sequence
  RNA Oligomer
guauauacuuuagaccucgga

SEQ ID NO: 20926 - RNA, 21 nt, Artificial Sequence
  RNA Oligomer
auggucaucuguaagcuucug

SEQ ID NO: 20927 - RNA, 21 nt, Artificial Sequence
  RNA Oligomer
aucuguaagcuucugacauuu

SEQ ID NO: 20928 - RNA, 21 nt, Artificial Sequence
  RNA Oligomer
accucccagauugucuuguuc

SEQ ID NO: 20929 - RNA, 21 nt, Artificial Sequence
  RNA Oligomer
ucccagauugucuuguucagc

SEQ ID NO: 20930 - RNA, 21 nt, Artificial Sequence
  RNA Oligomer
auuucaucaucugugugccga

SEQ ID NO: 20931 - RNA, 21 nt, Artificial Sequence
  RNA Oligomer
uucaucaucugugugccgagc

SEQ ID NO: 20932 - RNA, 21 nt, Artificial Sequence
  RNA Oligomer
ucccugugaauuaugucagcu

SEQ ID NO: 20933 - RNA, 21 nt, Artificial Sequence
  RNA Oligomer
uauacuuuagaccucggagaa

SEQ ID NO: 20934 - RNA, 21 nt, Artificial Sequence
  RNA Oligomer
gauaaggaacugaacaugguc

SEQ ID NO: 20935 - RNA, 21 nt, Artificial Sequence
  RNA Oligomer
auaaggaacugaacaugguca

SEQ ID NO: 20936 - RNA, 21 nt, Artificial Sequence
  RNA Oligomer
aaggaacugaacauggucauc

SEQ ID NO: 20937 - RNA, 21 nt, Artificial Sequence
  RNA Oligomer
gaacugaacauggucaucugu

SEQ ID NO: 20938 - RNA, 21 nt, Artificial Sequence
  RNA Oligomer
gaacauggucaucuguaagcu

SEQ ID NO: 20939 - RNA, 21 nt, Artificial Sequence
  Chemically synthesized
cauggucaucuguaagcuucu

SEQ ID NO: 20940 - RNA, 21 nt, Artificial Sequence
  Chemically synthesized
caucccacugaccaaauauca

SEQ ID NO: 20941 - RNA, 21 nt, Artificial Sequence
  Chemically synthesized
cacugaccaaauaucaacugu

SEQ ID NO: 20942 - RNA, 21 nt, Artificial Sequence
  Chemically synthesized
caaaagcagcacacacagagc

SEQ ID NO: 20943 - RNA, 21 nt, Artificial Sequence
  Chemically synthesized
auugucuuguucagcuccugc

SEQ ID NO: 20944 - RNA, 21 nt, Artificial Sequence
  Chemically synthesized
uaaggaacugaacauggucau

SEQ ID NO: 20945 - RNA, 21 nt, Artificial Sequence
  Chemically synthesized
cagaccaaucacauuuucaug

SEQ ID NO: 20946 - RNA, 21 nt, Artificial Sequence
  RNA Oligomer
acugaccaaauaucaacuguc

SEQ ID NO: 20947 - RNA, 21 nt, Artificial Sequence
  Chemically synthesized
cugaccaaauaucaacugucu

SEQ ID NO: 20948 - RNA, 21 nt, Artificial Sequence
  RNA Oligomer
ugucaaaagcagcacacacag

SEQ ID NO: 20949 - RNA, 21 nt, Artificial Sequence
  RNA Oligomer
auuacuagguuuuaggucccu

SEQ ID NO: 20950 - RNA, 21 nt, Artificial Sequence
  RNA Oligomer
ugauggacugaaauggucugg

SEQ ID NO: 20951 - RNA, 21 nt, Artificial Sequence
  RNA Oligomer
accaggaaacaauguucuucc

SEQ ID NO: 20952 - RNA, 21 nt, Artificial Sequence
  RNA Oligomer
ugaccaaauaucaacugucug

SEQ ID NO: 20953 - RNA, 21 nt, Artificial Sequence
  RNA Oligomer
ccacugaccaaauaucaacug

SEQ ID NO: 20954 - RNA, 21 nt, Artificial Sequence
  RNA Oligomer
uuucgcaugaaugauggacug

SEQ ID NO: 20955 - RNA, 21 nt, Artificial Sequence
  RNA Oligomer
cagauacacaucauugaauuc

SEQ ID NO: 20956 - RNA, 21 nt, Artificial Sequence
  RNA Oligomer
aaaacguccaacagaccaauc

SEQ ID NO: 20957 - RNA, 21 nt, Artificial Sequence
  RNA Oligomer
gauuacuagguuuuagguccc

SEQ ID NO: 20958 - RNA, 21 nt, Artificial Sequence
  RNA Oligomer
aguucucuguagguucuuuuc

SEQ ID NO: 20959 - RNA, 21 nt, Artificial Sequence
  RNA Oligomer
auggacugaaauggucuggag

SEQ ID NO: 20960 - RNA, 21 nt, Artificial Sequence
  RNA Oligomer
aaagcagcacacacagagcca

SEQ ID NO: 20961 - RNA, 21 nt, Artificial Sequence
  RNA Oligomer
uuuucgcaugaaugauggacu

SEQ ID NO: 20962 - RNA, 21 nt, Artificial Sequence
  RNA Oligomer
aaaagcagcacacacagagcc

SEQ ID NO: 20963 - RNA, 21 nt, Artificial Sequence
  RNA Oligomer
uuuaggucccugugaauuaug

SEQ ID NO: 20964 - RNA, 21 nt, Artificial Sequence
  RNA Oligomer
aaugauggacugaaauggucu

SEQ ID NO: 20965 - RNA, 21 nt, Artificial Sequence
  RNA Oligomer
caggaaacaauguucuuccag

SEQ ID NO: 20966 - RNA, 21 nt, Artificial Sequence
  RNA Oligomer
uuacuagguuuuaggucccug

SEQ ID NO: 20967 - RNA, 21 nt, Artificial Sequence
  RNA Oligomer
gucaccagauacacaucauug

SEQ ID NO: 20968 - RNA, 21 nt, Artificial Sequence
  RNA Oligomer
agauacacaucauugaauucc

SEQ ID NO: 20969 - RNA, 21 nt, Artificial Sequence
  RNA Oligomer
uucgcaugaaugauggacuga

SEQ ID NO: 20970 - RNA, 21 nt, Artificial Sequence
  RNA Oligomer
uacuagguuuuaggucccugu

SEQ ID NO: 20971 - RNA, 21 nt, Artificial Sequence
  RNA Oligomer
gauggacugaaauggucugga

SEQ ID NO: 20972 - RNA, 21 nt, Artificial Sequence
  RNA Oligomer
cuagauuacuagguuuuaggu

SEQ ID NO: 20973 - RNA, 21 nt, Artificial Sequence
  RNA Oligomer
augucagcugaauguauauac

SEQ ID NO: 20974 - RNA, 21 nt, Artificial Sequence
  RNA Oligomer
uucagcaugaucucaggagcc

SEQ ID NO: 20975 - RNA, 21 nt, Artificial Sequence
  RNA Oligomer
uaggucccugugaauuauguc

SEQ ID NO: 20976 - RNA, 21 nt, Artificial Sequence
  RNA Oligomer
uuuuugugucaaaagcagcac

SEQ ID NO: 20977 - RNA, 21 nt, Artificial Sequence
  RNA Oligomer
aucaacugucugguuguaaug

SEQ ID NO: 20978 - RNA, 21 nt, Artificial Sequence
  RNA Oligomer
uucugacauuucacaauguug

SEQ ID NO: 20979 - RNA, 21 nt, Artificial Sequence
  RNA Oligomer
gacauuucacaauguuguuca

SEQ ID NO: 20980 - RNA, 21 nt, Artificial Sequence
  RNA Oligomer
acauuucacaauguuguucag

SEQ ID NO: 20981 - RNA, 21 nt, Artificial Sequence
  RNA Oligomer
auaucaacugucugguuguaa

SEQ ID NO: 20982 - RNA, 21 nt, Artificial Sequence
  RNA Oligomer
auucacagcuagauuacuagg

SEQ ID NO: 20983 - RNA, 21 nt, Artificial Sequence
  RNA Oligomer
uucacagcuagauuacuaggu

SEQ ID NO: 20984 - RNA, 21 nt, Artificial Sequence
  RNA Oligomer
uagaccucggagaauuuggua

SEQ ID NO: 20985 - RNA, 21 nt, Artificial Sequence
  RNA Oligomer
agacagguucugguaacgcuc

SEQ ID NO: 20986 - RNA, 21 nt, Artificial Sequence
  RNA Oligomer
uccugagacauuuuccagcgg

SEQ ID NO: 20987 - RNA, 21 nt, Artificial Sequence
  RNA Oligomer
aacguccaacagaccaaucac

SEQ ID NO: 20988 - RNA, 21 nt, Artificial Sequence
  RNA Oligomer
augauggacugaaauggucug

SEQ ID NO: 20989 - RNA, 21 nt, Artificial Sequence
  RNA Oligomer
ucuggagagcuucuucacugc

SEQ ID NO: 20990 - RNA, 21 nt, Artificial Sequence
  RNA Oligomer
uaaugcauccaguucagcaug

SEQ ID NO: 20991 - RNA, 21 nt, Artificial Sequence
  RNA Oligomer
augaucucaggagcccuguac

SEQ ID NO: 20992 - RNA, 21 nt, Artificial Sequence
  RNA Oligomer
acuagguuuuaggucccugug

SEQ ID NO: 20993 - RNA, 21 nt, Artificial Sequence
  RNA Oligomer
cuugcagguguaaaaacgucc

SEQ ID NO: 20994 - RNA, 21 nt, Artificial Sequence
  RNA Oligomer
ugaaauggucuggagagcuuc

SEQ ID NO: 20995 - RNA, 21 nt, Artificial Sequence
  RNA Oligomer
uucuuccagucaacagcucgg

SEQ ID NO: 20996 - RNA, 21 nt, Artificial Sequence
  RNA Oligomer
uuugugucaaaagcagcacac

SEQ ID NO: 20997 - RNA, 21 nt, Artificial Sequence
  RNA Oligomer
uuaggucccugugaauuaugu

SEQ ID NO: 20998 - RNA, 21 nt, Artificial Sequence
  RNA Oligomer
uuagaccucggagaauuuggu

SEQ ID NO: 20999 - RNA, 21 nt, Artificial Sequence
  RNA Oligomer
gagaugggucaccagauacac

SEQ ID NO: 21000 - RNA, 21 nt, Artificial Sequence
  RNA Oligomer
uugcagguguaaaaacgucca

SEQ ID NO: 21001 - RNA, 21 nt, Artificial Sequence
  RNA Oligomer
uaaccgcaguucucuguaggu

SEQ ID NO: 21002 - RNA, 21 nt, Artificial Sequence
  RNA Oligomer
auauggucuguaccaggaaac

SEQ ID NO: 21003 - RNA, 21 nt, Artificial Sequence
  RNA Oligomer
uuuugugucaaaagcagcaca

SEQ ID NO: 21004 - RNA, 21 nt, Artificial Sequence
  RNA Oligomer
ucaacugucugguuguaaugc

SEQ ID NO: 21005 - RNA, 21 nt, Artificial Sequence
  RNA Oligomer
uugguagauaaggaacugaac

SEQ ID NO: 21006 - RNA, 21 nt, Artificial Sequence
  RNA Oligomer
ugacauuucacaauguuguuc

SEQ ID NO: 21007 - RNA, 21 nt, Artificial Sequence
  RNA Oligomer
uaaguaaccgcaguucucugu

SEQ ID NO: 21008 - RNA, 21 nt, Artificial Sequence
  RNA Oligomer
aauggucuggagagcuucuuc

SEQ ID NO: 21009 - RNA, 21 nt, Artificial Sequence
  RNA Oligomer
aaauaucaacugucugguugu

SEQ ID NO: 21010 - RNA, 21 nt, Artificial Sequence
  RNA Oligomer
cugucugguuguaaugcaucc

SEQ ID NO: 21011 - RNA, 21 nt, Artificial Sequence
  RNA Oligomer
ugucugguuguaaugcaucca

SEQ ID NO: 21012 - RNA, 21 nt, Artificial Sequence
  RNA Oligomer
gucugguuguaaugcauccag

SEQ ID NO: 21013 - RNA, 21 nt, Artificial Sequence
  RNA Oligomer
aaugcauccaguucagcauga

SEQ ID NO: 21014 - RNA, 21 nt, Artificial Sequence
  RNA Oligomer
gucaucuguaagcuucugaca

SEQ ID NO: 21015 - RNA, 21 nt, Artificial Sequence
  RNA Oligomer
aaacguccaacagaccaauca

SEQ ID NO: 21016 - RNA, 21 nt, Artificial Sequence
  RNA Oligomer
uuaaguaaccgcaguucucug

SEQ ID NO: 21017 - RNA, 21 nt, Artificial Sequence
  RNA Oligomer
aaguaaccgcaguucucugua

SEQ ID NO: 21018 - RNA, 21 nt, Artificial Sequence
  RNA Oligomer
guaaccgcaguucucuguagg

SEQ ID NO: 21019 - RNA, 21 nt, Artificial Sequence
  RNA Oligomer
cguuuuugugucaaaagcagc

SEQ ID NO: 21020 - RNA, 21 nt, Artificial Sequence
  RNA Oligomer
guucagcaugaucucaggagc

SEQ ID NO: 21021 - RNA, 21 nt, Artificial Sequence
  RNA Oligomer
uuugguagauaaggaacugaa

SEQ ID NO: 21022 - RNA, 21 nt, Artificial Sequence
  RNA Oligomer
accuugcagguguaaaaacgu

SEQ ID NO: 21023 - RNA, 21 nt, Artificial Sequence
  RNA Oligomer
cauucacagcuagauuacuag

SEQ ID NO: 21024 - RNA, 21 nt, Artificial Sequence
  RNA Oligomer
uguaaaaacguccaacagacc

SEQ ID NO: 21025 - RNA, 21 nt, Artificial Sequence
  RNA Oligomer
cuguagguucuuuucgcauga

SEQ ID NO: 21026 - RNA, 21 nt, Artificial Sequence
  RNA Oligomer
acugaaauggucuggagagcu

SEQ ID NO: 21027 - RNA, 21 nt, Artificial Sequence
  RNA Oligomer
uugugucaaaagcagcacaca

SEQ ID NO: 21028 - RNA, 21 nt, Artificial Sequence
  RNA Oligomer
agguguaaaaacguccaacag

SEQ ID NO: 21029 - RNA, 21 nt, Artificial Sequence
  RNA Oligomer
auggucuggagagcuucuuca

SEQ ID NO: 21030 - RNA, 21 nt, Artificial Sequence
  RNA Oligomer
uauggucuguaccaggaaaca

SEQ ID NO: 21031 - RNA, 21 nt, Artificial Sequence
  RNA Oligomer
accaaauaucaacugucuggu

SEQ ID NO: 21032 - RNA, 21 nt, Artificial Sequence
  RNA Oligomer
uggucuggagagcuucuucac

SEQ ID NO: 21033 - RNA, 21 nt, Artificial Sequence
  RNA Oligomer
gaccaaauaucaacugucugg

SEQ ID NO: 21034 - RNA, 21 nt, Artificial Sequence
  RNA Oligomer
augggucaccagauacacauc

SEQ ID NO: 21035 - RNA, 21 nt, Artificial Sequence
  RNA Oligomer
uugucuuguucagcuccugcc

SEQ ID NO: 21036 - RNA, 21 nt, Artificial Sequence
  RNA Oligomer
accgcaguucucuguagguuc

SEQ ID NO: 21037 - RNA, 21 nt, Artificial Sequence
  RNA Oligomer
accaauacugacccucuuuac

SEQ ID NO: 21038 - RNA, 21 nt, Artificial Sequence
  RNA Oligomer
gcaauaugccuccuuguauua

SEQ ID NO: 21039 - RNA, 21 nt, Artificial Sequence
  RNA Oligomer
cccuucugacugagcaauaug

SEQ ID NO: 21040 - RNA, 21 nt, Artificial Sequence
  RNA Oligomer
ggagauuggugcuguaaaaua

SEQ ID NO: 21041 - RNA, 21 nt, Artificial Sequence
  RNA Oligomer
cccuugugaguccugcaucau

SEQ ID NO: 21042 - RNA, 21 nt, Artificial Sequence
  RNA Oligomer
aggagauuggugcuguaaaau

SEQ ID NO: 21043 - RNA, 21 nt, Artificial Sequence
  RNA Oligomer
gcaguagaugaugaaagaaag

SEQ ID NO: 21044 - RNA, 21 nt, Artificial Sequence
  RNA Oligomer
agaacugcuauuuccucuaau

SEQ ID NO: 21045 - RNA, 21 nt, Artificial Sequence
  RNA Oligomer
ccuucugaacuacacugcauu

SEQ ID NO: 21046 - RNA, 21 nt, Artificial Sequence
  RNA Oligomer
gaaagaaagguugguauuauc

SEQ ID NO: 21047 - RNA, 21 nt, Artificial Sequence
  RNA Oligomer
cgaguuuucugaccagcuuuu

SEQ ID NO: 21048 - RNA, 21 nt, Artificial Sequence
  RNA Oligomer
cgacauaacauuguacuguaa

SEQ ID NO: 21049 - RNA, 21 nt, Artificial Sequence
  RNA Oligomer
gaaugaagcguugccauugaa

SEQ ID NO: 21050 - RNA, 21 nt, Artificial Sequence
  RNA Oligomer
cuuaauuugcuuuucccuugu

SEQ ID NO: 21051 - RNA, 21 nt, Artificial Sequence
  RNA Oligomer
gcagaauuguggaguguuuuu

SEQ ID NO: 21052 - RNA, 21 nt, Artificial Sequence
  RNA Oligomer
guagaugaugaaagaaagguu

SEQ ID NO: 21053 - RNA, 21 nt, Artificial Sequence
  RNA Oligomer
guacaaggaaugaaaguguca

SEQ ID NO: 21054 - RNA, 21 nt, Artificial Sequence
  RNA Oligomer
gaacugcuauuuccucuaaug

SEQ ID NO: 21055 - RNA, 21 nt, Artificial Sequence
  RNA Oligomer
gugauuucauagcgaguuuuc

SEQ ID NO: 21056 - RNA, 21 nt, Artificial Sequence
  RNA Oligomer
ggaucagucuuugugauuuca

SEQ ID NO: 21057 - RNA, 21 nt, Artificial Sequence
  RNA Oligomer
uguaguucucagaugcguaaa

SEQ ID NO: 21058 - RNA, 21 nt, Artificial Sequence
  RNA Oligomer
agacaguguuugacgaagcga

SEQ ID NO: 21059 - RNA, 21 nt, Artificial Sequence
  RNA Oligomer
uuaauuugcuuuucccuugug

SEQ ID NO: 21060 - RNA, 21 nt, Artificial Sequence
  RNA Oligomer
ccuuucucuuacaccugccau

SEQ ID NO: 21061 - RNA, 21 nt, Artificial Sequence
  RNA Oligomer
agguugguauuaucaggaaau

SEQ ID NO: 21062 - RNA, 21 nt, Artificial Sequence
  RNA Oligomer
ucaaaugcaguagaugaugaa

SEQ ID NO: 21063 - RNA, 21 nt, Artificial Sequence
  RNA Oligomer
ugugauuucauagcgaguuuu

SEQ ID NO: 21064 - RNA, 21 nt, Artificial Sequence
  RNA Oligomer
cgaaugaagcguugccauuga

SEQ ID NO: 21065 - RNA, 21 nt, Artificial Sequence
  RNA Oligomer
cuaaggagauuggugcuguaa

SEQ ID NO: 21066 - RNA, 21 nt, Artificial Sequence
  RNA Oligomer
gcuaaggagauuggugcugua

SEQ ID NO: 21067 - RNA, 21 nt, Artificial Sequence
  RNA Oligomer
gugggaacuaaacuugaucuu

SEQ ID NO: 21068 - RNA, 21 nt, Artificial Sequence
  RNA Oligomer
ugaguccugcaucauuugaaa

SEQ ID NO: 21069 - RNA, 21 nt, Artificial Sequence
  RNA Oligomer
uaauuugcuuuucccuuguga

SEQ ID NO: 21070 - RNA, 21 nt, Artificial Sequence
  RNA Oligomer
guucuuaauuugcuuuucccu

SEQ ID NO: 21071 - RNA, 21 nt, Artificial Sequence
  RNA Oligomer
ugcagaauuguggaguguuuu

SEQ ID NO: 21072 - RNA, 21 nt, Artificial Sequence
  RNA Oligomer
agguguaaaaaucauguguug

SEQ ID NO: 21073 - RNA, 21 nt, Artificial Sequence
  RNA Oligomer
cgauuaguaaaagugcuuucc

SEQ ID NO: 21074 - RNA, 21 nt, Artificial Sequence
  RNA Oligomer
ugaugaaagaaagguugguau

SEQ ID NO: 21075 - RNA, 21 nt, Artificial Sequence
  RNA Oligomer
gguuaauuucugucaaaugca

SEQ ID NO: 21076 - RNA, 21 nt, Artificial Sequence
  RNA Oligomer
acauuguacaaggaaugaaag

SEQ ID NO: 21077 - RNA, 21 nt, Artificial Sequence
  RNA Oligomer
uugugauuucauagcgaguuu

SEQ ID NO: 21078 - RNA, 21 nt, Artificial Sequence
  RNA Oligomer
ccgacauaacauuguacugua

SEQ ID NO: 21079 - RNA, 21 nt, Artificial Sequence
  RNA Oligomer
accuucugaacuacacugcau

SEQ ID NO: 21080 - RNA, 21 nt, Artificial Sequence
  RNA Oligomer
ugggaacuaaacuugaucuua

SEQ ID NO: 21081 - RNA, 21 nt, Artificial Sequence
  RNA Oligomer
guguucuuaauuugcuuuucc

SEQ ID NO: 21082 - RNA, 21 nt, Artificial Sequence
  RNA Oligomer
guggaguguuuuuacauugau

SEQ ID NO: 21083 - RNA, 21 nt, Artificial Sequence
  RNA Oligomer
gagguucuguaaacugugcua

SEQ ID NO: 21084 - RNA, 21 nt, Artificial Sequence
  RNA Oligomer
gggucugugagguucuguaaa

SEQ ID NO: 21085 - RNA, 21 nt, Artificial Sequence
  RNA Oligomer
ugggucugugagguucuguaa

SEQ ID NO: 21086 - RNA, 21 nt, Artificial Sequence
  RNA Oligomer
gcuuugccuauugauguuccu

SEQ ID NO: 21087 - RNA, 21 nt, Artificial Sequence
  RNA Oligomer
cuagguguaaaaaucaugugu

SEQ ID NO: 21088 - RNA, 21 nt, Artificial Sequence
  RNA Oligomer
gucgauuaguaaaagugcuuu

SEQ ID NO: 21089 - RNA, 21 nt, Artificial Sequence
  RNA Oligomer
agcuuuuccuuucucuuacac

SEQ ID NO: 21090 - RNA, 21 nt, Artificial Sequence
  RNA Oligomer
cuuaagcuuuuccuuucucuu

SEQ ID NO: 21091 - RNA, 21 nt, Artificial Sequence
  RNA Oligomer
caaaugcaguagaugaugaaa

SEQ ID NO: 21092 - RNA, 21 nt, Artificial Sequence
  RNA Oligomer
gaguuuucugaccagcuuuug

SEQ ID NO: 21093 - RNA, 21 nt, Artificial Sequence
  RNA Oligomer
ucagucuuugugauuucauag

SEQ ID NO: 21094 - RNA, 21 nt, Artificial Sequence
  RNA Oligomer
gaucagucuuugugauuucau

SEQ ID NO: 21095 - RNA, 21 nt, Artificial Sequence
  RNA Oligomer
cagauuaagaguugccaaaau

SEQ ID NO: 21096 - RNA, 21 nt, Artificial Sequence
  RNA Oligomer
ccuaaaaugacaagccuucuu

SEQ ID NO: 21097 - RNA, 21 nt, Artificial Sequence
  RNA Oligomer
agaaaaugccugcuguuguaa

SEQ ID NO: 21098 - RNA, 21 nt, Artificial Sequence
  RNA Oligomer
ggcuaaggagauuggugcugu

SEQ ID NO: 21099 - RNA, 21 nt, Artificial Sequence
  RNA Oligomer
gaguccugcaucauuugaaaa

SEQ ID NO: 21100 - RNA, 21 nt, Artificial Sequence
  RNA Oligomer
gguucuguaaacugugcuagu

SEQ ID NO: 21101 - RNA, 21 nt, Artificial Sequence
  RNA Oligomer
gucugugagguucuguaaacu

SEQ ID NO: 21102 - RNA, 21 nt, Artificial Sequence
  RNA Oligomer
guagucgcuuugccuauugau

SEQ ID NO: 21103 - RNA, 21 nt, Artificial Sequence
  RNA Oligomer
aaaucauguguugcagcuuua

SEQ ID NO: 21104 - RNA, 21 nt, Artificial Sequence
  RNA Oligomer
ucgauuaguaaaagugcuuuc

SEQ ID NO: 21105 - RNA, 21 nt, Artificial Sequence
  RNA Oligomer
uccuuucucuuacaccugcca

SEQ ID NO: 21106 - RNA, 21 nt, Artificial Sequence
  RNA Oligomer
gaaagguugguauuaucagga

SEQ ID NO: 21107 - RNA, 21 nt, Artificial Sequence
  RNA Oligomer
gaugaaagaaagguugguauu

SEQ ID NO: 21108 - RNA, 21 nt, Artificial Sequence
  RNA Oligomer
ugcaguagaugaugaaagaaa

SEQ ID NO: 21109 - RNA, 21 nt, Artificial Sequence
  RNA Oligomer
augcaguagaugaugaaagaa

SEQ ID NO: 21110 - RNA, 21 nt, Artificial Sequence
  RNA Oligomer
cuacauuguacaaggaaugaa

SEQ ID NO: 21111 - RNA, 21 nt, Artificial Sequence
  RNA Oligomer
gucuuugugauuucauagcga

SEQ ID NO: 21112 - RNA, 21 nt, Artificial Sequence
  RNA Oligomer
uggaucagucuuugugauuuc

SEQ ID NO: 21113 - RNA, 21 nt, Artificial Sequence
  RNA Oligomer
cucuccuauguaguucucaga

SEQ ID NO: 21114 - RNA, 21 nt, Artificial Sequence
  RNA Oligomer
ucugaacuacacugcauuguu

SEQ ID NO: 21115 - RNA, 21 nt, Artificial Sequence
  RNA Oligomer
aaggagauuggugcuguaaaa

SEQ ID NO: 21116 - RNA, 21 nt, Artificial Sequence
  RNA Oligomer
agaauuguggaguguuuuuac

SEQ ID NO: 21117 - RNA, 21 nt, Artificial Sequence
  RNA Oligomer
gccacuacaacagaauuuuuu

SEQ ID NO: 21118 - RNA, 21 nt, Artificial Sequence
  RNA Oligomer
agccacuacaacagaauuuuu

SEQ ID NO: 21119 - RNA, 21 nt, Artificial Sequence
  RNA Oligomer
ugagguucuguaaacugugcu

SEQ ID NO: 21120 - RNA, 21 nt, Artificial Sequence
  RNA Oligomer
ccuuugggucugugagguucu

SEQ ID NO: 21121 - RNA, 21 nt, Artificial Sequence
  RNA Oligomer
cuuugccuauugauguuccuu

SEQ ID NO: 21122 - RNA, 21 nt, Artificial Sequence
  RNA Oligomer
gucgcuuugccuauugauguu

SEQ ID NO: 21123 - RNA, 21 nt, Artificial Sequence
  RNA Oligomer
gcuuuccuuaguuuucuagua

SEQ ID NO: 21124 - RNA, 21 nt, Artificial Sequence
  RNA Oligomer
agugcuuuccuuaguuuucua

SEQ ID NO: 21125 - RNA, 21 nt, Artificial Sequence
  RNA Oligomer
ugucgauuaguaaaagugcuu

SEQ ID NO: 21126 - RNA, 21 nt, Artificial Sequence
  RNA Oligomer
aagcuuuuccuuucucuuaca

SEQ ID NO: 21127 - RNA, 21 nt, Artificial Sequence
  RNA Oligomer
ucuuaagcuuuuccuuucucu

SEQ ID NO: 21128 - RNA, 21 nt, Artificial Sequence
  RNA Oligomer
caggaaauguuuucuuaagcu

SEQ ID NO: 21129 - RNA, 21 nt, Artificial Sequence
  RNA Oligomer
gguugguauuaucaggaaaug

SEQ ID NO: 21130 - RNA, 21 nt, Artificial Sequence
  RNA Oligomer
aagguugguauuaucaggaaa

SEQ ID NO: 21131 - RNA, 21 nt, Artificial Sequence
  RNA Oligomer
aaagguugguauuaucaggaa

SEQ ID NO: 21132 - RNA, 21 nt, Artificial Sequence
  RNA Oligomer
cacuacauuguacaaggaaug

SEQ ID NO: 21133 - RNA, 21 nt, Artificial Sequence
  RNA Oligomer
acacuacauuguacaaggaau

SEQ ID NO: 21134 - RNA, 21 nt, Artificial Sequence
  RNA Oligomer
ucuccuauguaguucucagau

SEQ ID NO: 21135 - RNA, 21 nt, Artificial Sequence
  RNA Oligomer
gauuaagaguugccaaaauac

SEQ ID NO: 21136 - RNA, 21 nt, Artificial Sequence
  RNA Oligomer
aaacuugaucuuagggaugau

SEQ ID NO: 21137 - RNA, 21 nt, Artificial Sequence
  RNA Oligomer
ccuugugaguccugcaucauu

SEQ ID NO: 21138 - RNA, 21 nt, Artificial Sequence
  RNA Oligomer
cagaauuguggaguguuuuua

SEQ ID NO: 21139 - RNA, 21 nt, Artificial Sequence
  RNA Oligomer
cagccacuacaacagaauuuu

SEQ ID NO: 21140 - RNA, 21 nt, Artificial Sequence
  RNA Oligomer
gcuagugcugacgauguucug

SEQ ID NO: 21141 - RNA, 21 nt, Artificial Sequence
  RNA Oligomer
ggucugugagguucuguaaac

SEQ ID NO: 21142 - RNA, 21 nt, Artificial Sequence
  RNA Oligomer
ugccuauugauguuccuuugg

SEQ ID NO: 21143 - RNA, 21 nt, Artificial Sequence
  RNA Oligomer
cgcuuugccuauugauguucc

SEQ ID NO: 21144 - RNA, 21 nt, Artificial Sequence
  RNA Oligomer
ucgcuuugccuauugauguuc

SEQ ID NO: 21145 - RNA, 21 nt, Artificial Sequence
  RNA Oligomer
ugcuuuccuuaguuuucuagu

SEQ ID NO: 21146 - RNA, 21 nt, Artificial Sequence
  RNA Oligomer
gugcuuuccuuaguuuucuag

SEQ ID NO: 21147 - RNA, 21 nt, Artificial Sequence
  RNA Oligomer
caauaugccuccuuguauuau

SEQ ID NO: 21148 - RNA, 21 nt, Artificial Sequence
  RNA Oligomer
gcggagauuuugaacagaacu

SEQ ID NO: 21149 - RNA, 21 nt, Artificial Sequence
  RNA Oligomer
uccuauguaguucucagaugc

SEQ ID NO: 21150 - RNA, 21 nt, Artificial Sequence
  RNA Oligomer
ugaacuacacugcauuguugu

SEQ ID NO: 21151 - RNA, 21 nt, Artificial Sequence
  RNA Oligomer
gcuuuucccuugugaguccug

SEQ ID NO: 21152 - RNA, 21 nt, Artificial Sequence
  RNA Oligomer
uggaguguuuuuacauugauc

SEQ ID NO: 21153 - RNA, 21 nt, Artificial Sequence
  RNA Oligomer
ugcugacgauguucuguacaa

SEQ ID NO: 21154 - RNA, 21 nt, Artificial Sequence
  RNA Oligomer
gugcugacgauguucuguaca

SEQ ID NO: 21155 - RNA, 21 nt, Artificial Sequence
  RNA Oligomer
acacugucacuugaccaauac

SEQ ID NO: 21156 - RNA, 21 nt, Artificial Sequence
  RNA Oligomer
ucaggaaauguuuucuuaagc

SEQ ID NO: 21157 - RNA, 21 nt, Artificial Sequence
  RNA Oligomer
augaugaaagaaagguuggua

SEQ ID NO: 21158 - RNA, 21 nt, Artificial Sequence
  RNA Oligomer
gaaaaugccugcuguuguaaa

SEQ ID NO: 21159 - RNA, 21 nt, Artificial Sequence
  RNA Oligomer
gagaaaaugccugcuguugua

SEQ ID NO: 21160 - RNA, 21 nt, Artificial Sequence
  RNA Oligomer
gaagaggaagagaaaaugccu

SEQ ID NO: 21161 - RNA, 21 nt, Artificial Sequence
  RNA Oligomer
ccauggcuaaggagauuggug

SEQ ID NO: 21162 - RNA, 21 nt, Artificial Sequence
  RNA Oligomer
cgagaaacugaaggagaagaa

SEQ ID NO: 21163 - RNA, 21 nt, Artificial Sequence
  RNA Oligomer
acuugaucuuagggaugauaa

SEQ ID NO: 21164 - RNA, 21 nt, Artificial Sequence
  RNA Oligomer
ucagccacuacaacagaauuu

SEQ ID NO: 21165 - RNA, 21 nt, Artificial Sequence
  RNA Oligomer
guugguauuaucaggaaaugu

SEQ ID NO: 21166 - RNA, 21 nt, Artificial Sequence
  RNA Oligomer
ugcucuccuauguaguucuca

SEQ ID NO: 21167 - RNA, 21 nt, Artificial Sequence
  RNA Oligomer
ccugcuguuguaaaugucuca

SEQ ID NO: 21168 - RNA, 21 nt, Artificial Sequence
  RNA Oligomer
aacuugaucuuagggaugaua

SEQ ID NO: 21169 - RNA, 21 nt, Artificial Sequence
  RNA Oligomer
gugaguccugcaucauuugaa

SEQ ID NO: 21170 - RNA, 21 nt, Artificial Sequence
  RNA Oligomer
guagauggaaaaccggugaau

SEQ ID NO: 21171 - RNA, 21 nt, Artificial Sequence
  RNA Oligomer
guugcagaauuguggaguguu

SEQ ID NO: 21172 - RNA, 21 nt, Artificial Sequence
  RNA Oligomer
aaauugacaguugcagaauug

SEQ ID NO: 21173 - RNA, 21 nt, Artificial Sequence
  RNA Oligomer
ugauguuccuuugggucugug

SEQ ID NO: 21174 - RNA, 21 nt, Artificial Sequence
  RNA Oligomer
cuguagucgcuuugccuauug

SEQ ID NO: 21175 - RNA, 21 nt, Artificial Sequence
  RNA Oligomer
ggagauuuugaacagaacugc

SEQ ID NO: 21176 - RNA, 21 nt, Artificial Sequence
  RNA Oligomer
cacuugcucuccuauguaguu

SEQ ID NO: 21177 - RNA, 21 nt, Artificial Sequence
  RNA Oligomer
cuugaucuuagggaugauaaa

SEQ ID NO: 21178 - RNA, 21 nt, Artificial Sequence
  RNA Oligomer
uguggaguguuuuuacauuga

SEQ ID NO: 21179 - RNA, 21 nt, Artificial Sequence
  RNA Oligomer
ugacaguugcagaauugugga

SEQ ID NO: 21180 - RNA, 21 nt, Artificial Sequence
  RNA Oligomer
ccuguagucgcuuugccuauu

SEQ ID NO: 21181 - RNA, 21 nt, Artificial Sequence
  RNA Oligomer
cuaugaaccuucuuaacauca

SEQ ID NO: 21182 - RNA, 21 nt, Artificial Sequence
  RNA Oligomer
ugaagaauucuguuuagcugu

SEQ ID NO: 21183 - RNA, 21 nt, Artificial Sequence
  RNA Oligomer
ugcggagauuuugaacagaac

SEQ ID NO: 21184 - RNA, 21 nt, Artificial Sequence
  RNA Oligomer
gccuucuuaaagccuuauuuu

SEQ ID NO: 21185 - RNA, 21 nt, Artificial Sequence
  RNA Oligomer
ugccugcuguuguaaaugucu

SEQ ID NO: 21186 - RNA, 21 nt, Artificial Sequence
  RNA Oligomer
ggugcuguaaaauaccuggag

SEQ ID NO: 21187 - RNA, 21 nt, Artificial Sequence
  RNA Oligomer
gguagauggaaaaccggugaa

SEQ ID NO: 21188 - RNA, 21 nt, Artificial Sequence
  RNA Oligomer
ggaguguuuuuacauugaucu

SEQ ID NO: 21189 - RNA, 21 nt, Artificial Sequence
  RNA Oligomer
ucuguacaacuuaacucacug

SEQ ID NO: 21190 - RNA, 21 nt, Artificial Sequence
  RNA Oligomer
gacacugucacuugaccaaua

SEQ ID NO: 21191 - RNA, 21 nt, Artificial Sequence
  RNA Oligomer
ugaaccuucuuaacaucacug

SEQ ID NO: 21192 - RNA, 21 nt, Artificial Sequence
  RNA Oligomer
gaauucuguuuagcugugggu

SEQ ID NO: 21193 - RNA, 21 nt, Artificial Sequence
  RNA Oligomer
cggagauuuugaacagaacug

SEQ ID NO: 21194 - RNA, 21 nt, Artificial Sequence
  RNA Oligomer
gcucagcucuuuggaucaguc

SEQ ID NO: 21195 - RNA, 21 nt, Artificial Sequence
  RNA Oligomer
agcucagcucuuuggaucagu

SEQ ID NO: 21196 - RNA, 21 nt, Artificial Sequence
  RNA Oligomer
cccgacauaacauuguacugu

SEQ ID NO: 21197 - RNA, 21 nt, Artificial Sequence
  RNA Oligomer
ucccgacauaacauuguacug

SEQ ID NO: 21198 - RNA, 21 nt, Artificial Sequence
  RNA Oligomer
gugaguuagcagcacguguuc

SEQ ID NO: 21199 - RNA, 21 nt, Artificial Sequence
  RNA Oligomer
caguugcagaauuguggagug

SEQ ID NO: 21200 - RNA, 21 nt, Artificial Sequence
  RNA Oligomer
acaguugcagaauuguggagu

SEQ ID NO: 21201 - RNA, 21 nt, Artificial Sequence
  RNA Oligomer
uccuguagucgcuuugccuau

SEQ ID NO: 21202 - RNA, 21 nt, Artificial Sequence
  RNA Oligomer
acuaugaaccuucuuaacauc

SEQ ID NO: 21203 - RNA, 21 nt, Artificial Sequence
  RNA Oligomer
gccuccuuguauuauaaaauc

SEQ ID NO: 21204 - RNA, 21 nt, Artificial Sequence
  RNA Oligomer
gcuuuugcggagauuuugaac

SEQ ID NO: 21205 - RNA, 21 nt, Artificial Sequence
  RNA Oligomer
ucagcucuuuggaucagucuu

SEQ ID NO: 21206 - RNA, 21 nt, Artificial Sequence
  RNA Oligomer
cucagcucuuuggaucagucu

SEQ ID NO: 21207 - RNA, 21 nt, Artificial Sequence
  RNA Oligomer
gccugcuguuguaaaugucuc

SEQ ID NO: 21208 - RNA, 21 nt, Artificial Sequence
  RNA Oligomer
gaagagaaaaugccugcuguu

SEQ ID NO: 21209 - RNA, 21 nt, Artificial Sequence
  RNA Oligomer
caagacaguguuugacgaagc

SEQ ID NO: 21210 - RNA, 21 nt, Artificial Sequence
  RNA Oligomer
guuuucuaguaacuaggugua

SEQ ID NO: 21211 - RNA, 21 nt, Artificial Sequence
  RNA Oligomer
uugcggagauuuugaacagaa

SEQ ID NO: 21212 - RNA, 21 nt, Artificial Sequence
  RNA Oligomer
agccuucuuaaagccuuauuu

SEQ ID NO: 21213 - RNA, 21 nt, Artificial Sequence
  RNA Oligomer
cgacacugucacuugaccaau

SEQ ID NO: 21214 - RNA, 21 nt, Artificial Sequence
  RNA Oligomer
aaaaaucauguguugcagcuu

SEQ ID NO: 21215 - RNA, 21 nt, Artificial Sequence
  RNA Oligomer
gguguaaaaaucauguguugc

SEQ ID NO: 21216 - RNA, 21 nt, Artificial Sequence
  RNA Oligomer
gugugugugaucaaaggacaa

SEQ ID NO: 21217 - RNA, 21 nt, Artificial Sequence
  RNA Oligomer
gccaaaauaccuucugaacua

SEQ ID NO: 21218 - RNA, 21 nt, Artificial Sequence
  RNA Oligomer
ggaagagaaaaugccugcugu

SEQ ID NO: 21219 - RNA, 21 nt, Artificial Sequence
  RNA Oligomer
gaagaagaggaagagaaaaug

SEQ ID NO: 21220 - RNA, 21 nt, Artificial Sequence
  RNA Oligomer
ggagaagaagcugacucccau

SEQ ID NO: 21221 - RNA, 21 nt, Artificial Sequence
  RNA Oligomer
cccgaaugaagcguugccauu

SEQ ID NO: 21222 - RNA, 21 nt, Artificial Sequence
  RNA Oligomer
ccaaaauaccuucugaacuac

SEQ ID NO: 21223 - RNA, 21 nt, Artificial Sequence
  RNA Oligomer
ucagauuaagaguugccaaaa

SEQ ID NO: 21224 - RNA, 21 nt, Artificial Sequence
  RNA Oligomer
ccauuuuuugaaccaaucagu

SEQ ID NO: 21225 - RNA, 21 nt, Artificial Sequence
  RNA Oligomer
ugcuuuucccuugugaguccu

SEQ ID NO: 21226 - RNA, 21 nt, Artificial Sequence
  RNA Oligomer
cccuauccuauccgcaaacag

SEQ ID NO: 21227 - RNA, 21 nt, Artificial Sequence
  RNA Oligomer
gcuaaugcaauuagcauuaug

SEQ ID NO: 21228 - RNA, 21 nt, Artificial Sequence
  RNA Oligomer
cgauguucuguacaacuuaac

SEQ ID NO: 21229 - RNA, 21 nt, Artificial Sequence
  RNA Oligomer
gacgauguucuguacaacuua

SEQ ID NO: 21230 - RNA, 21 nt, Artificial Sequence
  RNA Oligomer
ggugugugugaucaaaggaca

SEQ ID NO: 21231 - RNA, 21 nt, Artificial Sequence
  RNA Oligomer
acagaacugcuauuuccucua

SEQ ID NO: 21232 - RNA, 21 nt, Artificial Sequence
  RNA Oligomer
agaguugccaaaauaccuucu

SEQ ID NO: 21233 - RNA, 21 nt, Artificial Sequence
  RNA Oligomer
caagccuucuuaaagccuuau

SEQ ID NO: 21234 - RNA, 21 nt, Artificial Sequence
  RNA Oligomer
acaagccuucuuaaagccuua

SEQ ID NO: 21235 - RNA, 21 nt, Artificial Sequence
  RNA Oligomer
ucccgaaugaagcguugccau

SEQ ID NO: 21236 - RNA, 21 nt, Artificial Sequence
  RNA Oligomer
gaagaagcugacucccaucac

SEQ ID NO: 21237 - RNA, 21 nt, Artificial Sequence
  RNA Oligomer
gagaaacugaaggagaagaag

SEQ ID NO: 21238 - RNA, 21 nt, Artificial Sequence
  RNA Oligomer
cgaucgagaaacugaaggaga

SEQ ID NO: 21239 - RNA, 21 nt, Artificial Sequence
  RNA Oligomer
ccaucauccuagugggaacua

SEQ ID NO: 21240 - RNA, 21 nt, Artificial Sequence
  RNA Oligomer
gcauuauguuuugcauguaug

SEQ ID NO: 21241 - RNA, 21 nt, Artificial Sequence
  RNA Oligomer
gaccaauacugacccucuuua

SEQ ID NO: 21242 - RNA, 21 nt, Artificial Sequence
  RNA Oligomer
cugucacuugaccaauacuga

SEQ ID NO: 21243 - RNA, 21 nt, Artificial Sequence
  RNA Oligomer
gcgaguuuucugaccagcuuu

SEQ ID NO: 21244 - RNA, 21 nt, Artificial Sequence
  RNA Oligomer
gcucuuuggaucagucuuugu

SEQ ID NO: 21245 - RNA, 21 nt, Artificial Sequence
  RNA Oligomer
ccgaaugaagcguugccauug

SEQ ID NO: 21246 - RNA, 21 nt, Artificial Sequence
  RNA Oligomer
guugccaaaauaccuucugaa

SEQ ID NO: 21247 - RNA, 21 nt, Artificial Sequence
  RNA Oligomer
aagccuucuuaaagccuuauu

SEQ ID NO: 21248 - RNA, 21 nt, Artificial Sequence
  RNA Oligomer
cacugucacuugaccaauacu

SEQ ID NO: 21249 - RNA, 21 nt, Artificial Sequence
  RNA Oligomer
cucagaugcguaaagcagaac

SEQ ID NO: 21250 - RNA, 21 nt, Artificial Sequence
  RNA Oligomer
cuaaaaugacaagccuucuua

SEQ ID NO: 21251 - RNA, 21 nt, Artificial Sequence
  RNA Oligomer
guucagacucacauucuauua

SEQ ID NO: 21252 - RNA, 21 nt, Artificial Sequence
  RNA Oligomer
agagaaaaugccugcuguugu

SEQ ID NO: 21253 - RNA, 21 nt, Artificial Sequence
  RNA Oligomer
ugacgauguucuguacaacuu

SEQ ID NO: 21254 - RNA, 21 nt, Artificial Sequence
  RNA Oligomer
ccgacacugucacuugaccaa

SEQ ID NO: 21255 - RNA, 21 nt, Artificial Sequence
  RNA Oligomer
ugaccagcuuuugcggagauu

SEQ ID NO: 21256 - RNA, 21 nt, Artificial Sequence
  RNA Oligomer
gcguugccauugaacucacca

SEQ ID NO: 21257 - RNA, 21 nt, Artificial Sequence
  RNA Oligomer
caaaauaccuucugaacuaca

SEQ ID NO: 21258 - RNA, 21 nt, Artificial Sequence
  RNA Oligomer
agguaaaacuugccuacugau

SEQ ID NO: 21259 - RNA, 21 nt, Artificial Sequence
  RNA Oligomer
guaagaguucagacucacauu

SEQ ID NO: 21260 - RNA, 21 nt, Artificial Sequence
  RNA Oligomer
guccugucccuuggaaccuuu

SEQ ID NO: 21261 - RNA, 21 nt, Artificial Sequence
  RNA Oligomer
aggaagagaaaaugccugcug

SEQ ID NO: 21262 - RNA, 21 nt, Artificial Sequence
  RNA Oligomer
acaguguuugacgaagcgauc

SEQ ID NO: 21263 - RNA, 21 nt, Artificial Sequence
  RNA Oligomer
acgauguucuguacaacuuaa

SEQ ID NO: 21264 - RNA, 21 nt, Artificial Sequence
  RNA Oligomer
cuguaaacugugcuagugcug

SEQ ID NO: 21265 - RNA, 21 nt, Artificial Sequence
  RNA Oligomer
cuauugauguuccuuuggguc

SEQ ID NO: 21266 - RNA, 21 nt, Artificial Sequence
  RNA Oligomer
ccuucuuaacaucacugucuu

SEQ ID NO: 21267 - RNA, 21 nt, Artificial Sequence
  RNA Oligomer
cccaaauugggcauuuaauuc

SEQ ID NO: 21268 - RNA, 21 nt, Artificial Sequence
  RNA Oligomer
cagaacugcuauuuccucuaa

SEQ ID NO: 21269 - RNA, 21 nt, Artificial Sequence
  RNA Oligomer
cugaccagcuuuugcggagau

SEQ ID NO: 21270 - RNA, 21 nt, Artificial Sequence
  RNA Oligomer
cagcucuuuggaucagucuuu

SEQ ID NO: 21271 - RNA, 21 nt, Artificial Sequence
  RNA Oligomer
gugcagacacuugcucuccua

SEQ ID NO: 21272 - RNA, 21 nt, Artificial Sequence
  RNA Oligomer
gugcuagugcugacgauguuc

SEQ ID NO: 21273 - RNA, 21 nt, Artificial Sequence
  RNA Oligomer
uuccuuugggucugugagguu

SEQ ID NO: 21274 - RNA, 21 nt, Artificial Sequence
  RNA Oligomer
ugaccaauacugacccucuuu

SEQ ID NO: 21275 - RNA, 21 nt, Artificial Sequence
  RNA Oligomer
ccaaauugggcauuuaauuca

SEQ ID NO: 21276 - RNA, 21 nt, Artificial Sequence
  RNA Oligomer
ugaacagaacugcuauuuccu

SEQ ID NO: 21277 - RNA, 21 nt, Artificial Sequence
  RNA Oligomer
gaccagcuuuugcggagauuu

SEQ ID NO: 21278 - RNA, 21 nt, Artificial Sequence
  RNA Oligomer
agcucuuuggaucagucuuug

SEQ ID NO: 21279 - RNA, 21 nt, Artificial Sequence
  RNA Oligomer
gccauugaacucaccagugag

SEQ ID NO: 21280 - RNA, 21 nt, Artificial Sequence
  RNA Oligomer
gaguugccaaaauaccuucug

SEQ ID NO: 21281 - RNA, 21 nt, Artificial Sequence
  RNA Oligomer
ugacaagccuucuuaaagccu

SEQ ID NO: 21282 - RNA, 21 nt, Artificial Sequence
  RNA Oligomer
cccuaaaaugacaagccuucu

SEQ ID NO: 21283 - RNA, 21 nt, Artificial Sequence
  RNA Oligomer
agaagcugacucccaucaccu

SEQ ID NO: 21284 - RNA, 21 nt, Artificial Sequence
  RNA Oligomer
ggaacuaaacuugaucuuagg

SEQ ID NO: 21285 - RNA, 21 nt, Artificial Sequence
  RNA Oligomer
gcaauuagcauuauguuuugc

SEQ ID NO: 21286 - RNA, 21 nt, Artificial Sequence
  RNA Oligomer
cuuaacucacuggcgagaaua

SEQ ID NO: 21287 - RNA, 21 nt, Artificial Sequence
  RNA Oligomer
accgacacugucacuugacca

SEQ ID NO: 21288 - RNA, 21 nt, Artificial Sequence
  RNA Oligomer
ucauagcgaguuuucugacca

SEQ ID NO: 21289 - RNA, 21 nt, Artificial Sequence
  RNA Oligomer
gaguucagacucacauucuau

SEQ ID NO: 21290 - RNA, 21 nt, Artificial Sequence
  RNA Oligomer
ucgcacucaaugccaacuuuu

SEQ ID NO: 21291 - RNA, 21 nt, Artificial Sequence
  RNA Oligomer
gaagcugacucccaucaccua

SEQ ID NO: 21292 - RNA, 21 nt, Artificial Sequence
  RNA Oligomer
gaacuaaacuugaucuuaggg

SEQ ID NO: 21293 - RNA, 21 nt, Artificial Sequence
  RNA Oligomer
ccuauugauguuccuuugggu

SEQ ID NO: 21294 - RNA, 21 nt, Artificial Sequence
  RNA Oligomer
ugcuauuuccucuaaugaaga

SEQ ID NO: 21295 - RNA, 21 nt, Artificial Sequence
  RNA Oligomer
gauuuugaacagaacugcuau

SEQ ID NO: 21296 - RNA, 21 nt, Artificial Sequence
  RNA Oligomer
agcguagcagcucagcucuuu

SEQ ID NO: 21297 - RNA, 21 nt, Artificial Sequence
  RNA Oligomer
gccuacugaucaguuacacaa

SEQ ID NO: 21298 - RNA, 21 nt, Artificial Sequence
  RNA Oligomer
aguuaggaggugcagacacuu

SEQ ID NO: 21299 - RNA, 21 nt, Artificial Sequence
  RNA Oligomer
gcaaagaccuucgucuuugag

SEQ ID NO: 21300 - RNA, 21 nt, Artificial Sequence
  RNA Oligomer
gcacugaacuuugcaaagacc

SEQ ID NO: 21301 - RNA, 21 nt, Artificial Sequence
  RNA Oligomer
gagaagaagcugacucccauc

SEQ ID NO: 21302 - RNA, 21 nt, Artificial Sequence
  RNA Oligomer
cuagugggaacuaaacuugau

SEQ ID NO: 21303 - RNA, 21 nt, Artificial Sequence
  RNA Oligomer
aacuuaacucacuggcgagaa

SEQ ID NO: 21304 - RNA, 21 nt, Artificial Sequence
  RNA Oligomer
gcuauuuccucuaaugaagaa

SEQ ID NO: 21305 - RNA, 21 nt, Artificial Sequence
  RNA Oligomer
ccuacugaucaguuacacaac

SEQ ID NO: 21306 - RNA, 21 nt, Artificial Sequence
  RNA Oligomer
agacacuugcucuccuaugua

SEQ ID NO: 21307 - RNA, 21 nt, Artificial Sequence
  RNA Oligomer
agcacugaacuuugcaaagac

SEQ ID NO: 21308 - RNA, 21 nt, Artificial Sequence
  RNA Oligomer
agcccuaaaaugacaagccuu

SEQ ID NO: 21309 - RNA, 21 nt, Artificial Sequence
  RNA Oligomer
uccugucccuuggaaccuuug

SEQ ID NO: 21310 - RNA, 21 nt, Artificial Sequence
  RNA Oligomer
gccauggcuaaggagauuggu

SEQ ID NO: 21311 - RNA, 21 nt, Artificial Sequence
  RNA Oligomer
gggaacuaaacuugaucuuag

SEQ ID NO: 21312 - RNA, 21 nt, Artificial Sequence
  RNA Oligomer
cccuucagccacuacaacaga

SEQ ID NO: 21313 - RNA, 21 nt, Artificial Sequence
  RNA Oligomer
cacuugaccaauacugacccu

SEQ ID NO: 21314 - RNA, 21 nt, Artificial Sequence
  RNA Oligomer
caucacugucuugccagauua

SEQ ID NO: 21315 - RNA, 21 nt, Artificial Sequence
  RNA Oligomer
cugucaaaugcaguagaugau

SEQ ID NO: 21316 - RNA, 21 nt, Artificial Sequence
  RNA Oligomer
ccucuaaugaagaauucuguu

SEQ ID NO: 21317 - RNA, 21 nt, Artificial Sequence
  RNA Oligomer
cugcuauuuccucuaaugaag

SEQ ID NO: 21318 - RNA, 21 nt, Artificial Sequence
  RNA Oligomer
agcgaguuuucugaccagcuu

SEQ ID NO: 21319 - RNA, 21 nt, Artificial Sequence
  RNA Oligomer
ccauugaacucaccagugagu

SEQ ID NO: 21320 - RNA, 21 nt, Artificial Sequence
  RNA Oligomer
gaccuucgucuuugagaagac

SEQ ID NO: 21321 - RNA, 21 nt, Artificial Sequence
  RNA Oligomer
ugcaaagaccuucgucuuuga

SEQ ID NO: 21322 - RNA, 21 nt, Artificial Sequence
  RNA Oligomer
gaacuuugcaaagaccuucgu

SEQ ID NO: 21323 - RNA, 21 nt, Artificial Sequence
  RNA Oligomer
cacugaacuuugcaaagaccu

SEQ ID NO: 21324 - RNA, 21 nt, Artificial Sequence
  RNA Oligomer
acugcauuguugugccgagaa

SEQ ID NO: 21325 - RNA, 21 nt, Artificial Sequence
  RNA Oligomer
agaguucagacucacauucua

SEQ ID NO: 21326 - RNA, 21 nt, Artificial Sequence
  RNA Oligomer
acuaaacuugaucuuagggau

SEQ ID NO: 21327 - RNA, 21 nt, Artificial Sequence
  RNA Oligomer
ccuagugggaacuaaacuuga

SEQ ID NO: 21328 - RNA, 21 nt, Artificial Sequence
  RNA Oligomer
gcugacgauguucuguacaac

SEQ ID NO: 21329 - RNA, 21 nt, Artificial Sequence
  RNA Oligomer
agcaauaugccuccuuguauu

SEQ ID NO: 21330 - RNA, 21 nt, Artificial Sequence
  RNA Oligomer
ugagcaauaugccuccuugua

SEQ ID NO: 21331 - RNA, 21 nt, Artificial Sequence
  RNA Oligomer
cguguucccgacauaacauug

SEQ ID NO: 21332 - RNA, 21 nt, Artificial Sequence
  RNA Oligomer
acacuugcucuccuauguagu

SEQ ID NO: 21333 - RNA, 21 nt, Artificial Sequence
  RNA Oligomer
ugcagacacuugcucuccuau

SEQ ID NO: 21334 - RNA, 21 nt, Artificial Sequence
  RNA Oligomer
cacugcauuguugugccgaga

SEQ ID NO: 21335 - RNA, 21 nt, Artificial Sequence
  RNA Oligomer
gccuuauuuuucaaaagcgcc

SEQ ID NO: 21336 - RNA, 21 nt, Artificial Sequence
  RNA Oligomer
gcccuaaaaugacaagccuuc

SEQ ID NO: 21337 - RNA, 21 nt, Artificial Sequence
  RNA Oligomer
uucgcacucaaugccaacuuu

SEQ ID NO: 21338 - RNA, 21 nt, Artificial Sequence
  RNA Oligomer
cuaaacuugaucuuagggaug

SEQ ID NO: 21339 - RNA, 21 nt, Artificial Sequence
  RNA Oligomer
uccuagugggaacuaaacuug

SEQ ID NO: 21340 - RNA, 21 nt, Artificial Sequence
  RNA Oligomer
cuucagccacuacaacagaau

SEQ ID NO: 21341 - RNA, 21 nt, Artificial Sequence
  RNA Oligomer
cugacgauguucuguacaacu

SEQ ID NO: 21342 - RNA, 21 nt, Artificial Sequence
  RNA Oligomer
acaucacugucuugccagauu

SEQ ID NO: 21343 - RNA, 21 nt, Artificial Sequence
  RNA Oligomer
cuucuuaacaucacugucuug

SEQ ID NO: 21344 - RNA, 21 nt, Artificial Sequence
  RNA Oligomer
gagcaauaugccuccuuguau

SEQ ID NO: 21345 - RNA, 21 nt, Artificial Sequence
  RNA Oligomer
uacacuacauuguacaaggaa

SEQ ID NO: 21346 - RNA, 21 nt, Artificial Sequence
  RNA Oligomer
cauugaacucaccagugaguu

SEQ ID NO: 21347 - RNA, 21 nt, Artificial Sequence
  RNA Oligomer
agccuuauuuuucaaaagcgc

SEQ ID NO: 21348 - RNA, 21 nt, Artificial Sequence
  RNA Oligomer
aucauccuagugggaacuaaa

SEQ ID NO: 21349 - RNA, 21 nt, Artificial Sequence
  RNA Oligomer
uuacacuacauuguacaagga

SEQ ID NO: 21350 - RNA, 21 nt, Artificial Sequence
  RNA Oligomer
agauuuugaacagaacugcua

SEQ ID NO: 21351 - RNA, 21 nt, Artificial Sequence
  RNA Oligomer
ccagcuuuugcggagauuuug

SEQ ID NO: 21352 - RNA, 21 nt, Artificial Sequence
  RNA Oligomer
cagcacguguucccgacauaa

SEQ ID NO: 21353 - RNA, 21 nt, Artificial Sequence
  RNA Oligomer
aaacuugccuacugaucaguu

SEQ ID NO: 21354 - RNA, 21 nt, Artificial Sequence
  RNA Oligomer
cgcacucaaugccaacuuuuu

SEQ ID NO: 21355 - RNA, 21 nt, Artificial Sequence
  RNA Oligomer
acauugaucuuuugcuaaugc

SEQ ID NO: 21356 - RNA, 21 nt, Artificial Sequence
  RNA Oligomer
ccuucagccacuacaacagaa

SEQ ID NO: 21357 - RNA, 21 nt, Artificial Sequence
  RNA Oligomer
agaauacagcgugggacccuu

SEQ ID NO: 21358 - RNA, 21 nt, Artificial Sequence
  RNA Oligomer
acaacuuaacucacuggcgag

SEQ ID NO: 21359 - RNA, 21 nt, Artificial Sequence
  RNA Oligomer
cagauuaccgacacugucacu

SEQ ID NO: 21360 - RNA, 21 nt, Artificial Sequence
  RNA Oligomer
ccagauuaccgacacugucac

SEQ ID NO: 21361 - RNA, 21 nt, Artificial Sequence
  RNA Oligomer
gccagauuaccgacacuguca

SEQ ID NO: 21362 - RNA, 21 nt, Artificial Sequence
  RNA Oligomer
ccuuaguuuucuaguaacuag

SEQ ID NO: 21363 - RNA, 21 nt, Artificial Sequence
  RNA Oligomer
uccucuaaugaagaauucugu

SEQ ID NO: 21364 - RNA, 21 nt, Artificial Sequence
  RNA Oligomer
accagcuuuugcggagauuuu

SEQ ID NO: 21365 - RNA, 21 nt, Artificial Sequence
  RNA Oligomer
gcagcucagcucuuuggauca

SEQ ID NO: 21366 - RNA, 21 nt, Artificial Sequence
  RNA Oligomer
gcacguguucccgacauaaca

SEQ ID NO: 21367 - RNA, 21 nt, Artificial Sequence
  RNA Oligomer
accagugaguuagcagcacgu

SEQ ID NO: 21368 - RNA, 21 nt, Artificial Sequence
  RNA Oligomer
gcagacacuugcucuccuaug

SEQ ID NO: 21369 - RNA, 21 nt, Artificial Sequence
  RNA Oligomer
ugcaguuaggaggugcagaca

SEQ ID NO: 21370 - RNA, 21 nt, Artificial Sequence
  RNA Oligomer
cuuugcaaagaccuucgucuu

SEQ ID NO: 21371 - RNA, 21 nt, Artificial Sequence
  RNA Oligomer
cauugaucuuuugcuaaugca

SEQ ID NO: 21372 - RNA, 21 nt, Artificial Sequence
  RNA Oligomer
gaaccuucuuaacaucacugu

SEQ ID NO: 21373 - RNA, 21 nt, Artificial Sequence
  RNA Oligomer
gacugagcaauaugccuccuu

SEQ ID NO: 21374 - RNA, 21 nt, Artificial Sequence
  RNA Oligomer
gagauuuugaacagaacugcu

SEQ ID NO: 21375 - RNA, 21 nt, Artificial Sequence
  RNA Oligomer
cacguguucccgacauaacau

SEQ ID NO: 21376 - RNA, 21 nt, Artificial Sequence
  RNA Oligomer
ugccuacugaucaguuacaca

SEQ ID NO: 21377 - RNA, 21 nt, Artificial Sequence
  RNA Oligomer
gucuuugagaagacgguagcu

SEQ ID NO: 21378 - RNA, 21 nt, Artificial Sequence
  RNA Oligomer
agcuuuugcggagauuuugaa

SEQ ID NO: 21379 - RNA, 21 nt, Artificial Sequence
  RNA Oligomer
acguguucccgacauaacauu

SEQ ID NO: 21380 - RNA, 21 nt, Artificial Sequence
  RNA Oligomer
gcauuguugugccgagaacac

SEQ ID NO: 21381 - RNA, 21 nt, Artificial Sequence
  RNA Oligomer
ugcauuguugugccgagaaca

SEQ ID NO: 21382 - RNA, 21 nt, Artificial Sequence
  RNA Oligomer
cuucgcacucaaugccaacuu

SEQ ID NO: 21383 - RNA, 21 nt, Artificial Sequence
  RNA Oligomer
ugguagauggaaaaccgguga

SEQ ID NO: 21384 - RNA, 21 nt, Artificial Sequence
  RNA Oligomer
cugagcaauaugccuccuugu

SEQ ID NO: 21385 - RNA, 21 nt, Artificial Sequence
  RNA Oligomer
guagcagcucagcucuuugga

SEQ ID NO: 21386 - RNA, 21 nt, Artificial Sequence
  RNA Oligomer
uguucccgacauaacauugua

SEQ ID NO: 21387 - RNA, 21 nt, Artificial Sequence
  RNA Oligomer
gucuugccagauuaccgacac

SEQ ID NO: 21388 - RNA, 21 nt, Artificial Sequence
  RNA Oligomer
aacaucacugucuugccagau

SEQ ID NO: 21389 - RNA, 21 nt, Artificial Sequence
  RNA Oligomer
cccaucauccuagugggaacu

SEQ ID NO: 21390 - RNA, 21 nt, Artificial Sequence
  RNA Oligomer
ucguucuugguccugucccuu

SEQ ID NO: 21391 - RNA, 21 nt, Artificial Sequence
  RNA Oligomer
cuagccauggcuaaggagauu

SEQ ID NO: 21392 - RNA, 21 nt, Artificial Sequence
  RNA Oligomer
ugacugagcaauaugccuccu

SEQ ID NO: 21393 - RNA, 21 nt, Artificial Sequence
  RNA Oligomer
guaaagagggucaguauuggu

SEQ ID NO: 21394 - RNA, 21 nt, Artificial Sequence
  RNA Oligomer
uaauacaaggaggcauauugc

SEQ ID NO: 21395 - RNA, 21 nt, Artificial Sequence
  RNA Oligomer
cauauugcucagucagaaggg

SEQ ID NO: 21396 - RNA, 21 nt, Artificial Sequence
  RNA Oligomer
uauuuuacagcaccaaucucc

SEQ ID NO: 21397 - RNA, 21 nt, Artificial Sequence
  RNA Oligomer
augaugcaggacucacaaggg

SEQ ID NO: 21398 - RNA, 21 nt, Artificial Sequence
  RNA Oligomer
auuuuacagcaccaaucuccu

SEQ ID NO: 21399 - RNA, 21 nt, Artificial Sequence
  RNA Oligomer
cuuucuuucaucaucuacugc

SEQ ID NO: 21400 - RNA, 21 nt, Artificial Sequence
  RNA Oligomer
auuagaggaaauagcaguucu

SEQ ID NO: 21401 - RNA, 21 nt, Artificial Sequence
  RNA Oligomer
aaugcaguguaguucagaagg

SEQ ID NO: 21402 - RNA, 21 nt, Artificial Sequence
  RNA Oligomer
gauaauaccaaccuuucuuuc

SEQ ID NO: 21403 - RNA, 21 nt, Artificial Sequence
  RNA Oligomer
aaaagcuggucagaaaacucg

SEQ ID NO: 21404 - RNA, 21 nt, Artificial Sequence
  RNA Oligomer
uuacaguacaauguuaugucg

SEQ ID NO: 21405 - RNA, 21 nt, Artificial Sequence
  RNA Oligomer
uucaauggcaacgcuucauuc

SEQ ID NO: 21406 - RNA, 21 nt, Artificial Sequence
  RNA Oligomer
acaagggaaaagcaaauuaag

SEQ ID NO: 21407 - RNA, 21 nt, Artificial Sequence
  RNA Oligomer
aaaaacacuccacaauucugc

SEQ ID NO: 21408 - RNA, 21 nt, Artificial Sequence
  RNA Oligomer
aaccuuucuuucaucaucuac

SEQ ID NO: 21409 - RNA, 21 nt, Artificial Sequence
  RNA Oligomer
ugacacuuucauuccuuguac

SEQ ID NO: 21410 - RNA, 21 nt, Artificial Sequence
  RNA Oligomer
cauuagaggaaauagcaguuc

SEQ ID NO: 21411 - RNA, 21 nt, Artificial Sequence
  RNA Oligomer
gaaaacucgcuaugaaaucac

SEQ ID NO: 21412 - RNA, 21 nt, Artificial Sequence
  RNA Oligomer
ugaaaucacaaagacugaucc

SEQ ID NO: 21413 - RNA, 21 nt, Artificial Sequence
  RNA Oligomer
uuuacgcaucugagaacuaca

SEQ ID NO: 21414 - RNA, 21 nt, Artificial Sequence
  RNA Oligomer
ucgcuucgucaaacacugucu

SEQ ID NO: 21415 - RNA, 21 nt, Artificial Sequence
  RNA Oligomer
cacaagggaaaagcaaauuaa

SEQ ID NO: 21416 - RNA, 21 nt, Artificial Sequence
  RNA Oligomer
auggcagguguaagagaaagg

SEQ ID NO: 21417 - RNA, 21 nt, Artificial Sequence
  RNA Oligomer
auuuccugauaauaccaaccu

SEQ ID NO: 21418 - RNA, 21 nt, Artificial Sequence
  RNA Oligomer
uucaucaucuacugcauuuga

SEQ ID NO: 21419 - RNA, 21 nt, Artificial Sequence
  RNA Oligomer
aaaacucgcuaugaaaucaca

SEQ ID NO: 21420 - RNA, 21 nt, Artificial Sequence
  RNA Oligomer
ucaauggcaacgcuucauucg

SEQ ID NO: 21421 - RNA, 21 nt, Artificial Sequence
  RNA Oligomer
uuacagcaccaaucuccuuag

SEQ ID NO: 21422 - RNA, 21 nt, Artificial Sequence
  RNA Oligomer
uacagcaccaaucuccuuagc

SEQ ID NO: 21423 - RNA, 21 nt, Artificial Sequence
  RNA Oligomer
aagaucaaguuuaguucccac

SEQ ID NO: 21424 - RNA, 21 nt, Artificial Sequence
  RNA Oligomer
uuucaaaugaugcaggacuca

SEQ ID NO: 21425 - RNA, 21 nt, Artificial Sequence
  RNA Oligomer
ucacaagggaaaagcaaauua

SEQ ID NO: 21426 - RNA, 21 nt, Artificial Sequence
  RNA Oligomer
agggaaaagcaaauuaagaac

SEQ ID NO: 21427 - RNA, 21 nt, Artificial Sequence
  RNA Oligomer
aaaacacuccacaauucugca

SEQ ID NO: 21428 - RNA, 21 nt, Artificial Sequence
  RNA Oligomer
caacacaugauuuuuacaccu

SEQ ID NO: 21429 - RNA, 21 nt, Artificial Sequence
  RNA Oligomer
ggaaagcacuuuuacuaaucg

SEQ ID NO: 21430 - RNA, 21 nt, Artificial Sequence
  RNA Oligomer
auaccaaccuuucuuucauca

SEQ ID NO: 21431 - RNA, 21 nt, Artificial Sequence
  RNA Oligomer
ugcauuugacagaaauuaacc

SEQ ID NO: 21432 - RNA, 21 nt, Artificial Sequence
  RNA Oligomer
cuuucauuccuuguacaaugu

SEQ ID NO: 21433 - RNA, 21 nt, Artificial Sequence
  RNA Oligomer
aaacucgcuaugaaaucacaa

SEQ ID NO: 21434 - RNA, 21 nt, Artificial Sequence
  RNA Oligomer
uacaguacaauguuaugucgg

SEQ ID NO: 21435 - RNA, 21 nt, Artificial Sequence
  RNA Oligomer
augcaguguaguucagaaggu

SEQ ID NO: 21436 - RNA, 21 nt, Artificial Sequence
  RNA Oligomer
uaagaucaaguuuaguuccca

SEQ ID NO: 21437 - RNA, 21 nt, Artificial Sequence
  RNA Oligomer
ggaaaagcaaauuaagaacac

SEQ ID NO: 21438 - RNA, 21 nt, Artificial Sequence
  RNA Oligomer
aucaauguaaaaacacuccac

SEQ ID NO: 21439 - RNA, 21 nt, Artificial Sequence
  RNA Oligomer
uagcacaguuuacagaaccuc

SEQ ID NO: 21440 - RNA, 21 nt, Artificial Sequence
  RNA Oligomer
uuuacagaaccucacagaccc

SEQ ID NO: 21441 - RNA, 21 nt, Artificial Sequence
  RNA Oligomer
uuacagaaccucacagaccca

SEQ ID NO: 21442 - RNA, 21 nt, Artificial Sequence
  RNA Oligomer
aggaacaucaauaggcaaagc

SEQ ID NO: 21443 - RNA, 21 nt, Artificial Sequence
  RNA Oligomer
acacaugauuuuuacaccuag

SEQ ID NO: 21444 - RNA, 21 nt, Artificial Sequence
  RNA Oligomer
aaagcacuuuuacuaaucgac

SEQ ID NO: 21445 - RNA, 21 nt, Artificial Sequence
  RNA Oligomer
guguaagagaaaggaaaagcu

SEQ ID NO: 21446 - RNA, 21 nt, Artificial Sequence
  RNA Oligomer
aagagaaaggaaaagcuuaag

SEQ ID NO: 21447 - RNA, 21 nt, Artificial Sequence
  RNA Oligomer
uuucaucaucuacugcauuug

SEQ ID NO: 21448 - RNA, 21 nt, Artificial Sequence
  RNA Oligomer
caaaagcuggucagaaaacuc

SEQ ID NO: 21449 - RNA, 21 nt, Artificial Sequence
  RNA Oligomer
cuaugaaaucacaaagacuga

SEQ ID NO: 21450 - RNA, 21 nt, Artificial Sequence
  RNA Oligomer
augaaaucacaaagacugauc

SEQ ID NO: 21451 - RNA, 21 nt, Artificial Sequence
  RNA Oligomer
auuuuggcaacucuuaaucug

SEQ ID NO: 21452 - RNA, 21 nt, Artificial Sequence
  RNA Oligomer
aagaaggcuugucauuuuagg

SEQ ID NO: 21453 - RNA, 21 nt, Artificial Sequence
  RNA Oligomer
uuacaacagcaggcauuuucu

SEQ ID NO: 21454 - RNA, 21 nt, Artificial Sequence
  RNA Oligomer
acagcaccaaucuccuuagcc

SEQ ID NO: 21455 - RNA, 21 nt, Artificial Sequence
  RNA Oligomer
uuuucaaaugaugcaggacuc

SEQ ID NO: 21456 - RNA, 21 nt, Artificial Sequence
  RNA Oligomer
acuagcacaguuuacagaacc

SEQ ID NO: 21457 - RNA, 21 nt, Artificial Sequence
  RNA Oligomer
aguuuacagaaccucacagac

SEQ ID NO: 21458 - RNA, 21 nt, Artificial Sequence
  RNA Oligomer
aucaauaggcaaagcgacuac

SEQ ID NO: 21459 - RNA, 21 nt, Artificial Sequence
  RNA Oligomer
uaaagcugcaacacaugauuu

SEQ ID NO: 21460 - RNA, 21 nt, Artificial Sequence
  RNA Oligomer
gaaagcacuuuuacuaaucga

SEQ ID NO: 21461 - RNA, 21 nt, Artificial Sequence
  RNA Oligomer
uggcagguguaagagaaagga

SEQ ID NO: 21462 - RNA, 21 nt, Artificial Sequence
  RNA Oligomer
uccugauaauaccaaccuuuc

SEQ ID NO: 21463 - RNA, 21 nt, Artificial Sequence
  RNA Oligomer
aauaccaaccuuucuuucauc

SEQ ID NO: 21464 - RNA, 21 nt, Artificial Sequence
  RNA Oligomer
uuucuuucaucaucuacugca

SEQ ID NO: 21465 - RNA, 21 nt, Artificial Sequence
  RNA Oligomer
uucuuucaucaucuacugcau

SEQ ID NO: 21466 - RNA, 21 nt, Artificial Sequence
  RNA Oligomer
uucauuccuuguacaauguag

SEQ ID NO: 21467 - RNA, 21 nt, Artificial Sequence
  RNA Oligomer
ucgcuaugaaaucacaaagac

SEQ ID NO: 21468 - RNA, 21 nt, Artificial Sequence
  RNA Oligomer
gaaaucacaaagacugaucca

SEQ ID NO: 21469 - RNA, 21 nt, Artificial Sequence
  RNA Oligomer
ucugagaacuacauaggagag

SEQ ID NO: 21470 - RNA, 21 nt, Artificial Sequence
  RNA Oligomer
aacaaugcaguguaguucaga

SEQ ID NO: 21471 - RNA, 21 nt, Artificial Sequence
  RNA Oligomer
uuuuacagcaccaaucuccuu

SEQ ID NO: 21472 - RNA, 21 nt, Artificial Sequence
  RNA Oligomer
guaaaaacacuccacaauucu

SEQ ID NO: 21473 - RNA, 21 nt, Artificial Sequence
  RNA Oligomer
aaaaaauucuguuguaguggc

SEQ ID NO: 21474 - RNA, 21 nt, Artificial Sequence
  RNA Oligomer
aaaaauucuguuguaguggcu

SEQ ID NO: 21475 - RNA, 21 nt, Artificial Sequence
  RNA Oligomer
agcacaguuuacagaaccuca

SEQ ID NO: 21476 - RNA, 21 nt, Artificial Sequence
  RNA Oligomer
agaaccucacagacccaaagg

SEQ ID NO: 21477 - RNA, 21 nt, Artificial Sequence
  RNA Oligomer
aaggaacaucaauaggcaaag

SEQ ID NO: 21478 - RNA, 21 nt, Artificial Sequence
  RNA Oligomer
aacaucaauaggcaaagcgac

SEQ ID NO: 21479 - RNA, 21 nt, Artificial Sequence
  RNA Oligomer
uacuagaaaacuaaggaaagc

SEQ ID NO: 21480 - RNA, 21 nt, Artificial Sequence
  RNA Oligomer
uagaaaacuaaggaaagcacu

SEQ ID NO: 21481 - RNA, 21 nt, Artificial Sequence
  RNA Oligomer
aagcacuuuuacuaaucgaca

SEQ ID NO: 21482 - RNA, 21 nt, Artificial Sequence
  RNA Oligomer
uguaagagaaaggaaaagcuu

SEQ ID NO: 21483 - RNA, 21 nt, Artificial Sequence
  RNA Oligomer
agagaaaggaaaagcuuaaga

SEQ ID NO: 21484 - RNA, 21 nt, Artificial Sequence
  RNA Oligomer
agcuuaagaaaacauuuccug

SEQ ID NO: 21485 - RNA, 21 nt, Artificial Sequence
  RNA Oligomer
cauuuccugauaauaccaacc

SEQ ID NO: 21486 - RNA, 21 nt, Artificial Sequence
  RNA Oligomer
uuuccugauaauaccaaccuu

SEQ ID NO: 21487 - RNA, 21 nt, Artificial Sequence
  RNA Oligomer
uuccugauaauaccaaccuuu

SEQ ID NO: 21488 - RNA, 21 nt, Artificial Sequence
  RNA Oligomer
cauuccuuguacaauguagug

SEQ ID NO: 21489 - RNA, 21 nt, Artificial Sequence
  RNA Oligomer
auuccuuguacaauguagugu

SEQ ID NO: 21490 - RNA, 21 nt, Artificial Sequence
  RNA Oligomer
aucugagaacuacauaggaga

SEQ ID NO: 21491 - RNA, 21 nt, Artificial Sequence
  RNA Oligomer
guauuuuggcaacucuuaauc

SEQ ID NO: 21492 - RNA, 21 nt, Artificial Sequence
  RNA Oligomer
aucaucccuaagaucaaguuu

SEQ ID NO: 21493 - RNA, 21 nt, Artificial Sequence
  RNA Oligomer
aaugaugcaggacucacaagg

SEQ ID NO: 21494 - RNA, 21 nt, Artificial Sequence
  RNA Oligomer
uaaaaacacuccacaauucug

SEQ ID NO: 21495 - RNA, 21 nt, Artificial Sequence
  RNA Oligomer
aaaauucuguuguaguggcug

SEQ ID NO: 21496 - RNA, 21 nt, Artificial Sequence
  RNA Oligomer
cagaacaucgucagcacuagc

SEQ ID NO: 21497 - RNA, 21 nt, Artificial Sequence
  RNA Oligomer
guuuacagaaccucacagacc

SEQ ID NO: 21498 - RNA, 21 nt, Artificial Sequence
  RNA Oligomer
ccaaaggaacaucaauaggca

SEQ ID NO: 21499 - RNA, 21 nt, Artificial Sequence
  RNA Oligomer
ggaacaucaauaggcaaagcg

SEQ ID NO: 21500 - RNA, 21 nt, Artificial Sequence
  RNA Oligomer
gaacaucaauaggcaaagcga

SEQ ID NO: 21501 - RNA, 21 nt, Artificial Sequence
  RNA Oligomer
acuagaaaacuaaggaaagca

SEQ ID NO: 21502 - RNA, 21 nt, Artificial Sequence
  RNA Oligomer
cuagaaaacuaaggaaagcac

SEQ ID NO: 21503 - RNA, 21 nt, Artificial Sequence
  RNA Oligomer
auaauacaaggaggcauauug

SEQ ID NO: 21504 - RNA, 21 nt, Artificial Sequence
  RNA Oligomer
aguucuguucaaaaucuccgc

SEQ ID NO: 21505 - RNA, 21 nt, Artificial Sequence
  RNA Oligomer
gcaucugagaacuacauagga

SEQ ID NO: 21506 - RNA, 21 nt, Artificial Sequence
  RNA Oligomer
acaacaaugcaguguaguuca

SEQ ID NO: 21507 - RNA, 21 nt, Artificial Sequence
  RNA Oligomer
caggacucacaagggaaaagc

SEQ ID NO: 21508 - RNA, 21 nt, Artificial Sequence
  RNA Oligomer
gaucaauguaaaaacacucca

SEQ ID NO: 21509 - RNA, 21 nt, Artificial Sequence
  RNA Oligomer
uuguacagaacaucgucagca

SEQ ID NO: 21510 - RNA, 21 nt, Artificial Sequence
  RNA Oligomer
uguacagaacaucgucagcac

SEQ ID NO: 21511 - RNA, 21 nt, Artificial Sequence
  RNA Oligomer
guauuggucaagugacagugu

SEQ ID NO: 21512 - RNA, 21 nt, Artificial Sequence
  RNA Oligomer
gcuuaagaaaacauuuccuga

SEQ ID NO: 21513 - RNA, 21 nt, Artificial Sequence
  RNA Oligomer
uaccaaccuuucuuucaucau

SEQ ID NO: 21514 - RNA, 21 nt, Artificial Sequence
  RNA Oligomer
uuuacaacagcaggcauuuuc

SEQ ID NO: 21515 - RNA, 21 nt, Artificial Sequence
  RNA Oligomer
uacaacagcaggcauuuucuc

SEQ ID NO: 21516 - RNA, 21 nt, Artificial Sequence
  RNA Oligomer
aggcauuuucucuuccucuuc

SEQ ID NO: 21517 - RNA, 21 nt, Artificial Sequence
  RNA Oligomer
caccaaucuccuuagccaugg

SEQ ID NO: 21518 - RNA, 21 nt, Artificial Sequence
  RNA Oligomer
uucuucuccuucaguuucucg

SEQ ID NO: 21519 - RNA, 21 nt, Artificial Sequence
  RNA Oligomer
uuaucaucccuaagaucaagu

SEQ ID NO: 21520 - RNA, 21 nt, Artificial Sequence
  RNA Oligomer
aaauucuguuguaguggcuga

SEQ ID NO: 21521 - RNA, 21 nt, Artificial Sequence
  RNA Oligomer
acauuuccugauaauaccaac

SEQ ID NO: 21522 - RNA, 21 nt, Artificial Sequence
  RNA Oligomer
ugagaacuacauaggagagca

SEQ ID NO: 21523 - RNA, 21 nt, Artificial Sequence
  RNA Oligomer
ugagacauuuacaacagcagg

SEQ ID NO: 21524 - RNA, 21 nt, Artificial Sequence
  RNA Oligomer
uaucaucccuaagaucaaguu

SEQ ID NO: 21525 - RNA, 21 nt, Artificial Sequence
  RNA Oligomer
uucaaaugaugcaggacucac

SEQ ID NO: 21526 - RNA, 21 nt, Artificial Sequence
  RNA Oligomer
auucaccgguuuuccaucuac

SEQ ID NO: 21527 - RNA, 21 nt, Artificial Sequence
  RNA Oligomer
aacacuccacaauucugcaac

SEQ ID NO: 21528 - RNA, 21 nt, Artificial Sequence
  RNA Oligomer
caauucugcaacugucaauuu

SEQ ID NO: 21529 - RNA, 21 nt, Artificial Sequence
  RNA Oligomer
cacagacccaaaggaacauca

SEQ ID NO: 21530 - RNA, 21 nt, Artificial Sequence
  RNA Oligomer
caauaggcaaagcgacuacag

SEQ ID NO: 21531 - RNA, 21 nt, Artificial Sequence
  RNA Oligomer
gcaguucuguucaaaaucucc

SEQ ID NO: 21532 - RNA, 21 nt, Artificial Sequence
  RNA Oligomer
aacuacauaggagagcaagug

SEQ ID NO: 21533 - RNA, 21 nt, Artificial Sequence
  RNA Oligomer
uuuaucaucccuaagaucaag

SEQ ID NO: 21534 - RNA, 21 nt, Artificial Sequence
  RNA Oligomer
ucaauguaaaaacacuccaca

SEQ ID NO: 21535 - RNA, 21 nt, Artificial Sequence
  RNA Oligomer
uccacaauucugcaacuguca

SEQ ID NO: 21536 - RNA, 21 nt, Artificial Sequence
  RNA Oligomer
aauaggcaaagcgacuacagg

SEQ ID NO: 21537 - RNA, 21 nt, Artificial Sequence
  RNA Oligomer
ugauguuaagaagguucauag

SEQ ID NO: 21538 - RNA, 21 nt, Artificial Sequence
  RNA Oligomer
acagcuaaacagaauucuuca

SEQ ID NO: 21539 - RNA, 21 nt, Artificial Sequence
  RNA Oligomer
guucuguucaaaaucuccgca

SEQ ID NO: 21540 - RNA, 21 nt, Artificial Sequence
  RNA Oligomer
aaaauaaggcuuuaagaaggc

SEQ ID NO: 21541 - RNA, 21 nt, Artificial Sequence
  RNA Oligomer
agacauuuacaacagcaggca

SEQ ID NO: 21542 - RNA, 21 nt, Artificial Sequence
  RNA Oligomer
cuccagguauuuuacagcacc

SEQ ID NO: 21543 - RNA, 21 nt, Artificial Sequence
  RNA Oligomer
uucaccgguuuuccaucuacc

SEQ ID NO: 21544 - RNA, 21 nt, Artificial Sequence
  RNA Oligomer
agaucaauguaaaaacacucc

SEQ ID NO: 21545 - RNA, 21 nt, Artificial Sequence
  RNA Oligomer
cagugaguuaaguuguacaga

SEQ ID NO: 21546 - RNA, 21 nt, Artificial Sequence
  RNA Oligomer
uauuggucaagugacaguguc

SEQ ID NO: 21547 - RNA, 21 nt, Artificial Sequence
  RNA Oligomer
cagugauguuaagaagguuca

SEQ ID NO: 21548 - RNA, 21 nt, Artificial Sequence
  RNA Oligomer
acccacagcuaaacagaauuc

SEQ ID NO: 21549 - RNA, 21 nt, Artificial Sequence
  RNA Oligomer
caguucuguucaaaaucuccg

SEQ ID NO: 21550 - RNA, 21 nt, Artificial Sequence
  RNA Oligomer
gacugauccaaagagcugagc

SEQ ID NO: 21551 - RNA, 21 nt, Artificial Sequence
  RNA Oligomer
acugauccaaagagcugagcu

SEQ ID NO: 21552 - RNA, 21 nt, Artificial Sequence
  RNA Oligomer
acaguacaauguuaugucggg

SEQ ID NO: 21553 - RNA, 21 nt, Artificial Sequence
  RNA Oligomer
caguacaauguuaugucggga

SEQ ID NO: 21554 - RNA, 21 nt, Artificial Sequence
  RNA Oligomer
gaacacgugcugcuaacucac

SEQ ID NO: 21555 - RNA, 21 nt, Artificial Sequence
  RNA Oligomer
cacuccacaauucugcaacug

SEQ ID NO: 21556 - RNA, 21 nt, Artificial Sequence
  RNA Oligomer
acuccacaauucugcaacugu

SEQ ID NO: 21557 - RNA, 21 nt, Artificial Sequence
  RNA Oligomer
auaggcaaagcgacuacagga

SEQ ID NO: 21558 - RNA, 21 nt, Artificial Sequence
  RNA Oligomer
gauguuaagaagguucauagu

SEQ ID NO: 21559 - RNA, 21 nt, Artificial Sequence
  RNA Oligomer
gauuuuauaauacaaggaggc

SEQ ID NO: 21560 - RNA, 21 nt, Artificial Sequence
  RNA Oligomer
guucaaaaucuccgcaaaagc

SEQ ID NO: 21561 - RNA, 21 nt, Artificial Sequence
  RNA Oligomer
aagacugauccaaagagcuga

SEQ ID NO: 21562 - RNA, 21 nt, Artificial Sequence
  RNA Oligomer
agacugauccaaagagcugag

SEQ ID NO: 21563 - RNA, 21 nt, Artificial Sequence
  RNA Oligomer
gagacauuuacaacagcaggc

SEQ ID NO: 21564 - RNA, 21 nt, Artificial Sequence
  RNA Oligomer
aacagcaggcauuuucucuuc

SEQ ID NO: 21565 - RNA, 21 nt, Artificial Sequence
  RNA Oligomer
gcuucgucaaacacugucuug

SEQ ID NO: 21566 - RNA, 21 nt, Artificial Sequence
  RNA Oligomer
uacaccuaguuacuagaaaac

SEQ ID NO: 21567 - RNA, 21 nt, Artificial Sequence
  RNA Oligomer
uucuguucaaaaucuccgcaa

SEQ ID NO: 21568 - RNA, 21 nt, Artificial Sequence
  RNA Oligomer
aaauaaggcuuuaagaaggcu

SEQ ID NO: 21569 - RNA, 21 nt, Artificial Sequence
  RNA Oligomer
auuggucaagugacagugucg

SEQ ID NO: 21570 - RNA, 21 nt, Artificial Sequence
  RNA Oligomer
aagcugcaacacaugauuuuu

SEQ ID NO: 21571 - RNA, 21 nt, Artificial Sequence
  RNA Oligomer
gcaacacaugauuuuuacacc

SEQ ID NO: 21572 - RNA, 21 nt, Artificial Sequence
  RNA Oligomer
uuguccuuugaucacacacac

SEQ ID NO: 21573 - RNA, 21 nt, Artificial Sequence
  RNA Oligomer
uaguucagaagguauuuuggc

SEQ ID NO: 21574 - RNA, 21 nt, Artificial Sequence
  RNA Oligomer
acagcaggcauuuucucuucc

SEQ ID NO: 21575 - RNA, 21 nt, Artificial Sequence
  RNA Oligomer
cauuuucucuuccucuucuuc

SEQ ID NO: 21576 - RNA, 21 nt, Artificial Sequence
  RNA Oligomer
augggagucagcuucuucucc

SEQ ID NO: 21577 - RNA, 21 nt, Artificial Sequence
  RNA Oligomer
aauggcaacgcuucauucggg

SEQ ID NO: 21578 - RNA, 21 nt, Artificial Sequence
  RNA Oligomer
guaguucagaagguauuuugg

SEQ ID NO: 21579 - RNA, 21 nt, Artificial Sequence
  RNA Oligomer
uuuuggcaacucuuaaucuga

SEQ ID NO: 21580 - RNA, 21 nt, Artificial Sequence
  RNA Oligomer
acugauugguucaaaaaaugg

SEQ ID NO: 21581 - RNA, 21 nt, Artificial Sequence
  RNA Oligomer
aggacucacaagggaaaagca

SEQ ID NO: 21582 - RNA, 21 nt, Artificial Sequence
  RNA Oligomer
cuguuugcggauaggauaggg

SEQ ID NO: 21583 - RNA, 21 nt, Artificial Sequence
  RNA Oligomer
cauaaugcuaauugcauuagc

SEQ ID NO: 21584 - RNA, 21 nt, Artificial Sequence
  RNA Oligomer
guuaaguuguacagaacaucg

SEQ ID NO: 21585 - RNA, 21 nt, Artificial Sequence
  RNA Oligomer
uaaguuguacagaacaucguc

SEQ ID NO: 21586 - RNA, 21 nt, Artificial Sequence
  RNA Oligomer
uguccuuugaucacacacacc

SEQ ID NO: 21587 - RNA, 21 nt, Artificial Sequence
  RNA Oligomer
uagaggaaauagcaguucugu

SEQ ID NO: 21588 - RNA, 21 nt, Artificial Sequence
  RNA Oligomer
agaagguauuuuggcaacucu

SEQ ID NO: 21589 - RNA, 21 nt, Artificial Sequence
  RNA Oligomer
auaaggcuuuaagaaggcuug

SEQ ID NO: 21590 - RNA, 21 nt, Artificial Sequence
  RNA Oligomer
uaaggcuuuaagaaggcuugu

SEQ ID NO: 21591 - RNA, 21 nt, Artificial Sequence
  RNA Oligomer
auggcaacgcuucauucggga

SEQ ID NO: 21592 - RNA, 21 nt, Artificial Sequence
  RNA Oligomer
gugaugggagucagcuucuuc

SEQ ID NO: 21593 - RNA, 21 nt, Artificial Sequence
  RNA Oligomer
cuucuucuccuucaguuucuc

SEQ ID NO: 21594 - RNA, 21 nt, Artificial Sequence
  RNA Oligomer
ucuccuucaguuucucgaucg

SEQ ID NO: 21595 - RNA, 21 nt, Artificial Sequence
  RNA Oligomer
uaguucccacuaggaugaugg

SEQ ID NO: 21596 - RNA, 21 nt, Artificial Sequence
  RNA Oligomer
cauacaugcaaaacauaaugc

SEQ ID NO: 21597 - RNA, 21 nt, Artificial Sequence
  RNA Oligomer
uaaagagggucaguauugguc

SEQ ID NO: 21598 - RNA, 21 nt, Artificial Sequence
  RNA Oligomer
ucaguauuggucaagugacag

SEQ ID NO: 21599 - RNA, 21 nt, Artificial Sequence
  RNA Oligomer
aaagcuggucagaaaacucgc

SEQ ID NO: 21600 - RNA, 21 nt, Artificial Sequence
  RNA Oligomer
acaaagacugauccaaagagc

SEQ ID NO: 21601 - RNA, 21 nt, Artificial Sequence
  RNA Oligomer
caauggcaacgcuucauucgg

SEQ ID NO: 21602 - RNA, 21 nt, Artificial Sequence
  RNA Oligomer
uucagaagguauuuuggcaac

SEQ ID NO: 21603 - RNA, 21 nt, Artificial Sequence
  RNA Oligomer
aauaaggcuuuaagaaggcuu

SEQ ID NO: 21604 - RNA, 21 nt, Artificial Sequence
  RNA Oligomer
aguauuggucaagugacagug

SEQ ID NO: 21605 - RNA, 21 nt, Artificial Sequence
  RNA Oligomer
guucugcuuuacgcaucugag

SEQ ID NO: 21606 - RNA, 21 nt, Artificial Sequence
  RNA Oligomer
uaagaaggcuugucauuuuag

SEQ ID NO: 21607 - RNA, 21 nt, Artificial Sequence
  RNA Oligomer
uaauagaaugugagucugaac

SEQ ID NO: 21608 - RNA, 21 nt, Artificial Sequence
  RNA Oligomer
acaacagcaggcauuuucucu

SEQ ID NO: 21609 - RNA, 21 nt, Artificial Sequence
  RNA Oligomer
aaguuguacagaacaucguca

SEQ ID NO: 21610 - RNA, 21 nt, Artificial Sequence
  RNA Oligomer
uuggucaagugacagugucgg

SEQ ID NO: 21611 - RNA, 21 nt, Artificial Sequence
  RNA Oligomer
aaucuccgcaaaagcugguca

SEQ ID NO: 21612 - RNA, 21 nt, Artificial Sequence
  RNA Oligomer
uggugaguucaauggcaacgc

SEQ ID NO: 21613 - RNA, 21 nt, Artificial Sequence
  RNA Oligomer
uguaguucagaagguauuuug

SEQ ID NO: 21614 - RNA, 21 nt, Artificial Sequence
  RNA Oligomer
aucaguaggcaaguuuuaccu

SEQ ID NO: 21615 - RNA, 21 nt, Artificial Sequence
  RNA Oligomer
aaugugagucugaacucuuac

SEQ ID NO: 21616 - RNA, 21 nt, Artificial Sequence
  RNA Oligomer
aaagguuccaagggacaggac

SEQ ID NO: 21617 - RNA, 21 nt, Artificial Sequence
  RNA Oligomer
cagcaggcauuuucucuuccu

SEQ ID NO: 21618 - RNA, 21 nt, Artificial Sequence
  RNA Oligomer
gaucgcuucgucaaacacugu

SEQ ID NO: 21619 - RNA, 21 nt, Artificial Sequence
  RNA Oligomer
uuaaguuguacagaacaucgu

SEQ ID NO: 21620 - RNA, 21 nt, Artificial Sequence
  RNA Oligomer
cagcacuagcacaguuuacag

SEQ ID NO: 21621 - RNA, 21 nt, Artificial Sequence
  RNA Oligomer
gacccaaaggaacaucaauag

SEQ ID NO: 21622 - RNA, 21 nt, Artificial Sequence
  RNA Oligomer
aagacagugauguuaagaagg

SEQ ID NO: 21623 - RNA, 21 nt, Artificial Sequence
  RNA Oligomer
gaauuaaaugcccaauuuggg

SEQ ID NO: 21624 - RNA, 21 nt, Artificial Sequence
  RNA Oligomer
uuagaggaaauagcaguucug

SEQ ID NO: 21625 - RNA, 21 nt, Artificial Sequence
  RNA Oligomer
aucuccgcaaaagcuggucag

SEQ ID NO: 21626 - RNA, 21 nt, Artificial Sequence
  RNA Oligomer
aaagacugauccaaagagcug

SEQ ID NO: 21627 - RNA, 21 nt, Artificial Sequence
  RNA Oligomer
uaggagagcaagugucugcac

SEQ ID NO: 21628 - RNA, 21 nt, Artificial Sequence
  RNA Oligomer
gaacaucgucagcacuagcac

SEQ ID NO: 21629 - RNA, 21 nt, Artificial Sequence
  RNA Oligomer
aaccucacagacccaaaggaa

SEQ ID NO: 21630 - RNA, 21 nt, Artificial Sequence
  RNA Oligomer
aaagagggucaguauugguca

SEQ ID NO: 21631 - RNA, 21 nt, Artificial Sequence
  RNA Oligomer
ugaauuaaaugcccaauuugg

SEQ ID NO: 21632 - RNA, 21 nt, Artificial Sequence
  RNA Oligomer
aggaaauagcaguucuguuca

SEQ ID NO: 21633 - RNA, 21 nt, Artificial Sequence
  RNA Oligomer
aaaucuccgcaaaagcugguc

SEQ ID NO: 21634 - RNA, 21 nt, Artificial Sequence
  RNA Oligomer
caaagacugauccaaagagcu

SEQ ID NO: 21635 - RNA, 21 nt, Artificial Sequence
  RNA Oligomer
cucacuggugaguucaauggc

SEQ ID NO: 21636 - RNA, 21 nt, Artificial Sequence
  RNA Oligomer
cagaagguauuuuggcaacuc

SEQ ID NO: 21637 - RNA, 21 nt, Artificial Sequence
  RNA Oligomer
aggcuuuaagaaggcuuguca

SEQ ID NO: 21638 - RNA, 21 nt, Artificial Sequence
  RNA Oligomer
agaaggcuugucauuuuaggg

SEQ ID NO: 21639 - RNA, 21 nt, Artificial Sequence
  RNA Oligomer
aggugaugggagucagcuucu

SEQ ID NO: 21640 - RNA, 21 nt, Artificial Sequence
  RNA Oligomer
ccuaagaucaaguuuaguucc

SEQ ID NO: 21641 - RNA, 21 nt, Artificial Sequence
  RNA Oligomer
gcaaaacauaaugcuaauugc

SEQ ID NO: 21642 - RNA, 21 nt, Artificial Sequence
  RNA Oligomer
uauucucgccagugaguuaag

SEQ ID NO: 21643 - RNA, 21 nt, Artificial Sequence
  RNA Oligomer
uggucaagugacagugucggu

SEQ ID NO: 21644 - RNA, 21 nt, Artificial Sequence
  RNA Oligomer
uggucagaaaacucgcuauga

SEQ ID NO: 21645 - RNA, 21 nt, Artificial Sequence
  RNA Oligomer
auagaaugugagucugaacuc

SEQ ID NO: 21646 - RNA, 21 nt, Artificial Sequence
  RNA Oligomer
aaaaguuggcauugagugcga

SEQ ID NO: 21647 - RNA, 21 nt, Artificial Sequence
  RNA Oligomer
uaggugaugggagucagcuuc

SEQ ID NO: 21648 - RNA, 21 nt, Artificial Sequence
  RNA Oligomer
cccuaagaucaaguuuaguuc

SEQ ID NO: 21649 - RNA, 21 nt, Artificial Sequence
  RNA Oligomer
acccaaaggaacaucaauagg

SEQ ID NO: 21650 - RNA, 21 nt, Artificial Sequence
  RNA Oligomer
ucuucauuagaggaaauagca

SEQ ID NO: 21651 - RNA, 21 nt, Artificial Sequence
  RNA Oligomer
auagcaguucuguucaaaauc

SEQ ID NO: 21652 - RNA, 21 nt, Artificial Sequence
  RNA Oligomer
aaagagcugagcugcuacgcu

SEQ ID NO: 21653 - RNA, 21 nt, Artificial Sequence
  RNA Oligomer
uuguguaacugaucaguaggc

SEQ ID NO: 21654 - RNA, 21 nt, Artificial Sequence
  RNA Oligomer
aagugucugcaccuccuaacu

SEQ ID NO: 21655 - RNA, 21 nt, Artificial Sequence
  RNA Oligomer
cucaaagacgaaggucuuugc

SEQ ID NO: 21656 - RNA, 21 nt, Artificial Sequence
  RNA Oligomer
ggucuuugcaaaguucagugc

SEQ ID NO: 21657 - RNA, 21 nt, Artificial Sequence
  RNA Oligomer
gaugggagucagcuucuucuc

SEQ ID NO: 21658 - RNA, 21 nt, Artificial Sequence
  RNA Oligomer
aucaaguuuaguucccacuag

SEQ ID NO: 21659 - RNA, 21 nt, Artificial Sequence
  RNA Oligomer
uucucgccagugaguuaaguu

SEQ ID NO: 21660 - RNA, 21 nt, Artificial Sequence
  RNA Oligomer
uucuucauuagaggaaauagc

SEQ ID NO: 21661 - RNA, 21 nt, Artificial Sequence
  RNA Oligomer
guuguguaacugaucaguagg

SEQ ID NO: 21662 - RNA, 21 nt, Artificial Sequence
  RNA Oligomer
uacauaggagagcaagugucu

SEQ ID NO: 21663 - RNA, 21 nt, Artificial Sequence
  RNA Oligomer
gucuuugcaaaguucagugcu

SEQ ID NO: 21664 - RNA, 21 nt, Artificial Sequence
  RNA Oligomer
aaggcuugucauuuuagggcu

SEQ ID NO: 21665 - RNA, 21 nt, Artificial Sequence
  RNA Oligomer
caaagguuccaagggacagga

SEQ ID NO: 21666 - RNA, 21 nt, Artificial Sequence
  RNA Oligomer
accaaucuccuuagccauggc

SEQ ID NO: 21667 - RNA, 21 nt, Artificial Sequence
  RNA Oligomer
cuaagaucaaguuuaguuccc

SEQ ID NO: 21668 - RNA, 21 nt, Artificial Sequence
  RNA Oligomer
ucuguuguaguggcugaaggg

SEQ ID NO: 21669 - RNA, 21 nt, Artificial Sequence
  RNA Oligomer
agggucaguauuggucaagug

SEQ ID NO: 21670 - RNA, 21 nt, Artificial Sequence
  RNA Oligomer
uaaucuggcaagacagugaug

SEQ ID NO: 21671 - RNA, 21 nt, Artificial Sequence
  RNA Oligomer
aucaucuacugcauuugacag

SEQ ID NO: 21672 - RNA, 21 nt, Artificial Sequence
  RNA Oligomer
aacagaauucuucauuagagg

SEQ ID NO: 21673 - RNA, 21 nt, Artificial Sequence
  RNA Oligomer
cuucauuagaggaaauagcag

SEQ ID NO: 21674 - RNA, 21 nt, Artificial Sequence
  RNA Oligomer
aagcuggucagaaaacucgcu

SEQ ID NO: 21675 - RNA, 21 nt, Artificial Sequence
  RNA Oligomer
acucacuggugaguucaaugg

SEQ ID NO: 21676 - RNA, 21 nt, Artificial Sequence
  RNA Oligomer
gucuucucaaagacgaagguc

SEQ ID NO: 21677 - RNA, 21 nt, Artificial Sequence
  RNA Oligomer
ucaaagacgaaggucuuugca

SEQ ID NO: 21678 - RNA, 21 nt, Artificial Sequence
  RNA Oligomer
acgaaggucuuugcaaaguuc

SEQ ID NO: 21679 - RNA, 21 nt, Artificial Sequence
  RNA Oligomer
aggucuuugcaaaguucagug

SEQ ID NO: 21680 - RNA, 21 nt, Artificial Sequence
  RNA Oligomer
uucucggcacaacaaugcagu

SEQ ID NO: 21681 - RNA, 21 nt, Artificial Sequence
  RNA Oligomer
uagaaugugagucugaacucu

SEQ ID NO: 21682 - RNA, 21 nt, Artificial Sequence
  RNA Oligomer
aucccuaagaucaaguuuagu

SEQ ID NO: 21683 - RNA, 21 nt, Artificial Sequence
  RNA Oligomer
ucaaguuuaguucccacuagg

SEQ ID NO: 21684 - RNA, 21 nt, Artificial Sequence
  RNA Oligomer
guuguacagaacaucgucagc

SEQ ID NO: 21685 - RNA, 21 nt, Artificial Sequence
  RNA Oligomer
aauacaaggaggcauauugcu

SEQ ID NO: 21686 - RNA, 21 nt, Artificial Sequence
  RNA Oligomer
uacaaggaggcauauugcuca

SEQ ID NO: 21687 - RNA, 21 nt, Artificial Sequence
  RNA Oligomer
caauguuaugucgggaacacg

SEQ ID NO: 21688 - RNA, 21 nt, Artificial Sequence
  RNA Oligomer
acuacauaggagagcaagugu

SEQ ID NO: 21689 - RNA, 21 nt, Artificial Sequence
  RNA Oligomer
auaggagagcaagugucugca

SEQ ID NO: 21690 - RNA, 21 nt, Artificial Sequence
  RNA Oligomer
ucucggcacaacaaugcagug

SEQ ID NO: 21691 - RNA, 21 nt, Artificial Sequence
  RNA Oligomer
ggcgcuuuugaaaaauaaggc

SEQ ID NO: 21692 - RNA, 21 nt, Artificial Sequence
  RNA Oligomer
gaaggcuugucauuuuagggc

SEQ ID NO: 21693 - RNA, 21 nt, Artificial Sequence
  RNA Oligomer
aaaguuggcauugagugcgaa

SEQ ID NO: 21694 - RNA, 21 nt, Artificial Sequence
  RNA Oligomer
caucccuaagaucaaguuuag

SEQ ID NO: 21695 - RNA, 21 nt, Artificial Sequence
  RNA Oligomer
caaguuuaguucccacuagga

SEQ ID NO: 21696 - RNA, 21 nt, Artificial Sequence
  RNA Oligomer
auucuguuguaguggcugaag

SEQ ID NO: 21697 - RNA, 21 nt, Artificial Sequence
  RNA Oligomer
aguuguacagaacaucgucag

SEQ ID NO: 21698 - RNA, 21 nt, Artificial Sequence
  RNA Oligomer
aaucuggcaagacagugaugu

SEQ ID NO: 21699 - RNA, 21 nt, Artificial Sequence
  RNA Oligomer
caagacagugauguuaagaag

SEQ ID NO: 21700 - RNA, 21 nt, Artificial Sequence
  RNA Oligomer
auacaaggaggcauauugcuc

SEQ ID NO: 21701 - RNA, 21 nt, Artificial Sequence
  RNA Oligomer
uuccuuguacaauguagugua

SEQ ID NO: 21702 - RNA, 21 nt, Artificial Sequence
  RNA Oligomer
aacucacuggugaguucaaug

SEQ ID NO: 21703 - RNA, 21 nt, Artificial Sequence
  RNA Oligomer
gcgcuuuugaaaaauaaggcu

SEQ ID NO: 21704 - RNA, 21 nt, Artificial Sequence
  RNA Oligomer
uuuaguucccacuaggaugau

SEQ ID NO: 21705 - RNA, 21 nt, Artificial Sequence
  RNA Oligomer
uccuuguacaauguaguguaa

SEQ ID NO: 21706 - RNA, 21 nt, Artificial Sequence
  RNA Oligomer
uagcaguucuguucaaaaucu

SEQ ID NO: 21707 - RNA, 21 nt, Artificial Sequence
  RNA Oligomer
caaaaucuccgcaaaagcugg

SEQ ID NO: 21708 - RNA, 21 nt, Artificial Sequence
  RNA Oligomer
uuaugucgggaacacgugcug

SEQ ID NO: 21709 - RNA, 21 nt, Artificial Sequence
  RNA Oligomer
aacugaucaguaggcaaguuu

SEQ ID NO: 21710 - RNA, 21 nt, Artificial Sequence
  RNA Oligomer
aaaaaguuggcauugagugcg

SEQ ID NO: 21711 - RNA, 21 nt, Artificial Sequence
  RNA Oligomer
gcauuagcaaaagaucaaugu

SEQ ID NO: 21712 - RNA, 21 nt, Artificial Sequence
  RNA Oligomer
uucuguuguaguggcugaagg

SEQ ID NO: 21713 - RNA, 21 nt, Artificial Sequence
  RNA Oligomer
aagggucccacgcuguauucu

SEQ ID NO: 21714 - RNA, 21 nt, Artificial Sequence
  RNA Oligomer
cucgccagugaguuaaguugu

SEQ ID NO: 21715 - RNA, 21 nt, Artificial Sequence
  RNA Oligomer
agugacagugucgguaaucug

SEQ ID NO: 21716 - RNA, 21 nt, Artificial Sequence
  RNA Oligomer
gugacagugucgguaaucugg

SEQ ID NO: 21717 - RNA, 21 nt, Artificial Sequence
  RNA Oligomer
ugacagugucgguaaucuggc

SEQ ID NO: 21718 - RNA, 21 nt, Artificial Sequence
  RNA Oligomer
cuaguuacuagaaaacuaagg

SEQ ID NO: 21719 - RNA, 21 nt, Artificial Sequence
  RNA Oligomer
acagaauucuucauuagagga

SEQ ID NO: 21720 - RNA, 21 nt, Artificial Sequence
  RNA Oligomer
aaaaucuccgcaaaagcuggu

SEQ ID NO: 21721 - RNA, 21 nt, Artificial Sequence
  RNA Oligomer
ugauccaaagagcugagcugc

SEQ ID NO: 21722 - RNA, 21 nt, Artificial Sequence
  RNA Oligomer
uguuaugucgggaacacgugc

SEQ ID NO: 21723 - RNA, 21 nt, Artificial Sequence
  RNA Oligomer
acgugcugcuaacucacuggu

SEQ ID NO: 21724 - RNA, 21 nt, Artificial Sequence
  RNA Oligomer
cauaggagagcaagugucugc

SEQ ID NO: 21725 - RNA, 21 nt, Artificial Sequence
  RNA Oligomer
ugucugcaccuccuaacugca

SEQ ID NO: 21726 - RNA, 21 nt, Artificial Sequence
  RNA Oligomer
aagacgaaggucuuugcaaag

SEQ ID NO: 21727 - RNA, 21 nt, Artificial Sequence
  RNA Oligomer
ugcauuagcaaaagaucaaug

SEQ ID NO: 21728 - RNA, 21 nt, Artificial Sequence
  RNA Oligomer
acagugauguuaagaagguuc

SEQ ID NO: 21729 - RNA, 21 nt, Artificial Sequence
  RNA Oligomer
aaggaggcauauugcucaguc

SEQ ID NO: 21730 - RNA, 21 nt, Artificial Sequence
  RNA Oligomer
agcaguucuguucaaaaucuc

SEQ ID NO: 21731 - RNA, 21 nt, Artificial Sequence
  RNA Oligomer
auguuaugucgggaacacgug

SEQ ID NO: 21732 - RNA, 21 nt, Artificial Sequence
  RNA Oligomer
uguguaacugaucaguaggca

SEQ ID NO: 21733 - RNA, 21 nt, Artificial Sequence
  RNA Oligomer
agcuaccgucuucucaaagac

SEQ ID NO: 21734 - RNA, 21 nt, Artificial Sequence
  RNA Oligomer
uucaaaaucuccgcaaaagcu

SEQ ID NO: 21735 - RNA, 21 nt, Artificial Sequence
  RNA Oligomer
aauguuaugucgggaacacgu

SEQ ID NO: 21736 - RNA, 21 nt, Artificial Sequence
  RNA Oligomer
guguucucggcacaacaaugc

SEQ ID NO: 21737 - RNA, 21 nt, Artificial Sequence
  RNA Oligomer
uguucucggcacaacaaugca

SEQ ID NO: 21738 - RNA, 21 nt, Artificial Sequence
  RNA Oligomer
aaguuggcauugagugcgaag

SEQ ID NO: 21739 - RNA, 21 nt, Artificial Sequence
  RNA Oligomer
ucaccgguuuuccaucuacca

SEQ ID NO: 21740 - RNA, 21 nt, Artificial Sequence
  RNA Oligomer
acaaggaggcauauugcucag

SEQ ID NO: 21741 - RNA, 21 nt, Artificial Sequence
  RNA Oligomer
uccaaagagcugagcugcuac

SEQ ID NO: 21742 - RNA, 21 nt, Artificial Sequence
  RNA Oligomer
uacaauguuaugucgggaaca

SEQ ID NO: 21743 - RNA, 21 nt, Artificial Sequence
  RNA Oligomer
gugucgguaaucuggcaagac

SEQ ID NO: 21744 - RNA, 21 nt, Artificial Sequence
  RNA Oligomer
aucuggcaagacagugauguu

SEQ ID NO: 21745 - RNA, 21 nt, Artificial Sequence
  RNA Oligomer
aguucccacuaggaugauggg

SEQ ID NO: 21746 - RNA, 21 nt, Artificial Sequence
  RNA Oligomer
aagggacaggaccaagaacga

SEQ ID NO: 21747 - RNA, 21 nt, Artificial Sequence
  RNA Oligomer
aaucuccuuagccauggcuag

SEQ ID NO: 21748 - RNA, 21 nt, Artificial Sequence
  RNA Oligomer
aggaggcauauugcucaguca

SEQ ID NO: 21749 - RNA, 21 nt, Artificial Sequence
  RNA Oligomer
ggagaacccaauguuucguau

SEQ ID NO: 21750 - RNA, 21 nt, Artificial Sequence
  RNA Oligomer
ggagaaauauaucgcuuguuu

SEQ ID NO: 21751 - RNA, 21 nt, Artificial Sequence
  RNA Oligomer
ccacaagaagucagcuauaca

SEQ ID NO: 21752 - RNA, 21 nt, Artificial Sequence
  RNA Oligomer
gcaugaaaguuagcagagaca

SEQ ID NO: 21753 - RNA, 21 nt, Artificial Sequence
  RNA Oligomer
gcauuuaucguuaaccuaaca

SEQ ID NO: 21754 - RNA, 21 nt, Artificial Sequence
  RNA Oligomer
ccaaaugucaaacuaccaaau

SEQ ID NO: 21755 - RNA, 21 nt, Artificial Sequence
  RNA Oligomer
ggagaacuuaaugcugcauuu

SEQ ID NO: 21756 - RNA, 21 nt, Artificial Sequence
  RNA Oligomer
gagaacccaauguuucguaua

SEQ ID NO: 21757 - RNA, 21 nt, Artificial Sequence
  RNA Oligomer
ccauccuuauuccuccucaug

SEQ ID NO: 21758 - RNA, 21 nt, Artificial Sequence
  RNA Oligomer
accauccuuauuccuccucau

SEQ ID NO: 21759 - RNA, 21 nt, Artificial Sequence
  RNA Oligomer
cccaaaugucaaacuaccaaa

SEQ ID NO: 21760 - RNA, 21 nt, Artificial Sequence
  RNA Oligomer
ccaauguuucguauaucuguu

SEQ ID NO: 21761 - RNA, 21 nt, Artificial Sequence
  RNA Oligomer
cgaucugucuugaaggagaaa

SEQ ID NO: 21762 - RNA, 21 nt, Artificial Sequence
  RNA Oligomer
ccgaucugucuugaaggagaa

SEQ ID NO: 21763 - RNA, 21 nt, Artificial Sequence
  RNA Oligomer
gaacccaauguuucguauauc

SEQ ID NO: 21764 - RNA, 21 nt, Artificial Sequence
  RNA Oligomer
agaacccaauguuucguauau

SEQ ID NO: 21765 - RNA, 21 nt, Artificial Sequence
  RNA Oligomer
aggagaaauauaucgcuuguu

SEQ ID NO: 21766 - RNA, 21 nt, Artificial Sequence
  RNA Oligomer
caagaaaguauugcaggacaa

SEQ ID NO: 21767 - RNA, 21 nt, Artificial Sequence
  RNA Oligomer
gcuaccauccuuauuccuccu

SEQ ID NO: 21768 - RNA, 21 nt, Artificial Sequence
  RNA Oligomer
gggagaacuuaaugcugcauu

SEQ ID NO: 21769 - RNA, 21 nt, Artificial Sequence
  RNA Oligomer
ggaucaguugguagaaauaau

SEQ ID NO: 21770 - RNA, 21 nt, Artificial Sequence
  RNA Oligomer
gcaggacaagagauuuaagaa

SEQ ID NO: 21771 - RNA, 21 nt, Artificial Sequence
  RNA Oligomer
ugaaggagaaauauaucgcuu

SEQ ID NO: 21772 - RNA, 21 nt, Artificial Sequence
  RNA Oligomer
cuaccauccuuauuccuccuc

SEQ ID NO: 21773 - RNA, 21 nt, Artificial Sequence
  RNA Oligomer
cucuucaacuucaccacucaa

SEQ ID NO: 21774 - RNA, 21 nt, Artificial Sequence
  RNA Oligomer
gcugcauuuaucguuaaccua

SEQ ID NO: 21775 - RNA, 21 nt, Artificial Sequence
  RNA Oligomer
gagaacuuaaugcugcauuua

SEQ ID NO: 21776 - RNA, 21 nt, Artificial Sequence
  RNA Oligomer
caauguuucguauaucuguuc

SEQ ID NO: 21777 - RNA, 21 nt, Artificial Sequence
  RNA Oligomer
acccaauguuucguauaucug

SEQ ID NO: 21778 - RNA, 21 nt, Artificial Sequence
  RNA Oligomer
ccggaaacaguauacagaguu

SEQ ID NO: 21779 - RNA, 21 nt, Artificial Sequence
  RNA Oligomer
gaaggagaaauauaucgcuug

SEQ ID NO: 21780 - RNA, 21 nt, Artificial Sequence
  RNA Oligomer
ucauuuggugugguauaucaa

SEQ ID NO: 21781 - RNA, 21 nt, Artificial Sequence
  RNA Oligomer
acaccugcacucuucaacuuc

SEQ ID NO: 21782 - RNA, 21 nt, Artificial Sequence
  RNA Oligomer
acacaccugcacucuucaacu

SEQ ID NO: 21783 - RNA, 21 nt, Artificial Sequence
  RNA Oligomer
guggaucaguugguagaaaua

SEQ ID NO: 21784 - RNA, 21 nt, Artificial Sequence
  RNA Oligomer
cccaauguuucguauaucugu

SEQ ID NO: 21785 - RNA, 21 nt, Artificial Sequence
  RNA Oligomer
gucuugaaggagaaauauauc

SEQ ID NO: 21786 - RNA, 21 nt, Artificial Sequence
  RNA Oligomer
cugucuugaaggagaaauaua

SEQ ID NO: 21787 - RNA, 21 nt, Artificial Sequence
  RNA Oligomer
acaagaagucagcuauacaga

SEQ ID NO: 21788 - RNA, 21 nt, Artificial Sequence
  RNA Oligomer
caugaaaguuagcagagacaa

SEQ ID NO: 21789 - RNA, 21 nt, Artificial Sequence
  RNA Oligomer
gcacucuucaacuucaccacu

SEQ ID NO: 21790 - RNA, 21 nt, Artificial Sequence
  RNA Oligomer
cacaccugcacucuucaacuu

SEQ ID NO: 21791 - RNA, 21 nt, Artificial Sequence
  RNA Oligomer
caaaugucaaacuaccaaaug

SEQ ID NO: 21792 - RNA, 21 nt, Artificial Sequence
  RNA Oligomer
auacaccaacugcccgacuaa

SEQ ID NO: 21793 - RNA, 21 nt, Artificial Sequence
  RNA Oligomer
gaaauaaucaagguccuggga

SEQ ID NO: 21794 - RNA, 21 nt, Artificial Sequence
  RNA Oligomer
aacccaauguuucguauaucu

SEQ ID NO: 21795 - RNA, 21 nt, Artificial Sequence
  RNA Oligomer
ggucgccaucaagaaaguauu

SEQ ID NO: 21796 - RNA, 21 nt, Artificial Sequence
  RNA Oligomer
ggaucauuuggugugguauau

SEQ ID NO: 21797 - RNA, 21 nt, Artificial Sequence
  RNA Oligomer
ucugucuugaaggagaaauau

SEQ ID NO: 21798 - RNA, 21 nt, Artificial Sequence
  RNA Oligomer
aucugucuugaaggagaaaua

SEQ ID NO: 21799 - RNA, 21 nt, Artificial Sequence
  RNA Oligomer
gaaaguuagcagagacaagga

SEQ ID NO: 21800 - RNA, 21 nt, Artificial Sequence
  RNA Oligomer
ggaaaaggugauucgcgaaga

SEQ ID NO: 21801 - RNA, 21 nt, Artificial Sequence
  RNA Oligomer
accugcacucuucaacuucac

SEQ ID NO: 21802 - RNA, 21 nt, Artificial Sequence
  RNA Oligomer
gcuugugcacauucauuuuuu

SEQ ID NO: 21803 - RNA, 21 nt, Artificial Sequence
  RNA Oligomer
ccaacaagggagcaaaucaga

SEQ ID NO: 21804 - RNA, 21 nt, Artificial Sequence
  RNA Oligomer
ggucuaucuuaaucuggugcu

SEQ ID NO: 21805 - RNA, 21 nt, Artificial Sequence
  RNA Oligomer
gaggucuaucuuaaucuggug

SEQ ID NO: 21806 - RNA, 21 nt, Artificial Sequence
  RNA Oligomer
auguuaaauauccgugccgau

SEQ ID NO: 21807 - RNA, 21 nt, Artificial Sequence
  RNA Oligomer
ucacuguaacauaguccgauu

SEQ ID NO: 21808 - RNA, 21 nt, Artificial Sequence
  RNA Oligomer
ucaagaaaguauugcaggaca

SEQ ID NO: 21809 - RNA, 21 nt, Artificial Sequence
  RNA Oligomer
gccaucaagaaaguauugcag

SEQ ID NO: 21810 - RNA, 21 nt, Artificial Sequence
  RNA Oligomer
gcgaagagagugaucauguca

SEQ ID NO: 21811 - RNA, 21 nt, Artificial Sequence
  RNA Oligomer
acucuucaacuucaccacuca

SEQ ID NO: 21812 - RNA, 21 nt, Artificial Sequence
  RNA Oligomer
cugcauuuaucguuaaccuaa

SEQ ID NO: 21813 - RNA, 21 nt, Artificial Sequence
  RNA Oligomer
cacuggaagcuugugcacauu

SEQ ID NO: 21814 - RNA, 21 nt, Artificial Sequence
  RNA Oligomer
ugggagaacuuaaugcugcau

SEQ ID NO: 21815 - RNA, 21 nt, Artificial Sequence
  RNA Oligomer
guagaaauaaucaagguccug

SEQ ID NO: 21816 - RNA, 21 nt, Artificial Sequence
  RNA Oligomer
gguagaaauaaucaagguccu

SEQ ID NO: 21817 - RNA, 21 nt, Artificial Sequence
  RNA Oligomer
gcugagcuguuacuaggacaa

SEQ ID NO: 21818 - RNA, 21 nt, Artificial Sequence
  RNA Oligomer
cugugauuuaugucaaguugu

SEQ ID NO: 21819 - RNA, 21 nt, Artificial Sequence
  RNA Oligomer
gcucccugugauuuaugucaa

SEQ ID NO: 21820 - RNA, 21 nt, Artificial Sequence
  RNA Oligomer
ccgauugcguuauuucuucua

SEQ ID NO: 21821 - RNA, 21 nt, Artificial Sequence
  RNA Oligomer
uccuuauuccuccucaugcuc

SEQ ID NO: 21822 - RNA, 21 nt, Artificial Sequence
  RNA Oligomer
acccaaaugucaaacuaccaa

SEQ ID NO: 21823 - RNA, 21 nt, Artificial Sequence
  RNA Oligomer
gaacuuaaugcugcauuuauc

SEQ ID NO: 21824 - RNA, 21 nt, Artificial Sequence
  RNA Oligomer
caagggagcaaaucagagaaa

SEQ ID NO: 21825 - RNA, 21 nt, Artificial Sequence
  RNA Oligomer
caguugguagaaauaaucaag

SEQ ID NO: 21826 - RNA, 21 nt, Artificial Sequence
  RNA Oligomer
uguggaucaguugguagaaau

SEQ ID NO: 21827 - RNA, 21 nt, Artificial Sequence
  RNA Oligomer
ggcugagcuguuacuaggaca

SEQ ID NO: 21828 - RNA, 21 nt, Artificial Sequence
  RNA Oligomer
uucguauaucuguucucggua

SEQ ID NO: 21829 - RNA, 21 nt, Artificial Sequence
  RNA Oligomer
cuguauuaaaacucugugacu

SEQ ID NO: 21830 - RNA, 21 nt, Artificial Sequence
  RNA Oligomer
gcuguauuaaaacucugugac

SEQ ID NO: 21831 - RNA, 21 nt, Artificial Sequence
  RNA Oligomer
agacgcucccugugauuuaug

SEQ ID NO: 21832 - RNA, 21 nt, Artificial Sequence
  RNA Oligomer
cggaaacaguauacagaguug

SEQ ID NO: 21833 - RNA, 21 nt, Artificial Sequence
  RNA Oligomer
gucuaucuuaaucuggugcug

SEQ ID NO: 21834 - RNA, 21 nt, Artificial Sequence
  RNA Oligomer
ccaucaagaaaguauugcagg

SEQ ID NO: 21835 - RNA, 21 nt, Artificial Sequence
  RNA Oligomer
gaaaaggugauucgcgaagag

SEQ ID NO: 21836 - RNA, 21 nt, Artificial Sequence
  RNA Oligomer
agaccaauaaugcugcuucug

SEQ ID NO: 21837 - RNA, 21 nt, Artificial Sequence
  RNA Oligomer
ccucuggcuaccauccuuauu

SEQ ID NO: 21838 - RNA, 21 nt, Artificial Sequence
  RNA Oligomer
caacuucaccacucaagaacu

SEQ ID NO: 21839 - RNA, 21 nt, Artificial Sequence
  RNA Oligomer
ugcauuuaucguuaaccuaac

SEQ ID NO: 21840 - RNA, 21 nt, Artificial Sequence
  RNA Oligomer
ugcugcauuuaucguuaaccu

SEQ ID NO: 21841 - RNA, 21 nt, Artificial Sequence
  RNA Oligomer
uggaagcuugugcacauucau

SEQ ID NO: 21842 - RNA, 21 nt, Artificial Sequence
  RNA Oligomer
guauacaccaacugcccgacu

SEQ ID NO: 21843 - RNA, 21 nt, Artificial Sequence
  RNA Oligomer
acccaaacuacacagaauuua

SEQ ID NO: 21844 - RNA, 21 nt, Artificial Sequence
  RNA Oligomer
gugggagaacuuaaugcugca

SEQ ID NO: 21845 - RNA, 21 nt, Artificial Sequence
  RNA Oligomer
acaagggagcaaaucagagaa

SEQ ID NO: 21846 - RNA, 21 nt, Artificial Sequence
  RNA Oligomer
gaucaguugguagaaauaauc

SEQ ID NO: 21847 - RNA, 21 nt, Artificial Sequence
  RNA Oligomer
uggaucaguugguagaaauaa

SEQ ID NO: 21848 - RNA, 21 nt, Artificial Sequence
  RNA Oligomer
gguguggaucaguugguagaa

SEQ ID NO: 21849 - RNA, 21 nt, Artificial Sequence
  RNA Oligomer
ggauagugguguggaucaguu

SEQ ID NO: 21850 - RNA, 21 nt, Artificial Sequence
  RNA Oligomer
gggauagugguguggaucagu

SEQ ID NO: 21851 - RNA, 21 nt, Artificial Sequence
  RNA Oligomer
uaaaacucugugacuuuggaa

SEQ ID NO: 21852 - RNA, 21 nt, Artificial Sequence
  RNA Oligomer
ugcuguauuaaaacucuguga

SEQ ID NO: 21853 - RNA, 21 nt, Artificial Sequence
  RNA Oligomer
gucaaguuguauauguaucag

SEQ ID NO: 21854 - RNA, 21 nt, Artificial Sequence
  RNA Oligomer
gucgccaucaagaaaguauug

SEQ ID NO: 21855 - RNA, 21 nt, Artificial Sequence
  RNA Oligomer
gugauuggaaauggaucauuu

SEQ ID NO: 21856 - RNA, 21 nt, Artificial Sequence
  RNA Oligomer
ugcacucuucaacuucaccac

SEQ ID NO: 21857 - RNA, 21 nt, Artificial Sequence
  RNA Oligomer
aacccaaacuacacagaauuu

SEQ ID NO: 21858 - RNA, 21 nt, Artificial Sequence
  RNA Oligomer
guguuggcugagcuguuacua

SEQ ID NO: 21859 - RNA, 21 nt, Artificial Sequence
  RNA Oligomer
cugcuguauuaaaacucugug

SEQ ID NO: 21860 - RNA, 21 nt, Artificial Sequence
  RNA Oligomer
cgauugcguuauuucuucuac

SEQ ID NO: 21861 - RNA, 21 nt, Artificial Sequence
  RNA Oligomer
acauaguccgauugcguuauu

SEQ ID NO: 21862 - RNA, 21 nt, Artificial Sequence
  RNA Oligomer
cacuguaacauaguccgauug

SEQ ID NO: 21863 - RNA, 21 nt, Artificial Sequence
  RNA Oligomer
gagaaagcuagaucacuguaa

SEQ ID NO: 21864 - RNA, 21 nt, Artificial Sequence
  RNA Oligomer
caggacaagagauuuaagaau

SEQ ID NO: 21865 - RNA, 21 nt, Artificial Sequence
  RNA Oligomer
guauugcaggacaagagauuu

SEQ ID NO: 21866 - RNA, 21 nt, Artificial Sequence
  RNA Oligomer
gccgaucugucuugaaggaga

SEQ ID NO: 21867 - RNA, 21 nt, Artificial Sequence
  RNA Oligomer
aaggaaaaggugauucgcgaa

SEQ ID NO: 21868 - RNA, 21 nt, Artificial Sequence
  RNA Oligomer
ggaaaaaccaccaguuacuug

SEQ ID NO: 21869 - RNA, 21 nt, Artificial Sequence
  RNA Oligomer
gugcacauucauuuuuugaug

SEQ ID NO: 21870 - RNA, 21 nt, Artificial Sequence
  RNA Oligomer
acgcucccugugauuuauguc

SEQ ID NO: 21871 - RNA, 21 nt, Artificial Sequence
  RNA Oligomer
acacuauagucgagccaaaca

SEQ ID NO: 21872 - RNA, 21 nt, Artificial Sequence
  RNA Oligomer
gagaagaaagaugaggucuau

SEQ ID NO: 21873 - RNA, 21 nt, Artificial Sequence
  RNA Oligomer
ugauuggaaauggaucauuug

SEQ ID NO: 21874 - RNA, 21 nt, Artificial Sequence
  RNA Oligomer
cgcgaagagagugaucauguc

SEQ ID NO: 21875 - RNA, 21 nt, Artificial Sequence
  RNA Oligomer
uccgugccgaucugucuugaa

SEQ ID NO: 21876 - RNA, 21 nt, Artificial Sequence
  RNA Oligomer
gugauucgcgaagagagugau

SEQ ID NO: 21877 - RNA, 21 nt, Artificial Sequence
  RNA Oligomer
guguguuggcugagcuguuac

SEQ ID NO: 21878 - RNA, 21 nt, Artificial Sequence
  RNA Oligomer
ggaaacaguauacagaguugc

SEQ ID NO: 21879 - RNA, 21 nt, Artificial Sequence
  RNA Oligomer
uccaguggugagaagaaagau

SEQ ID NO: 21880 - RNA, 21 nt, Artificial Sequence
  RNA Oligomer
agaacuggucgccaucaagaa

SEQ ID NO: 21881 - RNA, 21 nt, Artificial Sequence
  RNA Oligomer
aaacuuugugauucaggagaa

SEQ ID NO: 21882 - RNA, 21 nt, Artificial Sequence
  RNA Oligomer
gaucauuuggugugguauauc

SEQ ID NO: 21883 - RNA, 21 nt, Artificial Sequence
  RNA Oligomer
uggaucauuuggugugguaua

SEQ ID NO: 21884 - RNA, 21 nt, Artificial Sequence
  RNA Oligomer
ugccgaucugucuugaaggag

SEQ ID NO: 21885 - RNA, 21 nt, Artificial Sequence
  RNA Oligomer
cgaagagagugaucaugucag

SEQ ID NO: 21886 - RNA, 21 nt, Artificial Sequence
  RNA Oligomer
ucgcgaagagagugaucaugu

SEQ ID NO: 21887 - RNA, 21 nt, Artificial Sequence
  RNA Oligomer
gaccguggacagaccaauaau

SEQ ID NO: 21888 - RNA, 21 nt, Artificial Sequence
  RNA Oligomer
cuugugcacauucauuuuuug

SEQ ID NO: 21889 - RNA, 21 nt, Artificial Sequence
  RNA Oligomer
guguggaucaguugguagaaa

SEQ ID NO: 21890 - RNA, 21 nt, Artificial Sequence
  RNA Oligomer
agauguauggucugcuggcug

SEQ ID NO: 21891 - RNA, 21 nt, Artificial Sequence
  RNA Oligomer
cucuuguuggauccugauacu

SEQ ID NO: 21892 - RNA, 21 nt, Artificial Sequence
  RNA Oligomer
accucuuguuggauccugaua

SEQ ID NO: 21893 - RNA, 21 nt, Artificial Sequence
  RNA Oligomer
auggaucauuuggugugguau

SEQ ID NO: 21894 - RNA, 21 nt, Artificial Sequence
  RNA Oligomer
gugacaacagugguggcaacu

SEQ ID NO: 21895 - RNA, 21 nt, Artificial Sequence
  RNA Oligomer
aggugacaacagugguggcaa

SEQ ID NO: 21896 - RNA, 21 nt, Artificial Sequence
  RNA Oligomer
ugauucgcgaagagagugauc

SEQ ID NO: 21897 - RNA, 21 nt, Artificial Sequence
  RNA Oligomer
cuguguguuggcugagcuguu

SEQ ID NO: 21898 - RNA, 21 nt, Artificial Sequence
  RNA Oligomer
guauagauguauggucugcug

SEQ ID NO: 21899 - RNA, 21 nt, Artificial Sequence
  RNA Oligomer
cuaguauagauguauggucug

SEQ ID NO: 21900 - RNA, 21 nt, Artificial Sequence
  RNA Oligomer
uuggauccugauacugcugua

SEQ ID NO: 21901 - RNA, 21 nt, Artificial Sequence
  RNA Oligomer
aaccucuuguuggauccugau

SEQ ID NO: 21902 - RNA, 21 nt, Artificial Sequence
  RNA Oligomer
ugagaagaaagaugaggucua

SEQ ID NO: 21903 - RNA, 21 nt, Artificial Sequence
  RNA Oligomer
uccgauugcguuauuucuucu

SEQ ID NO: 21904 - RNA, 21 nt, Artificial Sequence
  RNA Oligomer
ggagcaaaucagagaaaugaa

SEQ ID NO: 21905 - RNA, 21 nt, Artificial Sequence
  RNA Oligomer
ggacgaagucuuuuucuuuuu

SEQ ID NO: 21906 - RNA, 21 nt, Artificial Sequence
  RNA Oligomer
caguggugagaagaaagauga

SEQ ID NO: 21907 - RNA, 21 nt, Artificial Sequence
  RNA Oligomer
ccaguggugagaagaaagaug

SEQ ID NO: 21908 - RNA, 21 nt, Artificial Sequence
  RNA Oligomer
cauaguccgauugcguuauuu

SEQ ID NO: 21909 - RNA, 21 nt, Artificial Sequence
  RNA Oligomer
cagaucaugagaaagcuagau

SEQ ID NO: 21910 - RNA, 21 nt, Artificial Sequence
  RNA Oligomer
agugauuggaaauggaucauu

SEQ ID NO: 21911 - RNA, 21 nt, Artificial Sequence
  RNA Oligomer
cagcaaggugacaacaguggu

SEQ ID NO: 21912 - RNA, 21 nt, Artificial Sequence
  RNA Oligomer
gcagcaugaaaguuagcagag

SEQ ID NO: 21913 - RNA, 21 nt, Artificial Sequence
  RNA Oligomer
ucaccacucaagaacugucaa

SEQ ID NO: 21914 - RNA, 21 nt, Artificial Sequence
  RNA Oligomer
cgggacccaaaugucaaacua

SEQ ID NO: 21915 - RNA, 21 nt, Artificial Sequence
  RNA Oligomer
gaacccaaacuacacagaauu

SEQ ID NO: 21916 - RNA, 21 nt, Artificial Sequence
  RNA Oligomer
gugguguggaucaguugguag

SEQ ID NO: 21917 - RNA, 21 nt, Artificial Sequence
  RNA Oligomer
agugguguggaucaguuggua

SEQ ID NO: 21918 - RNA, 21 nt, Artificial Sequence
  RNA Oligomer
cuguuccgaaguuuagccuau

SEQ ID NO: 21919 - RNA, 21 nt, Artificial Sequence
  RNA Oligomer
ggugagaagaaagaugagguc

SEQ ID NO: 21920 - RNA, 21 nt, Artificial Sequence
  RNA Oligomer
uggugagaagaaagaugaggu

SEQ ID NO: 21921 - RNA, 21 nt, Artificial Sequence
  RNA Oligomer
gcguuauuucuucuacuccag

SEQ ID NO: 21922 - RNA, 21 nt, Artificial Sequence
  RNA Oligomer
guaacauaguccgauugcguu

SEQ ID NO: 21923 - RNA, 21 nt, Artificial Sequence
  RNA Oligomer
caaguuguauauguaucagcu

SEQ ID NO: 21924 - RNA, 21 nt, Artificial Sequence
  RNA Oligomer
aagugauuggaaauggaucau

SEQ ID NO: 21925 - RNA, 21 nt, Artificial Sequence
  RNA Oligomer
ggcagcaugaaaguuagcaga

SEQ ID NO: 21926 - RNA, 21 nt, Artificial Sequence
  RNA Oligomer
cuaauacuggagaccguggac

SEQ ID NO: 21927 - RNA, 21 nt, Artificial Sequence
  RNA Oligomer
caccucuggcuaccauccuua

SEQ ID NO: 21928 - RNA, 21 nt, Artificial Sequence
  RNA Oligomer
ggaacaggacauuucaccuca

SEQ ID NO: 21929 - RNA, 21 nt, Artificial Sequence
  RNA Oligomer
guccgaggagaacccaauguu

SEQ ID NO: 21930 - RNA, 21 nt, Artificial Sequence
  RNA Oligomer
guuguauauguaucagcuguu

SEQ ID NO: 21931 - RNA, 21 nt, Artificial Sequence
  RNA Oligomer
accucuggcuaccauccuuau

SEQ ID NO: 21932 - RNA, 21 nt, Artificial Sequence
  RNA Oligomer
ggccacaagaagucagcuaua

SEQ ID NO: 21933 - RNA, 21 nt, Artificial Sequence
  RNA Oligomer
aggccacaagaagucagcuau

SEQ ID NO: 21934 - RNA, 21 nt, Artificial Sequence
  RNA Oligomer
ccaauaaugcugcuucugcau

SEQ ID NO: 21935 - RNA, 21 nt, Artificial Sequence
  RNA Oligomer
caaguaauccaccucuggcua

SEQ ID NO: 21936 - RNA, 21 nt, Artificial Sequence
  RNA Oligomer
gggacccaaaugucaaacuac

SEQ ID NO: 21937 - RNA, 21 nt, Artificial Sequence
  RNA Oligomer
gaacuccaacaagggagcaaa

SEQ ID NO: 21938 - RNA, 21 nt, Artificial Sequence
  RNA Oligomer
ggaacuccaacaagggagcaa

SEQ ID NO: 21939 - RNA, 21 nt, Artificial Sequence
  RNA Oligomer
ccgaggagaacccaauguuuc

SEQ ID NO: 21940 - RNA, 21 nt, Artificial Sequence
  RNA Oligomer
cuaaagugauuggaaauggau

SEQ ID NO: 21941 - RNA, 21 nt, Artificial Sequence
  RNA Oligomer
uggcagcaugaaaguuagcag

SEQ ID NO: 21942 - RNA, 21 nt, Artificial Sequence
  RNA Oligomer
gccuucagcuuuuggcagcau

SEQ ID NO: 21943 - RNA, 21 nt, Artificial Sequence
  RNA Oligomer
ccacucaagaacugucaagua

SEQ ID NO: 21944 - RNA, 21 nt, Artificial Sequence
  RNA Oligomer
gaacaggacauuucaccucag

SEQ ID NO: 21945 - RNA, 21 nt, Artificial Sequence
  RNA Oligomer
cccaaacuacacagaauuuaa

SEQ ID NO: 21946 - RNA, 21 nt, Artificial Sequence
  RNA Oligomer
agggagcaaaucagagaaaug

SEQ ID NO: 21947 - RNA, 21 nt, Artificial Sequence
  RNA Oligomer
aggagaacccaauguuucgua

SEQ ID NO: 21948 - RNA, 21 nt, Artificial Sequence
  RNA Oligomer
cguuauuucuucuacuccagu

SEQ ID NO: 21949 - RNA, 21 nt, Artificial Sequence
  RNA Oligomer
ggugugguauaucaagccaaa

SEQ ID NO: 21950 - RNA, 21 nt, Artificial Sequence
  RNA Oligomer
ggauucaagcagcugcuucaa

SEQ ID NO: 21951 - RNA, 21 nt, Artificial Sequence
  RNA Oligomer
cuggcuaccauccuuauuccu

SEQ ID NO: 21952 - RNA, 21 nt, Artificial Sequence
  RNA Oligomer
ggaagcuugugcacauucauu

SEQ ID NO: 21953 - RNA, 21 nt, Artificial Sequence
  RNA Oligomer
acaggacauuucaccucagga

SEQ ID NO: 21954 - RNA, 21 nt, Artificial Sequence
  RNA Oligomer
ggacuaaggauucgucaggaa

SEQ ID NO: 21955 - RNA, 21 nt, Artificial Sequence
  RNA Oligomer
ugaacccaaacuacacagaau

SEQ ID NO: 21956 - RNA, 21 nt, Artificial Sequence
  RNA Oligomer
uccgaggagaacccaauguuu

SEQ ID NO: 21957 - RNA, 21 nt, Artificial Sequence
  RNA Oligomer
ccugauacugcuguauuaaaa

SEQ ID NO: 21958 - RNA, 21 nt, Artificial Sequence
  RNA Oligomer
gaggacgaagucuuuuucuuu

SEQ ID NO: 21959 - RNA, 21 nt, Artificial Sequence
  RNA Oligomer
ccaagaggacgaagucuuuuu

SEQ ID NO: 21960 - RNA, 21 nt, Artificial Sequence
  RNA Oligomer
cccugugauuuaugucaaguu

SEQ ID NO: 21961 - RNA, 21 nt, Artificial Sequence
  RNA Oligomer
aaacagacgcucccugugauu

SEQ ID NO: 21962 - RNA, 21 nt, Artificial Sequence
  RNA Oligomer
gaacuggucgccaucaagaaa

SEQ ID NO: 21963 - RNA, 21 nt, Artificial Sequence
  RNA Oligomer
gaagucagcuauacagacacu

SEQ ID NO: 21964 - RNA, 21 nt, Artificial Sequence
  RNA Oligomer
agaagucagcuauacagacac

SEQ ID NO: 21965 - RNA, 21 nt, Artificial Sequence
  RNA Oligomer
agcaugaaaguuagcagagac

SEQ ID NO: 21966 - RNA, 21 nt, Artificial Sequence
  RNA Oligomer
cggaggcaauugcacugugua

SEQ ID NO: 21967 - RNA, 21 nt, Artificial Sequence
  RNA Oligomer
aagggagcaaaucagagaaau

SEQ ID NO: 21968 - RNA, 21 nt, Artificial Sequence
  RNA Oligomer
uguuacuaggacaaccaauau

SEQ ID NO: 21969 - RNA, 21 nt, Artificial Sequence
  RNA Oligomer
cugauacugcuguauuaaaac

SEQ ID NO: 21970 - RNA, 21 nt, Artificial Sequence
  RNA Oligomer
caaacagacgcucccugugau

SEQ ID NO: 21971 - RNA, 21 nt, Artificial Sequence
  RNA Oligomer
ccagacacuauagucgagcca

SEQ ID NO: 21972 - RNA, 21 nt, Artificial Sequence
  RNA Oligomer
ggaaauggaucauuuggugug

SEQ ID NO: 21973 - RNA, 21 nt, Artificial Sequence
  RNA Oligomer
uggaaauggaucauuuggugu

SEQ ID NO: 21974 - RNA, 21 nt, Artificial Sequence
  RNA Oligomer
gcacaggaaaaaccaccaguu

SEQ ID NO: 21975 - RNA, 21 nt, Artificial Sequence
  RNA Oligomer
ccagcugcacaggaaaaacca

SEQ ID NO: 21976 - RNA, 21 nt, Artificial Sequence
  RNA Oligomer
acgggacccaaaugucaaacu

SEQ ID NO: 21977 - RNA, 21 nt, Artificial Sequence
  RNA Oligomer
ugaugaauuacgggacccaaa

SEQ ID NO: 21978 - RNA, 21 nt, Artificial Sequence
  RNA Oligomer
cuaacaccacuggaagcuugu

SEQ ID NO: 21979 - RNA, 21 nt, Artificial Sequence
  RNA Oligomer
ucccucaaauuaaggcacauc

SEQ ID NO: 21980 - RNA, 21 nt, Artificial Sequence
  RNA Oligomer
gggagcaaaucagagaaauga

SEQ ID NO: 21981 - RNA, 21 nt, Artificial Sequence
  RNA Oligomer
ucugugacuuuggaagugcaa

SEQ ID NO: 21982 - RNA, 21 nt, Artificial Sequence
  RNA Oligomer
cucugugacuuuggaagugca

SEQ ID NO: 21983 - RNA, 21 nt, Artificial Sequence
  RNA Oligomer
agagcuccagaucaugagaaa

SEQ ID NO: 21984 - RNA, 21 nt, Artificial Sequence
  RNA Oligomer
aggagaacuggucgccaucaa

SEQ ID NO: 21985 - RNA, 21 nt, Artificial Sequence
  RNA Oligomer
gugguauaucaagccaaacuu

SEQ ID NO: 21986 - RNA, 21 nt, Artificial Sequence
  RNA Oligomer
cugucaaguaauccaccucug

SEQ ID NO: 21987 - RNA, 21 nt, Artificial Sequence
  RNA Oligomer
acucaagaacugucaaguaau

SEQ ID NO: 21988 - RNA, 21 nt, Artificial Sequence
  RNA Oligomer
agacacaccugcacucuucaa

SEQ ID NO: 21989 - RNA, 21 nt, Artificial Sequence
  RNA Oligomer
gagacacaccugcacucuuca

SEQ ID NO: 21990 - RNA, 21 nt, Artificial Sequence
  RNA Oligomer
gaugaauuacgggacccaaau

SEQ ID NO: 21991 - RNA, 21 nt, Artificial Sequence
  RNA Oligomer
aagcuugugcacauucauuuu

SEQ ID NO: 21992 - RNA, 21 nt, Artificial Sequence
  RNA Oligomer
gaagcuugugcacauucauuu

SEQ ID NO: 21993 - RNA, 21 nt, Artificial Sequence
  RNA Oligomer
gacuaacaccacuggaagcuu

SEQ ID NO: 21994 - RNA, 21 nt, Artificial Sequence
  RNA Oligomer
gcaauugcacuguguagccgu

SEQ ID NO: 21995 - RNA, 21 nt, Artificial Sequence
  RNA Oligomer
cgucaggaacaggacauuuca

SEQ ID NO: 21996 - RNA, 21 nt, Artificial Sequence
  RNA Oligomer
uucccucaaauuaaggcacau

SEQ ID NO: 21997 - RNA, 21 nt, Artificial Sequence
  RNA Oligomer
cuguuacuaggacaaccaaua

SEQ ID NO: 21998 - RNA, 21 nt, Artificial Sequence
  RNA Oligomer
agcuguuacuaggacaaccaa

SEQ ID NO: 21999 - RNA, 21 nt, Artificial Sequence
  RNA Oligomer
gccaagaggacgaagucuuuu

SEQ ID NO: 22000 - RNA, 21 nt, Artificial Sequence
  RNA Oligomer
gacaagagauuuaagaaucga

SEQ ID NO: 22001 - RNA, 21 nt, Artificial Sequence
  RNA Oligomer
cgccaucaagaaaguauugca

SEQ ID NO: 22002 - RNA, 21 nt, Artificial Sequence
  RNA Oligomer
ugguauaucaagccaaacuuu

SEQ ID NO: 22003 - RNA, 21 nt, Artificial Sequence
  RNA Oligomer
gacacuaaagugauuggaaau

SEQ ID NO: 22004 - RNA, 21 nt, Artificial Sequence
  RNA Oligomer
cuauacagacacuaaagugau

SEQ ID NO: 22005 - RNA, 21 nt, Artificial Sequence
  RNA Oligomer
gaauuacgggacccaaauguc

SEQ ID NO: 22006 - RNA, 21 nt, Artificial Sequence
  RNA Oligomer
cgacuaacaccacuggaagcu

SEQ ID NO: 22007 - RNA, 21 nt, Artificial Sequence
  RNA Oligomer
gcuguuacuaggacaaccaau

SEQ ID NO: 22008 - RNA, 21 nt, Artificial Sequence
  RNA Oligomer
uccugauacugcuguauuaaa

SEQ ID NO: 22009 - RNA, 21 nt, Artificial Sequence
  RNA Oligomer
auccugauacugcuguauuaa

SEQ ID NO: 22010 - RNA, 21 nt, Artificial Sequence
  RNA Oligomer
agaggacgaagucuuuuucuu

SEQ ID NO: 22011 - RNA, 21 nt, Artificial Sequence
  RNA Oligomer
guaucagcuguuccgaaguuu

SEQ ID NO: 22012 - RNA, 21 nt, Artificial Sequence
  RNA Oligomer
cagacacuauagucgagccaa

SEQ ID NO: 22013 - RNA, 21 nt, Artificial Sequence
  RNA Oligomer
gaaagaugaggucuaucuuaa

SEQ ID NO: 22014 - RNA, 21 nt, Artificial Sequence
  RNA Oligomer
aagcuagaucacuguaacaua

SEQ ID NO: 22015 - RNA, 21 nt, Artificial Sequence
  RNA Oligomer
acaagagauuuaagaaucgag

SEQ ID NO: 22016 - RNA, 21 nt, Artificial Sequence
  RNA Oligomer
guauaucaagccaaacuuugu

SEQ ID NO: 22017 - RNA, 21 nt, Artificial Sequence
  RNA Oligomer
acuaaagugauuggaaaugga

SEQ ID NO: 22018 - RNA, 21 nt, Artificial Sequence
  RNA Oligomer
gccacaagaagucagcuauac

SEQ ID NO: 22019 - RNA, 21 nt, Artificial Sequence
  RNA Oligomer
agcuuuuggcagcaugaaagu

SEQ ID NO: 22020 - RNA, 21 nt, Artificial Sequence
  RNA Oligomer
gcugcacaggaaaaaccacca

SEQ ID NO: 22021 - RNA, 21 nt, Artificial Sequence
  RNA Oligomer
ccguggacagaccaauaaugc

SEQ ID NO: 22022 - RNA, 21 nt, Artificial Sequence
  RNA Oligomer
ccuccucaugcucggauucaa

SEQ ID NO: 22023 - RNA, 21 nt, Artificial Sequence
  RNA Oligomer
gacccaaaugucaaacuacca

SEQ ID NO: 22024 - RNA, 21 nt, Artificial Sequence
  RNA Oligomer
uuaaggcacauccuuggacua

SEQ ID NO: 22025 - RNA, 21 nt, Artificial Sequence
  RNA Oligomer
ggacaaccaauauuuccaggg

SEQ ID NO: 22026 - RNA, 21 nt, Artificial Sequence
  RNA Oligomer
gagcuguuacuaggacaacca

SEQ ID NO: 22027 - RNA, 21 nt, Artificial Sequence
  RNA Oligomer
aggacgaagucuuuuucuuuu

SEQ ID NO: 22028 - RNA, 21 nt, Artificial Sequence
  RNA Oligomer
ggauccugauacugcuguauu

SEQ ID NO: 22029 - RNA, 21 nt, Artificial Sequence
  RNA Oligomer
agccaagaggacgaagucuuu

SEQ ID NO: 22030 - RNA, 21 nt, Artificial Sequence
  RNA Oligomer
uguuccgaaguuuagccuaua

SEQ ID NO: 22031 - RNA, 21 nt, Artificial Sequence
  RNA Oligomer
ccugugauuuaugucaaguug

SEQ ID NO: 22032 - RNA, 21 nt, Artificial Sequence
  RNA Oligomer
acagacgcucccugugauuua

SEQ ID NO: 22033 - RNA, 21 nt, Artificial Sequence
  RNA Oligomer
cagaguugccagacacuauag

SEQ ID NO: 22034 - RNA, 21 nt, Artificial Sequence
  RNA Oligomer
ugcuggacuauguuccggaaa

SEQ ID NO: 22035 - RNA, 21 nt, Artificial Sequence
  RNA Oligomer
ugagaaagcuagaucacugua

SEQ ID NO: 22036 - RNA, 21 nt, Artificial Sequence
  RNA Oligomer
caagagauuuaagaaucgaga

SEQ ID NO: 22037 - RNA, 21 nt, Artificial Sequence
  RNA Oligomer
ggacaagagauuuaagaaucg

SEQ ID NO: 22038 - RNA, 21 nt, Artificial Sequence
  RNA Oligomer
cuggucgccaucaagaaagua

SEQ ID NO: 22039 - RNA, 21 nt, Artificial Sequence
  RNA Oligomer
ucagcuuuuggcagcaugaaa

SEQ ID NO: 22040 - RNA, 21 nt, Artificial Sequence
  RNA Oligomer
cacaggaaaaaccaccaguua

SEQ ID NO: 22041 - RNA, 21 nt, Artificial Sequence
  RNA Oligomer
cugcaucagcuuccaacucca

SEQ ID NO: 22042 - RNA, 21 nt, Artificial Sequence
  RNA Oligomer
gcagcgucagaugcuaauacu

SEQ ID NO: 22043 - RNA, 21 nt, Artificial Sequence
  RNA Oligomer
guaauccaccucuggcuacca

SEQ ID NO: 22044 - RNA, 21 nt, Artificial Sequence
  RNA Oligomer
cacucaagaacugucaaguaa

SEQ ID NO: 22045 - RNA, 21 nt, Artificial Sequence
  RNA Oligomer
ggacauuucaccucaggagug

SEQ ID NO: 22046 - RNA, 21 nt, Artificial Sequence
  RNA Oligomer
acauccuuggacuaaggauuc

SEQ ID NO: 22047 - RNA, 21 nt, Artificial Sequence
  RNA Oligomer
agguccugggaacuccaacaa

SEQ ID NO: 22048 - RNA, 21 nt, Artificial Sequence
  RNA Oligomer
cuggacuauguuccggaaaca

SEQ ID NO: 22049 - RNA, 21 nt, Artificial Sequence
  RNA Oligomer
agaugaggucuaucuuaaucu

SEQ ID NO: 22050 - RNA, 21 nt, Artificial Sequence
  RNA Oligomer
uggugugguauaucaagccaa

SEQ ID NO: 22051 - RNA, 21 nt, Artificial Sequence
  RNA Oligomer
agacacuaaagugauuggaaa

SEQ ID NO: 22052 - RNA, 21 nt, Artificial Sequence
  RNA Oligomer
ucagcuauacagacacuaaag

SEQ ID NO: 22053 - RNA, 21 nt, Artificial Sequence
  RNA Oligomer
agucagcuauacagacacuaa

SEQ ID NO: 22054 - RNA, 21 nt, Artificial Sequence
  RNA Oligomer
gcuuuuggcagcaugaaaguu

SEQ ID NO: 22055 - RNA, 21 nt, Artificial Sequence
  RNA Oligomer
aggaaaaaccaccaguuacuu

SEQ ID NO: 22056 - RNA, 21 nt, Artificial Sequence
  RNA Oligomer
caggaaaaaccaccaguuacu

SEQ ID NO: 22057 - RNA, 21 nt, Artificial Sequence
  RNA Oligomer
augcugcuucugcaucagcuu

SEQ ID NO: 22058 - RNA, 21 nt, Artificial Sequence
  RNA Oligomer
ggacagaccaauaaugcugcu

SEQ ID NO: 22059 - RNA, 21 nt, Artificial Sequence
  RNA Oligomer
uguagccgucugcuggaguau

SEQ ID NO: 22060 - RNA, 21 nt, Artificial Sequence
  RNA Oligomer
ggaggcaauugcacuguguag

SEQ ID NO: 22061 - RNA, 21 nt, Artificial Sequence
  RNA Oligomer
caggaacaggacauuucaccu

SEQ ID NO: 22062 - RNA, 21 nt, Artificial Sequence
  RNA Oligomer
uggacuaaggauucgucagga

SEQ ID NO: 22063 - RNA, 21 nt, Artificial Sequence
  RNA Oligomer
cccucaaauuaaggcacaucc

SEQ ID NO: 22064 - RNA, 21 nt, Artificial Sequence
  RNA Oligomer
caguauacagaguugccagac

SEQ ID NO: 22065 - RNA, 21 nt, Artificial Sequence
  RNA Oligomer
gugcuggacuauguuccggaa

SEQ ID NO: 22066 - RNA, 21 nt, Artificial Sequence
  RNA Oligomer
cuuaaucuggugcuggacuau

SEQ ID NO: 22067 - RNA, 21 nt, Artificial Sequence
  RNA Oligomer
cuacuccaguggugagaagaa

SEQ ID NO: 22068 - RNA, 21 nt, Artificial Sequence
  RNA Oligomer
agaaagcuagaucacuguaac

SEQ ID NO: 22069 - RNA, 21 nt, Artificial Sequence
  RNA Oligomer
ccagaucaugagaaagcuaga

SEQ ID NO: 22070 - RNA, 21 nt, Artificial Sequence
  RNA Oligomer
gagauuuaagaaucgagagcu

SEQ ID NO: 22071 - RNA, 21 nt, Artificial Sequence
  RNA Oligomer
cgucagaugcuaauacuggag

SEQ ID NO: 22072 - RNA, 21 nt, Artificial Sequence
  RNA Oligomer
gcgucagaugcuaauacugga

SEQ ID NO: 22073 - RNA, 21 nt, Artificial Sequence
  RNA Oligomer
cggauucaagcagcugcuuca

SEQ ID NO: 22074 - RNA, 21 nt, Artificial Sequence
  RNA Oligomer
ugcuggaguauacaccaacug

SEQ ID NO: 22075 - RNA, 21 nt, Artificial Sequence
  RNA Oligomer
cugcuggaguauacaccaacu

SEQ ID NO: 22076 - RNA, 21 nt, Artificial Sequence
  RNA Oligomer
aggacauuucaccucaggagu

SEQ ID NO: 22077 - RNA, 21 nt, Artificial Sequence
  RNA Oligomer
aacuccaacaagggagcaaau

SEQ ID NO: 22078 - RNA, 21 nt, Artificial Sequence
  RNA Oligomer
ccucuaguauagauguauggu

SEQ ID NO: 22079 - RNA, 21 nt, Artificial Sequence
  RNA Oligomer
gauccugauacugcuguauua

SEQ ID NO: 22080 - RNA, 21 nt, Artificial Sequence
  RNA Oligomer
cagacgcucccugugauuuau

SEQ ID NO: 22081 - RNA, 21 nt, Artificial Sequence
  RNA Oligomer
agacacuauagucgagccaaa

SEQ ID NO: 22082 - RNA, 21 nt, Artificial Sequence
  RNA Oligomer
guauacagaguugccagacac

SEQ ID NO: 22083 - RNA, 21 nt, Artificial Sequence
  RNA Oligomer
gaaagcuagaucacuguaaca

SEQ ID NO: 22084 - RNA, 21 nt, Artificial Sequence
  RNA Oligomer
cuccagaucaugagaaagcua

SEQ ID NO: 22085 - RNA, 21 nt, Artificial Sequence
  RNA Oligomer
gagcuccagaucaugagaaag

SEQ ID NO: 22086 - RNA, 21 nt, Artificial Sequence
  RNA Oligomer
aggacaagagauuuaagaauc

SEQ ID NO: 22087 - RNA, 21 nt, Artificial Sequence
  RNA Oligomer
gucagcuauacagacacuaaa

SEQ ID NO: 22088 - RNA, 21 nt, Artificial Sequence
  RNA Oligomer
cugcuucugcaucagcuucca

SEQ ID NO: 22089 - RNA, 21 nt, Artificial Sequence
  RNA Oligomer
cagaccaauaaugcugcuucu

SEQ ID NO: 22090 - RNA, 21 nt, Artificial Sequence
  RNA Oligomer
gacagaccaauaaugcugcuu

SEQ ID NO: 22091 - RNA, 21 nt, Artificial Sequence
  RNA Oligomer
cagcagcgucagaugcuaaua

SEQ ID NO: 22092 - RNA, 21 nt, Artificial Sequence
  RNA Oligomer
cucggauucaagcagcugcuu

SEQ ID NO: 22093 - RNA, 21 nt, Artificial Sequence
  RNA Oligomer
agccgucugcuggaguauaca

SEQ ID NO: 22094 - RNA, 21 nt, Artificial Sequence
  RNA Oligomer
gacuaaggauucgucaggaac

SEQ ID NO: 22095 - RNA, 21 nt, Artificial Sequence
  RNA Oligomer
gcacauccuuggacuaaggau

SEQ ID NO: 22096 - RNA, 21 nt, Artificial Sequence
  RNA Oligomer
ggcacauccuuggacuaagga

SEQ ID NO: 22097 - RNA, 21 nt, Artificial Sequence
  RNA Oligomer
caagaggacgaagucuuuuuc

SEQ ID NO: 22098 - RNA, 21 nt, Artificial Sequence
  RNA Oligomer
ucccugugauuuaugucaagu

SEQ ID NO: 22099 - RNA, 21 nt, Artificial Sequence
  RNA Oligomer
cucccugugauuuaugucaag

SEQ ID NO: 22100 - RNA, 21 nt, Artificial Sequence
  RNA Oligomer
gacacuauagucgagccaaac

SEQ ID NO: 22101 - RNA, 21 nt, Artificial Sequence
  RNA Oligomer
gaguugccagacacuauaguc

SEQ ID NO: 22102 - RNA, 21 nt, Artificial Sequence
  RNA Oligomer
acagaguugccagacacuaua

SEQ ID NO: 22103 - RNA, 21 nt, Artificial Sequence
  RNA Oligomer
gcuagaucacuguaacauagu

SEQ ID NO: 22104 - RNA, 21 nt, Artificial Sequence
  RNA Oligomer
ccaaacuuugugauucaggag

SEQ ID NO: 22105 - RNA, 21 nt, Artificial Sequence
  RNA Oligomer
gugugguauaucaagccaaac

SEQ ID NO: 22106 - RNA, 21 nt, Artificial Sequence
  RNA Oligomer
ccuucagcuuuuggcagcaug

SEQ ID NO: 22107 - RNA, 21 nt, Artificial Sequence
  RNA Oligomer
ugagugucacucagcaacacu

SEQ ID NO: 22108 - RNA, 21 nt, Artificial Sequence
  RNA Oligomer
ugcuucugcaucagcuuccaa

SEQ ID NO: 22109 - RNA, 21 nt, Artificial Sequence
  RNA Oligomer
acagaccaauaaugcugcuuc

SEQ ID NO: 22110 - RNA, 21 nt, Artificial Sequence
  RNA Oligomer
gagaccguggacagaccaaua

SEQ ID NO: 22111 - RNA, 21 nt, Artificial Sequence
  RNA Oligomer
cacagcagcgucagaugcuaa

SEQ ID NO: 22112 - RNA, 21 nt, Artificial Sequence
  RNA Oligomer
cuccucaugcucggauucaag

SEQ ID NO: 22113 - RNA, 21 nt, Artificial Sequence
  RNA Oligomer
accacucaagaacugucaagu

SEQ ID NO: 22114 - RNA, 21 nt, Artificial Sequence
  RNA Oligomer
agcuugugcacauucauuuuu

SEQ ID NO: 22115 - RNA, 21 nt, Artificial Sequence
  RNA Oligomer
ccacuggaagcuugugcacau

SEQ ID NO: 22116 - RNA, 21 nt, Artificial Sequence
  RNA Oligomer
ggauucgucaggaacaggaca

SEQ ID NO: 22117 - RNA, 21 nt, Artificial Sequence
  RNA Oligomer
cacagaauuuaaauucccuca

SEQ ID NO: 22118 - RNA, 21 nt, Artificial Sequence
  RNA Oligomer
acacagaauuuaaauucccuc

SEQ ID NO: 22119 - RNA, 21 nt, Artificial Sequence
  RNA Oligomer
uggauccugauacugcuguau

SEQ ID NO: 22120 - RNA, 21 nt, Artificial Sequence
  RNA Oligomer
cgagagcuccagaucaugaga

SEQ ID NO: 22121 - RNA, 21 nt, Artificial Sequence
  RNA Oligomer
gaaucgagagcuccagaucau

SEQ ID NO: 22122 - RNA, 21 nt, Artificial Sequence
  RNA Oligomer
agauuuaagaaucgagagcuc

SEQ ID NO: 22123 - RNA, 21 nt, Artificial Sequence
  RNA Oligomer
cagacacuaaagugauuggaa

SEQ ID NO: 22124 - RNA, 21 nt, Artificial Sequence
  RNA Oligomer
agcuauacagacacuaaagug

SEQ ID NO: 22125 - RNA, 21 nt, Artificial Sequence
  RNA Oligomer
agccuucagcuuuuggcagca

SEQ ID NO: 22126 - RNA, 21 nt, Artificial Sequence
  RNA Oligomer
agaccguggacagaccaauaa

SEQ ID NO: 22127 - RNA, 21 nt, Artificial Sequence
  RNA Oligomer
cgucugcuggaguauacacca

SEQ ID NO: 22128 - RNA, 21 nt, Artificial Sequence
  RNA Oligomer
aggauucgucaggaacaggac

SEQ ID NO: 22129 - RNA, 21 nt, Artificial Sequence
  RNA Oligomer
gcuguuccgaaguuuagccua

SEQ ID NO: 22130 - RNA, 21 nt, Artificial Sequence
  RNA Oligomer
agaaagaugaggucuaucuua

SEQ ID NO: 22131 - RNA, 21 nt, Artificial Sequence
  RNA Oligomer
agaucaugagaaagcuagauc

SEQ ID NO: 22132 - RNA, 21 nt, Artificial Sequence
  RNA Oligomer
gcuccagaucaugagaaagcu

SEQ ID NO: 22133 - RNA, 21 nt, Artificial Sequence
  RNA Oligomer
acaacagugguggcaacuccu

SEQ ID NO: 22134 - RNA, 21 nt, Artificial Sequence
  RNA Oligomer
uacuugagugucacucagcaa

SEQ ID NO: 22135 - RNA, 21 nt, Artificial Sequence
  RNA Oligomer
ccaccaguuacuugaguguca

SEQ ID NO: 22136 - RNA, 21 nt, Artificial Sequence
  RNA Oligomer
cagcgucagaugcuaauacug

SEQ ID NO: 22137 - RNA, 21 nt, Artificial Sequence
  RNA Oligomer
cuacacagaauuuaaauuccc

SEQ ID NO: 22138 - RNA, 21 nt, Artificial Sequence
  RNA Oligomer
gacgaagucuuuuucuuuuuc

SEQ ID NO: 22139 - RNA, 21 nt, Artificial Sequence
  RNA Oligomer
aagaaagaugaggucuaucuu

SEQ ID NO: 22140 - RNA, 21 nt, Artificial Sequence
  RNA Oligomer
caguuacuugagugucacuca

SEQ ID NO: 22141 - RNA, 21 nt, Artificial Sequence
  RNA Oligomer
accaguuacuugagugucacu

SEQ ID NO: 22142 - RNA, 21 nt, Artificial Sequence
  RNA Oligomer
caccaguuacuugagugucac

SEQ ID NO: 22143 - RNA, 21 nt, Artificial Sequence
  RNA Oligomer
ucagaugcuaauacuggagac

SEQ ID NO: 22144 - RNA, 21 nt, Artificial Sequence
  RNA Oligomer
acagcagcgucagaugcuaau

SEQ ID NO: 22145 - RNA, 21 nt, Artificial Sequence
  RNA Oligomer
ccuuggacuaaggauucguca

SEQ ID NO: 22146 - RNA, 21 nt, Artificial Sequence
  RNA Oligomer
cacauccuuggacuaaggauu

SEQ ID NO: 22147 - RNA, 21 nt, Artificial Sequence
  RNA Oligomer
aggcacauccuuggacuaagg

SEQ ID NO: 22148 - RNA, 21 nt, Artificial Sequence
  RNA Oligomer
cuucuacuccaguggugagaa

SEQ ID NO: 22149 - RNA, 21 nt, Artificial Sequence
  RNA Oligomer
acagacacuaaagugauugga

SEQ ID NO: 22150 - RNA, 21 nt, Artificial Sequence
  RNA Oligomer
ccaguuacuugagugucacuc

SEQ ID NO: 22151 - RNA, 21 nt, Artificial Sequence
  RNA Oligomer
cagagaaaugaacccaaacua

SEQ ID NO: 22152 - RNA, 21 nt, Artificial Sequence
  RNA Oligomer
caaaucagagaaaugaaccca

SEQ ID NO: 22153 - RNA, 21 nt, Artificial Sequence
  RNA Oligomer
agaagaaagaugaggucuauc

SEQ ID NO: 22154 - RNA, 21 nt, Artificial Sequence
  RNA Oligomer
gccaaacuuugugauucagga

SEQ ID NO: 22155 - RNA, 21 nt, Artificial Sequence
  RNA Oligomer
acaccacuggaagcuugugca

SEQ ID NO: 22156 - RNA, 21 nt, Artificial Sequence
  RNA Oligomer
uggacuauguuccggaaacag

SEQ ID NO: 22157 - RNA, 21 nt, Artificial Sequence
  RNA Oligomer
gaagaaagaugaggucuaucu

SEQ ID NO: 22158 - RNA, 21 nt, Artificial Sequence
  RNA Oligomer
ccucaaauuaaggcacauccu

SEQ ID NO: 22159 - RNA, 21 nt, Artificial Sequence
  RNA Oligomer
aucaagccaaacuuugugauu

SEQ ID NO: 22160 - RNA, 21 nt, Artificial Sequence
  RNA Oligomer
agcuuccaacuccaccugaac

SEQ ID NO: 22161 - RNA, 21 nt, Artificial Sequence
  RNA Oligomer
cucaaauuaaggcacauccuu

SEQ ID NO: 22162 - RNA, 21 nt, Artificial Sequence
  RNA Oligomer
caagccaaacuuugugauuca

SEQ ID NO: 22163 - RNA, 21 nt, Artificial Sequence
  RNA Oligomer
agccagcugcacaggaaaaac

SEQ ID NO: 22164 - RNA, 21 nt, Artificial Sequence
  RNA Oligomer
cagcuuccaacuccaccugaa

SEQ ID NO: 22165 - RNA, 21 nt, Artificial Sequence
  RNA Oligomer
cagccagcugcacaggaaaaa

SEQ ID NO: 22166 - RNA, 21 nt, Artificial Sequence
  RNA Oligomer
ucagcuuccaacuccaccuga

SEQ ID NO: 22167 - RNA, 21 nt, Artificial Sequence
  RNA Oligomer
ucagagaaaugaacccaaacu

SEQ ID NO: 22168 - RNA, 21 nt, Artificial Sequence
  RNA Oligomer
cuauguuccggaaacaguaua

SEQ ID NO: 22169 - RNA, 21 nt, Artificial Sequence
  RNA Oligomer
gacuauguuccggaaacagua

SEQ ID NO: 22170 - RNA, 21 nt, Artificial Sequence
  RNA Oligomer
agagaaaugaacccaaacuac

SEQ ID NO: 22171 - RNA, 21 nt, Artificial Sequence
  RNA Oligomer
ugcaucagcuuccaacuccac

SEQ ID NO: 22172 - RNA, 21 nt, Artificial Sequence
  RNA Oligomer
ggacuauguuccggaaacagu

SEQ ID NO: 22173 - RNA, 21 nt, Artificial Sequence
  RNA Oligomer
ugacuuuggaagugcaaagca

SEQ ID NO: 22174 - RNA, 21 nt, Artificial Sequence
  RNA Oligomer
auacgaaacauuggguucucc

SEQ ID NO: 22175 - RNA, 21 nt, Artificial Sequence
  RNA Oligomer
aaacaagcgauauauuucucc

SEQ ID NO: 22176 - RNA, 21 nt, Artificial Sequence
  RNA Oligomer
uguauagcugacuucuugugg

SEQ ID NO: 22177 - RNA, 21 nt, Artificial Sequence
  RNA Oligomer
ugucucugcuaacuuucaugc

SEQ ID NO: 22178 - RNA, 21 nt, Artificial Sequence
  RNA Oligomer
uguuagguuaacgauaaaugc

SEQ ID NO: 22179 - RNA, 21 nt, Artificial Sequence
  RNA Oligomer
auuugguaguuugacauuugg

SEQ ID NO: 22180 - RNA, 21 nt, Artificial Sequence
  RNA Oligomer
aaaugcagcauuaaguucucc

SEQ ID NO: 22181 - RNA, 21 nt, Artificial Sequence
  RNA Oligomer
uauacgaaacauuggguucuc

SEQ ID NO: 22182 - RNA, 21 nt, Artificial Sequence
  RNA Oligomer
caugaggaggaauaaggaugg

SEQ ID NO: 22183 - RNA, 21 nt, Artificial Sequence
  RNA Oligomer
augaggaggaauaaggauggu

SEQ ID NO: 22184 - RNA, 21 nt, Artificial Sequence
  RNA Oligomer
uuugguaguuugacauuuggg

SEQ ID NO: 22185 - RNA, 21 nt, Artificial Sequence
  RNA Oligomer
aacagauauacgaaacauugg

SEQ ID NO: 22186 - RNA, 21 nt, Artificial Sequence
  RNA Oligomer
uuucuccuucaagacagaucg

SEQ ID NO: 22187 - RNA, 21 nt, Artificial Sequence
  RNA Oligomer
uucuccuucaagacagaucgg

SEQ ID NO: 22188 - RNA, 21 nt, Artificial Sequence
  RNA Oligomer
gauauacgaaacauuggguuc

SEQ ID NO: 22189 - RNA, 21 nt, Artificial Sequence
  RNA Oligomer
auauacgaaacauuggguucu

SEQ ID NO: 22190 - RNA, 21 nt, Artificial Sequence
  RNA Oligomer
aacaagcgauauauuucuccu

SEQ ID NO: 22191 - RNA, 21 nt, Artificial Sequence
  RNA Oligomer
uuguccugcaauacuuucuug

SEQ ID NO: 22192 - RNA, 21 nt, Artificial Sequence
  RNA Oligomer
aggaggaauaaggaugguagc

SEQ ID NO: 22193 - RNA, 21 nt, Artificial Sequence
  RNA Oligomer
aaugcagcauuaaguucuccc

SEQ ID NO: 22194 - RNA, 21 nt, Artificial Sequence
  RNA Oligomer
auuauuucuaccaacugaucc

SEQ ID NO: 22195 - RNA, 21 nt, Artificial Sequence
  RNA Oligomer
uucuuaaaucucuuguccugc

SEQ ID NO: 22196 - RNA, 21 nt, Artificial Sequence
  RNA Oligomer
aagcgauauauuucuccuuca

SEQ ID NO: 22197 - RNA, 21 nt, Artificial Sequence
  RNA Oligomer
gaggaggaauaaggaugguag

SEQ ID NO: 22198 - RNA, 21 nt, Artificial Sequence
  RNA Oligomer
uugaguggugaaguugaagag

SEQ ID NO: 22199 - RNA, 21 nt, Artificial Sequence
  RNA Oligomer
uagguuaacgauaaaugcagc

SEQ ID NO: 22200 - RNA, 21 nt, Artificial Sequence
  RNA Oligomer
uaaaugcagcauuaaguucuc

SEQ ID NO: 22201 - RNA, 21 nt, Artificial Sequence
  RNA Oligomer
gaacagauauacgaaacauug

SEQ ID NO: 22202 - RNA, 21 nt, Artificial Sequence
  RNA Oligomer
cagauauacgaaacauugggu

SEQ ID NO: 22203 - RNA, 21 nt, Artificial Sequence
  RNA Oligomer
aacucuguauacuguuuccgg

SEQ ID NO: 22204 - RNA, 21 nt, Artificial Sequence
  RNA Oligomer
caagcgauauauuucuccuuc

SEQ ID NO: 22205 - RNA, 21 nt, Artificial Sequence
  RNA Oligomer
uugauauaccacaccaaauga

SEQ ID NO: 22206 - RNA, 21 nt, Artificial Sequence
  RNA Oligomer
gaaguugaagagugcaggugu

SEQ ID NO: 22207 - RNA, 21 nt, Artificial Sequence
  RNA Oligomer
aguugaagagugcaggugugu

SEQ ID NO: 22208 - RNA, 21 nt, Artificial Sequence
  RNA Oligomer
uauuucuaccaacugauccac

SEQ ID NO: 22209 - RNA, 21 nt, Artificial Sequence
  RNA Oligomer
acagauauacgaaacauuggg

SEQ ID NO: 22210 - RNA, 21 nt, Artificial Sequence
  RNA Oligomer
gauauauuucuccuucaagac

SEQ ID NO: 22211 - RNA, 21 nt, Artificial Sequence
  RNA Oligomer
uauauuucuccuucaagacag

SEQ ID NO: 22212 - RNA, 21 nt, Artificial Sequence
  RNA Oligomer
ucuguauagcugacuucuugu

SEQ ID NO: 22213 - RNA, 21 nt, Artificial Sequence
  RNA Oligomer
uugucucugcuaacuuucaug

SEQ ID NO: 22214 - RNA, 21 nt, Artificial Sequence
  RNA Oligomer
aguggugaaguugaagagugc

SEQ ID NO: 22215 - RNA, 21 nt, Artificial Sequence
  RNA Oligomer
aaguugaagagugcaggugug

SEQ ID NO: 22216 - RNA, 21 nt, Artificial Sequence
  RNA Oligomer
cauuugguaguuugacauuug

SEQ ID NO: 22217 - RNA, 21 nt, Artificial Sequence
  RNA Oligomer
uuagucgggcaguugguguau

SEQ ID NO: 22218 - RNA, 21 nt, Artificial Sequence
  RNA Oligomer
ucccaggaccuugauuauuuc

SEQ ID NO: 22219 - RNA, 21 nt, Artificial Sequence
  RNA Oligomer
agauauacgaaacauuggguu

SEQ ID NO: 22220 - RNA, 21 nt, Artificial Sequence
  RNA Oligomer
aauacuuucuugauggcgacc

SEQ ID NO: 22221 - RNA, 21 nt, Artificial Sequence
  RNA Oligomer
auauaccacaccaaaugaucc

SEQ ID NO: 22222 - RNA, 21 nt, Artificial Sequence
  RNA Oligomer
auauuucuccuucaagacaga

SEQ ID NO: 22223 - RNA, 21 nt, Artificial Sequence
  RNA Oligomer
uauuucuccuucaagacagau

SEQ ID NO: 22224 - RNA, 21 nt, Artificial Sequence
  RNA Oligomer
uccuugucucugcuaacuuuc

SEQ ID NO: 22225 - RNA, 21 nt, Artificial Sequence
  RNA Oligomer
ucuucgcgaaucaccuuuucc

SEQ ID NO: 22226 - RNA, 21 nt, Artificial Sequence
  RNA Oligomer
gugaaguugaagagugcaggu

SEQ ID NO: 22227 - RNA, 21 nt, Artificial Sequence
  RNA Oligomer
aaaaaaugaaugugcacaagc

SEQ ID NO: 22228 - RNA, 21 nt, Artificial Sequence
  RNA Oligomer
ucugauuugcucccuuguugg

SEQ ID NO: 22229 - RNA, 21 nt, Artificial Sequence
  RNA Oligomer
agcaccagauuaagauagacc

SEQ ID NO: 22230 - RNA, 21 nt, Artificial Sequence
  RNA Oligomer
caccagauuaagauagaccuc

SEQ ID NO: 22231 - RNA, 21 nt, Artificial Sequence
  RNA Oligomer
aucggcacggauauuuaacau

SEQ ID NO: 22232 - RNA, 21 nt, Artificial Sequence
  RNA Oligomer
aaucggacuauguuacaguga

SEQ ID NO: 22233 - RNA, 21 nt, Artificial Sequence
  RNA Oligomer
uguccugcaauacuuucuuga

SEQ ID NO: 22234 - RNA, 21 nt, Artificial Sequence
  RNA Oligomer
cugcaauacuuucuugauggc

SEQ ID NO: 22235 - RNA, 21 nt, Artificial Sequence
  RNA Oligomer
ugacaugaucacucucuucgc

SEQ ID NO: 22236 - RNA, 21 nt, Artificial Sequence
  RNA Oligomer
ugaguggugaaguugaagagu

SEQ ID NO: 22237 - RNA, 21 nt, Artificial Sequence
  RNA Oligomer
uuagguuaacgauaaaugcag

SEQ ID NO: 22238 - RNA, 21 nt, Artificial Sequence
  RNA Oligomer
aaugugcacaagcuuccagug

SEQ ID NO: 22239 - RNA, 21 nt, Artificial Sequence
  RNA Oligomer
augcagcauuaaguucuccca

SEQ ID NO: 22240 - RNA, 21 nt, Artificial Sequence
  RNA Oligomer
caggaccuugauuauuucuac

SEQ ID NO: 22241 - RNA, 21 nt, Artificial Sequence
  RNA Oligomer
aggaccuugauuauuucuacc

SEQ ID NO: 22242 - RNA, 21 nt, Artificial Sequence
  RNA Oligomer
uuguccuaguaacagcucagc

SEQ ID NO: 22243 - RNA, 21 nt, Artificial Sequence
  RNA Oligomer
acaacuugacauaaaucacag

SEQ ID NO: 22244 - RNA, 21 nt, Artificial Sequence
  RNA Oligomer
uugacauaaaucacagggagc

SEQ ID NO: 22245 - RNA, 21 nt, Artificial Sequence
  RNA Oligomer
uagaagaaauaacgcaaucgg

SEQ ID NO: 22246 - RNA, 21 nt, Artificial Sequence
  RNA Oligomer
gagcaugaggaggaauaagga

SEQ ID NO: 22247 - RNA, 21 nt, Artificial Sequence
  RNA Oligomer
uugguaguuugacauuugggu

SEQ ID NO: 22248 - RNA, 21 nt, Artificial Sequence
  RNA Oligomer
gauaaaugcagcauuaaguuc

SEQ ID NO: 22249 - RNA, 21 nt, Artificial Sequence
  RNA Oligomer
uuucucugauuugcucccuug

SEQ ID NO: 22250 - RNA, 21 nt, Artificial Sequence
  RNA Oligomer
cuugauuauuucuaccaacug

SEQ ID NO: 22251 - RNA, 21 nt, Artificial Sequence
  RNA Oligomer
auuucuaccaacugauccaca

SEQ ID NO: 22252 - RNA, 21 nt, Artificial Sequence
  RNA Oligomer
uguccuaguaacagcucagcc

SEQ ID NO: 22253 - RNA, 21 nt, Artificial Sequence
  RNA Oligomer
uaccgagaacagauauacgaa

SEQ ID NO: 22254 - RNA, 21 nt, Artificial Sequence
  RNA Oligomer
agucacagaguuuuaauacag

SEQ ID NO: 22255 - RNA, 21 nt, Artificial Sequence
  RNA Oligomer
gucacagaguuuuaauacagc

SEQ ID NO: 22256 - RNA, 21 nt, Artificial Sequence
  RNA Oligomer
cauaaaucacagggagcgucu

SEQ ID NO: 22257 - RNA, 21 nt, Artificial Sequence
  RNA Oligomer
caacucuguauacuguuuccg

SEQ ID NO: 22258 - RNA, 21 nt, Artificial Sequence
  RNA Oligomer
cagcaccagauuaagauagac

SEQ ID NO: 22259 - RNA, 21 nt, Artificial Sequence
  RNA Oligomer
ccugcaauacuuucuugaugg

SEQ ID NO: 22260 - RNA, 21 nt, Artificial Sequence
  RNA Oligomer
cucuucgcgaaucaccuuuuc

SEQ ID NO: 22261 - RNA, 21 nt, Artificial Sequence
  RNA Oligomer
cagaagcagcauuauuggucu

SEQ ID NO: 22262 - RNA, 21 nt, Artificial Sequence
  RNA Oligomer
aauaaggaugguagccagagg

SEQ ID NO: 22263 - RNA, 21 nt, Artificial Sequence
  RNA Oligomer
aguucuugaguggugaaguug

SEQ ID NO: 22264 - RNA, 21 nt, Artificial Sequence
  RNA Oligomer
guuagguuaacgauaaaugca

SEQ ID NO: 22265 - RNA, 21 nt, Artificial Sequence
  RNA Oligomer
agguuaacgauaaaugcagca

SEQ ID NO: 22266 - RNA, 21 nt, Artificial Sequence
  RNA Oligomer
augaaugugcacaagcuucca

SEQ ID NO: 22267 - RNA, 21 nt, Artificial Sequence
  RNA Oligomer
agucgggcaguugguguauac

SEQ ID NO: 22268 - RNA, 21 nt, Artificial Sequence
  RNA Oligomer
uaaauucuguguaguuugggu

SEQ ID NO: 22269 - RNA, 21 nt, Artificial Sequence
  RNA Oligomer
ugcagcauuaaguucucccac

SEQ ID NO: 22270 - RNA, 21 nt, Artificial Sequence
  RNA Oligomer
uucucugauuugcucccuugu

SEQ ID NO: 22271 - RNA, 21 nt, Artificial Sequence
  RNA Oligomer
gauuauuucuaccaacugauc

SEQ ID NO: 22272 - RNA, 21 nt, Artificial Sequence
  RNA Oligomer
uuauuucuaccaacugaucca

SEQ ID NO: 22273 - RNA, 21 nt, Artificial Sequence
  RNA Oligomer
uucuaccaacugauccacacc

SEQ ID NO: 22274 - RNA, 21 nt, Artificial Sequence
  RNA Oligomer
aacugauccacaccacuaucc

SEQ ID NO: 22275 - RNA, 21 nt, Artificial Sequence
  RNA Oligomer
acugauccacaccacuauccc

SEQ ID NO: 22276 - RNA, 21 nt, Artificial Sequence
  RNA Oligomer
uuccaaagucacagaguuuua

SEQ ID NO: 22277 - RNA, 21 nt, Artificial Sequence
  RNA Oligomer
ucacagaguuuuaauacagca

SEQ ID NO: 22278 - RNA, 21 nt, Artificial Sequence
  RNA Oligomer
cugauacauauacaacuugac

SEQ ID NO: 22279 - RNA, 21 nt, Artificial Sequence
  RNA Oligomer
caauacuuucuugauggcgac

SEQ ID NO: 22280 - RNA, 21 nt, Artificial Sequence
  RNA Oligomer
aaaugauccauuuccaaucac

SEQ ID NO: 22281 - RNA, 21 nt, Artificial Sequence
  RNA Oligomer
guggugaaguugaagagugca

SEQ ID NO: 22282 - RNA, 21 nt, Artificial Sequence
  RNA Oligomer
aaauucuguguaguuuggguu

SEQ ID NO: 22283 - RNA, 21 nt, Artificial Sequence
  RNA Oligomer
uaguaacagcucagccaacac

SEQ ID NO: 22284 - RNA, 21 nt, Artificial Sequence
  RNA Oligomer
cacagaguuuuaauacagcag

SEQ ID NO: 22285 - RNA, 21 nt, Artificial Sequence
  RNA Oligomer
guagaagaaauaacgcaaucg

SEQ ID NO: 22286 - RNA, 21 nt, Artificial Sequence
  RNA Oligomer
aauaacgcaaucggacuaugu

SEQ ID NO: 22287 - RNA, 21 nt, Artificial Sequence
  RNA Oligomer
caaucggacuauguuacagug

SEQ ID NO: 22288 - RNA, 21 nt, Artificial Sequence
  RNA Oligomer
uuacagugaucuagcuuucuc

SEQ ID NO: 22289 - RNA, 21 nt, Artificial Sequence
  RNA Oligomer
auucuuaaaucucuuguccug

SEQ ID NO: 22290 - RNA, 21 nt, Artificial Sequence
  RNA Oligomer
aaaucucuuguccugcaauac

SEQ ID NO: 22291 - RNA, 21 nt, Artificial Sequence
  RNA Oligomer
ucuccuucaagacagaucggc

SEQ ID NO: 22292 - RNA, 21 nt, Artificial Sequence
  RNA Oligomer
uucgcgaaucaccuuuuccuu

SEQ ID NO: 22293 - RNA, 21 nt, Artificial Sequence
  RNA Oligomer
caaguaacuggugguuuuucc

SEQ ID NO: 22294 - RNA, 21 nt, Artificial Sequence
  RNA Oligomer
caucaaaaaaugaaugugcac

SEQ ID NO: 22295 - RNA, 21 nt, Artificial Sequence
  RNA Oligomer
gacauaaaucacagggagcgu

SEQ ID NO: 22296 - RNA, 21 nt, Artificial Sequence
  RNA Oligomer
uguuuggcucgacuauagugu

SEQ ID NO: 22297 - RNA, 21 nt, Artificial Sequence
  RNA Oligomer
auagaccucaucuuucuucuc

SEQ ID NO: 22298 - RNA, 21 nt, Artificial Sequence
  RNA Oligomer
caaaugauccauuuccaauca

SEQ ID NO: 22299 - RNA, 21 nt, Artificial Sequence
  RNA Oligomer
gacaugaucacucucuucgcg

SEQ ID NO: 22300 - RNA, 21 nt, Artificial Sequence
  RNA Oligomer
uucaagacagaucggcacgga

SEQ ID NO: 22301 - RNA, 21 nt, Artificial Sequence
  RNA Oligomer
aucacucucuucgcgaaucac

SEQ ID NO: 22302 - RNA, 21 nt, Artificial Sequence
  RNA Oligomer
guaacagcucagccaacacac

SEQ ID NO: 22303 - RNA, 21 nt, Artificial Sequence
  RNA Oligomer
gcaacucuguauacuguuucc

SEQ ID NO: 22304 - RNA, 21 nt, Artificial Sequence
  RNA Oligomer
aucuuucuucucaccacugga

SEQ ID NO: 22305 - RNA, 21 nt, Artificial Sequence
  RNA Oligomer
uucuugauggcgaccaguucu

SEQ ID NO: 22306 - RNA, 21 nt, Artificial Sequence
  RNA Oligomer
uucuccugaaucacaaaguuu

SEQ ID NO: 22307 - RNA, 21 nt, Artificial Sequence
  RNA Oligomer
gauauaccacaccaaaugauc

SEQ ID NO: 22308 - RNA, 21 nt, Artificial Sequence
  RNA Oligomer
uauaccacaccaaaugaucca

SEQ ID NO: 22309 - RNA, 21 nt, Artificial Sequence
  RNA Oligomer
cuccuucaagacagaucggca

SEQ ID NO: 22310 - RNA, 21 nt, Artificial Sequence
  RNA Oligomer
cugacaugaucacucucuucg

SEQ ID NO: 22311 - RNA, 21 nt, Artificial Sequence
  RNA Oligomer
acaugaucacucucuucgcga

SEQ ID NO: 22312 - RNA, 21 nt, Artificial Sequence
  RNA Oligomer
auuauuggucuguccacgguc

SEQ ID NO: 22313 - RNA, 21 nt, Artificial Sequence
  RNA Oligomer
caaaaaaugaaugugcacaag

SEQ ID NO: 22314 - RNA, 21 nt, Artificial Sequence
  RNA Oligomer
uuucuaccaacugauccacac

SEQ ID NO: 22315 - RNA, 21 nt, Artificial Sequence
  RNA Oligomer
cagccagcagaccauacaucu

SEQ ID NO: 22316 - RNA, 21 nt, Artificial Sequence
  RNA Oligomer
aguaucaggauccaacaagag

SEQ ID NO: 22317 - RNA, 21 nt, Artificial Sequence
  RNA Oligomer
uaucaggauccaacaagaggu

SEQ ID NO: 22318 - RNA, 21 nt, Artificial Sequence
  RNA Oligomer
auaccacaccaaaugauccau

SEQ ID NO: 22319 - RNA, 21 nt, Artificial Sequence
  RNA Oligomer
aguugccaccacuguugucac

SEQ ID NO: 22320 - RNA, 21 nt, Artificial Sequence
  RNA Oligomer
uugccaccacuguugucaccu

SEQ ID NO: 22321 - RNA, 21 nt, Artificial Sequence
  RNA Oligomer
gaucacucucuucgcgaauca

SEQ ID NO: 22322 - RNA, 21 nt, Artificial Sequence
  RNA Oligomer
aacagcucagccaacacacag

SEQ ID NO: 22323 - RNA, 21 nt, Artificial Sequence
  RNA Oligomer
cagcagaccauacaucuauac

SEQ ID NO: 22324 - RNA, 21 nt, Artificial Sequence
  RNA Oligomer
cagaccauacaucuauacuag

SEQ ID NO: 22325 - RNA, 21 nt, Artificial Sequence
  RNA Oligomer
uacagcaguaucaggauccaa

SEQ ID NO: 22326 - RNA, 21 nt, Artificial Sequence
  RNA Oligomer
aucaggauccaacaagagguu

SEQ ID NO: 22327 - RNA, 21 nt, Artificial Sequence
  RNA Oligomer
uagaccucaucuuucuucuca

SEQ ID NO: 22328 - RNA, 21 nt, Artificial Sequence
  RNA Oligomer
agaagaaauaacgcaaucgga

SEQ ID NO: 22329 - RNA, 21 nt, Artificial Sequence
  RNA Oligomer
uucauuucucugauuugcucc

SEQ ID NO: 22330 - RNA, 21 nt, Artificial Sequence
  RNA Oligomer
aaaaagaaaaagacuucgucc

SEQ ID NO: 22331 - RNA, 21 nt, Artificial Sequence
  RNA Oligomer
ucaucuuucuucucaccacug

SEQ ID NO: 22332 - RNA, 21 nt, Artificial Sequence
  RNA Oligomer
caucuuucuucucaccacugg

SEQ ID NO: 22333 - RNA, 21 nt, Artificial Sequence
  RNA Oligomer
aaauaacgcaaucggacuaug

SEQ ID NO: 22334 - RNA, 21 nt, Artificial Sequence
  RNA Oligomer
aucuagcuuucucaugaucug

SEQ ID NO: 22335 - RNA, 21 nt, Artificial Sequence
  RNA Oligomer
aaugauccauuuccaaucacu

SEQ ID NO: 22336 - RNA, 21 nt, Artificial Sequence
  RNA Oligomer
accacuguugucaccuugcug

SEQ ID NO: 22337 - RNA, 21 nt, Artificial Sequence
  RNA Oligomer
cucugcuaacuuucaugcugc

SEQ ID NO: 22338 - RNA, 21 nt, Artificial Sequence
  RNA Oligomer
uugacaguucuugagugguga

SEQ ID NO: 22339 - RNA, 21 nt, Artificial Sequence
  RNA Oligomer
uaguuugacauuugggucccg

SEQ ID NO: 22340 - RNA, 21 nt, Artificial Sequence
  RNA Oligomer
aauucuguguaguuuggguuc

SEQ ID NO: 22341 - RNA, 21 nt, Artificial Sequence
  RNA Oligomer
cuaccaacugauccacaccac

SEQ ID NO: 22342 - RNA, 21 nt, Artificial Sequence
  RNA Oligomer
uaccaacugauccacaccacu

SEQ ID NO: 22343 - RNA, 21 nt, Artificial Sequence
  RNA Oligomer
auaggcuaaacuucggaacag

SEQ ID NO: 22344 - RNA, 21 nt, Artificial Sequence
  RNA Oligomer
gaccucaucuuucuucucacc

SEQ ID NO: 22345 - RNA, 21 nt, Artificial Sequence
  RNA Oligomer
accucaucuuucuucucacca

SEQ ID NO: 22346 - RNA, 21 nt, Artificial Sequence
  RNA Oligomer
cuggaguagaagaaauaacgc

SEQ ID NO: 22347 - RNA, 21 nt, Artificial Sequence
  RNA Oligomer
aacgcaaucggacuauguuac

SEQ ID NO: 22348 - RNA, 21 nt, Artificial Sequence
  RNA Oligomer
agcugauacauauacaacuug

SEQ ID NO: 22349 - RNA, 21 nt, Artificial Sequence
  RNA Oligomer
augauccauuuccaaucacuu

SEQ ID NO: 22350 - RNA, 21 nt, Artificial Sequence
  RNA Oligomer
ucugcuaacuuucaugcugcc

SEQ ID NO: 22351 - RNA, 21 nt, Artificial Sequence
  RNA Oligomer
guccacggucuccaguauuag

SEQ ID NO: 22352 - RNA, 21 nt, Artificial Sequence
  RNA Oligomer
uaaggaugguagccagaggug

SEQ ID NO: 22353 - RNA, 21 nt, Artificial Sequence
  RNA Oligomer
ugaggugaaauguccuguucc

SEQ ID NO: 22354 - RNA, 21 nt, Artificial Sequence
  RNA Oligomer
aacauuggguucuccucggac

SEQ ID NO: 22355 - RNA, 21 nt, Artificial Sequence
  RNA Oligomer
aacagcugauacauauacaac

SEQ ID NO: 22356 - RNA, 21 nt, Artificial Sequence
  RNA Oligomer
auaaggaugguagccagaggu

SEQ ID NO: 22357 - RNA, 21 nt, Artificial Sequence
  RNA Oligomer
uauagcugacuucuuguggcc

SEQ ID NO: 22358 - RNA, 21 nt, Artificial Sequence
  RNA Oligomer
auagcugacuucuuguggccu

SEQ ID NO: 22359 - RNA, 21 nt, Artificial Sequence
  RNA Oligomer
augcagaagcagcauuauugg

SEQ ID NO: 22360 - RNA, 21 nt, Artificial Sequence
  RNA Oligomer
uagccagagguggauuacuug

SEQ ID NO: 22361 - RNA, 21 nt, Artificial Sequence
  RNA Oligomer
guaguuugacauuuggguccc

SEQ ID NO: 22362 - RNA, 21 nt, Artificial Sequence
  RNA Oligomer
uuugcucccuuguuggaguuc

SEQ ID NO: 22363 - RNA, 21 nt, Artificial Sequence
  RNA Oligomer
uugcucccuuguuggaguucc

SEQ ID NO: 22364 - RNA, 21 nt, Artificial Sequence
  RNA Oligomer
gaaacauuggguucuccucgg

SEQ ID NO: 22365 - RNA, 21 nt, Artificial Sequence
  RNA Oligomer
auccauuuccaaucacuuuag

SEQ ID NO: 22366 - RNA, 21 nt, Artificial Sequence
  RNA Oligomer
cugcuaacuuucaugcugcca

SEQ ID NO: 22367 - RNA, 21 nt, Artificial Sequence
  RNA Oligomer
augcugccaaaagcugaaggc

SEQ ID NO: 22368 - RNA, 21 nt, Artificial Sequence
  RNA Oligomer
uacuugacaguucuugagugg

SEQ ID NO: 22369 - RNA, 21 nt, Artificial Sequence
  RNA Oligomer
cugaggugaaauguccuguuc

SEQ ID NO: 22370 - RNA, 21 nt, Artificial Sequence
  RNA Oligomer
uuaaauucuguguaguuuggg

SEQ ID NO: 22371 - RNA, 21 nt, Artificial Sequence
  RNA Oligomer
cauuucucugauuugcucccu

SEQ ID NO: 22372 - RNA, 21 nt, Artificial Sequence
  RNA Oligomer
uacgaaacauuggguucuccu

SEQ ID NO: 22373 - RNA, 21 nt, Artificial Sequence
  RNA Oligomer
acuggaguagaagaaauaacg

SEQ ID NO: 22374 - RNA, 21 nt, Artificial Sequence
  RNA Oligomer
uuuggcuugauauaccacacc

SEQ ID NO: 22375 - RNA, 21 nt, Artificial Sequence
  RNA Oligomer
uugaagcagcugcuugaaucc

SEQ ID NO: 22376 - RNA, 21 nt, Artificial Sequence
  RNA Oligomer
aggaauaaggaugguagccag

SEQ ID NO: 22377 - RNA, 21 nt, Artificial Sequence
  RNA Oligomer
aaugaaugugcacaagcuucc

SEQ ID NO: 22378 - RNA, 21 nt, Artificial Sequence
  RNA Oligomer
uccugaggugaaauguccugu

SEQ ID NO: 22379 - RNA, 21 nt, Artificial Sequence
  RNA Oligomer
uuccugacgaauccuuagucc

SEQ ID NO: 22380 - RNA, 21 nt, Artificial Sequence
  RNA Oligomer
auucuguguaguuuggguuca

SEQ ID NO: 22381 - RNA, 21 nt, Artificial Sequence
  RNA Oligomer
aaacauuggguucuccucgga

SEQ ID NO: 22382 - RNA, 21 nt, Artificial Sequence
  RNA Oligomer
uuuuaauacagcaguaucagg

SEQ ID NO: 22383 - RNA, 21 nt, Artificial Sequence
  RNA Oligomer
aaagaaaaagacuucguccuc

SEQ ID NO: 22384 - RNA, 21 nt, Artificial Sequence
  RNA Oligomer
aaaaagacuucguccucuugg

SEQ ID NO: 22385 - RNA, 21 nt, Artificial Sequence
  RNA Oligomer
aacuugacauaaaucacaggg

SEQ ID NO: 22386 - RNA, 21 nt, Artificial Sequence
  RNA Oligomer
aaucacagggagcgucuguuu

SEQ ID NO: 22387 - RNA, 21 nt, Artificial Sequence
  RNA Oligomer
uuucuugauggcgaccaguuc

SEQ ID NO: 22388 - RNA, 21 nt, Artificial Sequence
  RNA Oligomer
agugucuguauagcugacuuc

SEQ ID NO: 22389 - RNA, 21 nt, Artificial Sequence
  RNA Oligomer
gugucuguauagcugacuucu

SEQ ID NO: 22390 - RNA, 21 nt, Artificial Sequence
  RNA Oligomer
gucucugcuaacuuucaugcu

SEQ ID NO: 22391 - RNA, 21 nt, Artificial Sequence
  RNA Oligomer
uacacagugcaauugccuccg

SEQ ID NO: 22392 - RNA, 21 nt, Artificial Sequence
  RNA Oligomer
auuucucugauuugcucccuu

SEQ ID NO: 22393 - RNA, 21 nt, Artificial Sequence
  RNA Oligomer
auauugguuguccuaguaaca

SEQ ID NO: 22394 - RNA, 21 nt, Artificial Sequence
  RNA Oligomer
guuuuaauacagcaguaucag

SEQ ID NO: 22395 - RNA, 21 nt, Artificial Sequence
  RNA Oligomer
aucacagggagcgucuguuug

SEQ ID NO: 22396 - RNA, 21 nt, Artificial Sequence
  RNA Oligomer
uggcucgacuauagugucugg

SEQ ID NO: 22397 - RNA, 21 nt, Artificial Sequence
  RNA Oligomer
cacaccaaaugauccauuucc

SEQ ID NO: 22398 - RNA, 21 nt, Artificial Sequence
  RNA Oligomer
acaccaaaugauccauuucca

SEQ ID NO: 22399 - RNA, 21 nt, Artificial Sequence
  RNA Oligomer
aacuggugguuuuuccugugc

SEQ ID NO: 22400 - RNA, 21 nt, Artificial Sequence
  RNA Oligomer
ugguuuuuccugugcagcugg

SEQ ID NO: 22401 - RNA, 21 nt, Artificial Sequence
  RNA Oligomer
aguuugacauuugggucccgu

SEQ ID NO: 22402 - RNA, 21 nt, Artificial Sequence
  RNA Oligomer
uuugggucccguaauucauca

SEQ ID NO: 22403 - RNA, 21 nt, Artificial Sequence
  RNA Oligomer
acaagcuuccagugguguuag

SEQ ID NO: 22404 - RNA, 21 nt, Artificial Sequence
  RNA Oligomer
gaugugccuuaauuugaggga

SEQ ID NO: 22405 - RNA, 21 nt, Artificial Sequence
  RNA Oligomer
ucauuucucugauuugcuccc

SEQ ID NO: 22406 - RNA, 21 nt, Artificial Sequence
  RNA Oligomer
uugcacuuccaaagucacaga

SEQ ID NO: 22407 - RNA, 21 nt, Artificial Sequence
  RNA Oligomer
ugcacuuccaaagucacagag

SEQ ID NO: 22408 - RNA, 21 nt, Artificial Sequence
  RNA Oligomer
uuucucaugaucuggagcucu

SEQ ID NO: 22409 - RNA, 21 nt, Artificial Sequence
  RNA Oligomer
uugauggcgaccaguucuccu

SEQ ID NO: 22410 - RNA, 21 nt, Artificial Sequence
  RNA Oligomer
aaguuuggcuugauauaccac

SEQ ID NO: 22411 - RNA, 21 nt, Artificial Sequence
  RNA Oligomer
cagagguggauuacuugacag

SEQ ID NO: 22412 - RNA, 21 nt, Artificial Sequence
  RNA Oligomer
auuacuugacaguucuugagu

SEQ ID NO: 22413 - RNA, 21 nt, Artificial Sequence
  RNA Oligomer
uugaagagugcaggugugucu

SEQ ID NO: 22414 - RNA, 21 nt, Artificial Sequence
  RNA Oligomer
ugaagagugcaggugugucuc

SEQ ID NO: 22415 - RNA, 21 nt, Artificial Sequence
  RNA Oligomer
auuugggucccguaauucauc

SEQ ID NO: 22416 - RNA, 21 nt, Artificial Sequence
  RNA Oligomer
aaaaugaaugugcacaagcuu

SEQ ID NO: 22417 - RNA, 21 nt, Artificial Sequence
  RNA Oligomer
aaaugaaugugcacaagcuuc

SEQ ID NO: 22418 - RNA, 21 nt, Artificial Sequence
  RNA Oligomer
aagcuuccagugguguuaguc

SEQ ID NO: 22419 - RNA, 21 nt, Artificial Sequence
  RNA Oligomer
acggcuacacagugcaauugc

SEQ ID NO: 22420 - RNA, 21 nt, Artificial Sequence
  RNA Oligomer
ugaaauguccuguuccugacg

SEQ ID NO: 22421 - RNA, 21 nt, Artificial Sequence
  RNA Oligomer
augugccuuaauuugagggaa

SEQ ID NO: 22422 - RNA, 21 nt, Artificial Sequence
  RNA Oligomer
uauugguuguccuaguaacag

SEQ ID NO: 22423 - RNA, 21 nt, Artificial Sequence
  RNA Oligomer
uugguuguccuaguaacagcu

SEQ ID NO: 22424 - RNA, 21 nt, Artificial Sequence
  RNA Oligomer
aaaagacuucguccucuuggc

SEQ ID NO: 22425 - RNA, 21 nt, Artificial Sequence
  RNA Oligomer
ucgauucuuaaaucucuuguc

SEQ ID NO: 22426 - RNA, 21 nt, Artificial Sequence
  RNA Oligomer
ugcaauacuuucuugauggcg

SEQ ID NO: 22427 - RNA, 21 nt, Artificial Sequence
  RNA Oligomer
aaaguuuggcuugauauacca

SEQ ID NO: 22428 - RNA, 21 nt, Artificial Sequence
  RNA Oligomer
auuuccaaucacuuuaguguc

SEQ ID NO: 22429 - RNA, 21 nt, Artificial Sequence
  RNA Oligomer
aucacuuuagugucuguauag

SEQ ID NO: 22430 - RNA, 21 nt, Artificial Sequence
  RNA Oligomer
gacauuugggucccguaauuc

SEQ ID NO: 22431 - RNA, 21 nt, Artificial Sequence
  RNA Oligomer
agcuuccagugguguuagucg

SEQ ID NO: 22432 - RNA, 21 nt, Artificial Sequence
  RNA Oligomer
auugguuguccuaguaacagc

SEQ ID NO: 22433 - RNA, 21 nt, Artificial Sequence
  RNA Oligomer
uuuaauacagcaguaucagga

SEQ ID NO: 22434 - RNA, 21 nt, Artificial Sequence
  RNA Oligomer
uuaauacagcaguaucaggau

SEQ ID NO: 22435 - RNA, 21 nt, Artificial Sequence
  RNA Oligomer
aagaaaaagacuucguccucu

SEQ ID NO: 22436 - RNA, 21 nt, Artificial Sequence
  RNA Oligomer
aaacuucggaacagcugauac

SEQ ID NO: 22437 - RNA, 21 nt, Artificial Sequence
  RNA Oligomer
uuggcucgacuauagugucug

SEQ ID NO: 22438 - RNA, 21 nt, Artificial Sequence
  RNA Oligomer
uuaagauagaccucaucuuuc

SEQ ID NO: 22439 - RNA, 21 nt, Artificial Sequence
  RNA Oligomer
uauguuacagugaucuagcuu

SEQ ID NO: 22440 - RNA, 21 nt, Artificial Sequence
  RNA Oligomer
cucgauucuuaaaucucuugu

SEQ ID NO: 22441 - RNA, 21 nt, Artificial Sequence
  RNA Oligomer
acaaaguuuggcuugauauac

SEQ ID NO: 22442 - RNA, 21 nt, Artificial Sequence
  RNA Oligomer
uccauuuccaaucacuuuagu

SEQ ID NO: 22443 - RNA, 21 nt, Artificial Sequence
  RNA Oligomer
guauagcugacuucuuguggc

SEQ ID NO: 22444 - RNA, 21 nt, Artificial Sequence
  RNA Oligomer
acuuucaugcugccaaaagcu

SEQ ID NO: 22445 - RNA, 21 nt, Artificial Sequence
  RNA Oligomer
uggugguuuuuccugugcagc

SEQ ID NO: 22446 - RNA, 21 nt, Artificial Sequence
  RNA Oligomer
gcauuauuggucuguccacgg

SEQ ID NO: 22447 - RNA, 21 nt, Artificial Sequence
  RNA Oligomer
uugaauccgagcaugaggagg

SEQ ID NO: 22448 - RNA, 21 nt, Artificial Sequence
  RNA Oligomer
ugguaguuugacauuuggguc

SEQ ID NO: 22449 - RNA, 21 nt, Artificial Sequence
  RNA Oligomer
uaguccaaggaugugccuuaa

SEQ ID NO: 22450 - RNA, 21 nt, Artificial Sequence
  RNA Oligomer
cccuggaaauauugguugucc

SEQ ID NO: 22451 - RNA, 21 nt, Artificial Sequence
  RNA Oligomer
ugguuguccuaguaacagcuc

SEQ ID NO: 22452 - RNA, 21 nt, Artificial Sequence
  RNA Oligomer
aaaagaaaaagacuucguccu

SEQ ID NO: 22453 - RNA, 21 nt, Artificial Sequence
  RNA Oligomer
aauacagcaguaucaggaucc

SEQ ID NO: 22454 - RNA, 21 nt, Artificial Sequence
  RNA Oligomer
aaagacuucguccucuuggcu

SEQ ID NO: 22455 - RNA, 21 nt, Artificial Sequence
  RNA Oligomer
uauaggcuaaacuucggaaca

SEQ ID NO: 22456 - RNA, 21 nt, Artificial Sequence
  RNA Oligomer
caacuugacauaaaucacagg

SEQ ID NO: 22457 - RNA, 21 nt, Artificial Sequence
  RNA Oligomer
uaaaucacagggagcgucugu

SEQ ID NO: 22458 - RNA, 21 nt, Artificial Sequence
  RNA Oligomer
cuauagugucuggcaacucug

SEQ ID NO: 22459 - RNA, 21 nt, Artificial Sequence
  RNA Oligomer
uuuccggaacauaguccagca

SEQ ID NO: 22460 - RNA, 21 nt, Artificial Sequence
  RNA Oligomer
uacagugaucuagcuuucuca

SEQ ID NO: 22461 - RNA, 21 nt, Artificial Sequence
  RNA Oligomer
ucucgauucuuaaaucucuug

SEQ ID NO: 22462 - RNA, 21 nt, Artificial Sequence
  RNA Oligomer
cgauucuuaaaucucuugucc

SEQ ID NO: 22463 - RNA, 21 nt, Artificial Sequence
  RNA Oligomer
uacuuucuugauggcgaccag

SEQ ID NO: 22464 - RNA, 21 nt, Artificial Sequence
  RNA Oligomer
uuucaugcugccaaaagcuga

SEQ ID NO: 22465 - RNA, 21 nt, Artificial Sequence
  RNA Oligomer
uaacuggugguuuuuccugug

SEQ ID NO: 22466 - RNA, 21 nt, Artificial Sequence
  RNA Oligomer
uggaguuggaagcugaugcag

SEQ ID NO: 22467 - RNA, 21 nt, Artificial Sequence
  RNA Oligomer
aguauuagcaucugacgcugc

SEQ ID NO: 22468 - RNA, 21 nt, Artificial Sequence
  RNA Oligomer
ugguagccagagguggauuac

SEQ ID NO: 22469 - RNA, 21 nt, Artificial Sequence
  RNA Oligomer
uuacuugacaguucuugagug

SEQ ID NO: 22470 - RNA, 21 nt, Artificial Sequence
  RNA Oligomer
cacuccugaggugaaaugucc

SEQ ID NO: 22471 - RNA, 21 nt, Artificial Sequence
  RNA Oligomer
gaauccuuaguccaaggaugu

SEQ ID NO: 22472 - RNA, 21 nt, Artificial Sequence
  RNA Oligomer
uuguuggaguucccaggaccu

SEQ ID NO: 22473 - RNA, 21 nt, Artificial Sequence
  RNA Oligomer
uguuuccggaacauaguccag

SEQ ID NO: 22474 - RNA, 21 nt, Artificial Sequence
  RNA Oligomer
agauuaagauagaccucaucu

SEQ ID NO: 22475 - RNA, 21 nt, Artificial Sequence
  RNA Oligomer
uuggcuugauauaccacacca

SEQ ID NO: 22476 - RNA, 21 nt, Artificial Sequence
  RNA Oligomer
uuuccaaucacuuuagugucu

SEQ ID NO: 22477 - RNA, 21 nt, Artificial Sequence
  RNA Oligomer
cuuuagugucuguauagcuga

SEQ ID NO: 22478 - RNA, 21 nt, Artificial Sequence
  RNA Oligomer
uuagugucuguauagcugacu

SEQ ID NO: 22479 - RNA, 21 nt, Artificial Sequence
  RNA Oligomer
aacuuucaugcugccaaaagc

SEQ ID NO: 22480 - RNA, 21 nt, Artificial Sequence
  RNA Oligomer
aaguaacuggugguuuuuccu

SEQ ID NO: 22481 - RNA, 21 nt, Artificial Sequence
  RNA Oligomer
aguaacuggugguuuuuccug

SEQ ID NO: 22482 - RNA, 21 nt, Artificial Sequence
  RNA Oligomer
aagcugaugcagaagcagcau

SEQ ID NO: 22483 - RNA, 21 nt, Artificial Sequence
  RNA Oligomer
agcagcauuauuggucugucc

SEQ ID NO: 22484 - RNA, 21 nt, Artificial Sequence
  RNA Oligomer
auacuccagcagacggcuaca

SEQ ID NO: 22485 - RNA, 21 nt, Artificial Sequence
  RNA Oligomer
cuacacagugcaauugccucc

SEQ ID NO: 22486 - RNA, 21 nt, Artificial Sequence
  RNA Oligomer
aggugaaauguccuguuccug

SEQ ID NO: 22487 - RNA, 21 nt, Artificial Sequence
  RNA Oligomer
uccugacgaauccuuagucca

SEQ ID NO: 22488 - RNA, 21 nt, Artificial Sequence
  RNA Oligomer
ggaugugccuuaauuugaggg

SEQ ID NO: 22489 - RNA, 21 nt, Artificial Sequence
  RNA Oligomer
gucuggcaacucuguauacug

SEQ ID NO: 22490 - RNA, 21 nt, Artificial Sequence
  RNA Oligomer
uuccggaacauaguccagcac

SEQ ID NO: 22491 - RNA, 21 nt, Artificial Sequence
  RNA Oligomer
auaguccagcaccagauuaag

SEQ ID NO: 22492 - RNA, 21 nt, Artificial Sequence
  RNA Oligomer
uucuucucaccacuggaguag

SEQ ID NO: 22493 - RNA, 21 nt, Artificial Sequence
  RNA Oligomer
guuacagugaucuagcuuucu

SEQ ID NO: 22494 - RNA, 21 nt, Artificial Sequence
  RNA Oligomer
ucuagcuuucucaugaucugg

SEQ ID NO: 22495 - RNA, 21 nt, Artificial Sequence
  RNA Oligomer
agcucucgauucuuaaaucuc

SEQ ID NO: 22496 - RNA, 21 nt, Artificial Sequence
  RNA Oligomer
cuccaguauuagcaucugacg

SEQ ID NO: 22497 - RNA, 21 nt, Artificial Sequence
  RNA Oligomer
uccaguauuagcaucugacgc

SEQ ID NO: 22498 - RNA, 21 nt, Artificial Sequence
  RNA Oligomer
ugaagcagcugcuugaauccg

SEQ ID NO: 22499 - RNA, 21 nt, Artificial Sequence
  RNA Oligomer
caguugguguauacuccagca

SEQ ID NO: 22500 - RNA, 21 nt, Artificial Sequence
  RNA Oligomer
aguugguguauacuccagcag

SEQ ID NO: 22501 - RNA, 21 nt, Artificial Sequence
  RNA Oligomer
acuccugaggugaaauguccu

SEQ ID NO: 22502 - RNA, 21 nt, Artificial Sequence
  RNA Oligomer
auuugcucccuuguuggaguu

SEQ ID NO: 22503 - RNA, 21 nt, Artificial Sequence
  RNA Oligomer
accauacaucuauacuagagg

SEQ ID NO: 22504 - RNA, 21 nt, Artificial Sequence
  RNA Oligomer
uaauacagcaguaucaggauc

SEQ ID NO: 22505 - RNA, 21 nt, Artificial Sequence
  RNA Oligomer
auaaaucacagggagcgucug

SEQ ID NO: 22506 - RNA, 21 nt, Artificial Sequence
  RNA Oligomer
uuuggcucgacuauagugucu

SEQ ID NO: 22507 - RNA, 21 nt, Artificial Sequence
  RNA Oligomer
gugucuggcaacucuguauac

SEQ ID NO: 22508 - RNA, 21 nt, Artificial Sequence
  RNA Oligomer
uguuacagugaucuagcuuuc

SEQ ID NO: 22509 - RNA, 21 nt, Artificial Sequence
  RNA Oligomer
uagcuuucucaugaucuggag

SEQ ID NO: 22510 - RNA, 21 nt, Artificial Sequence
  RNA Oligomer
cuuucucaugaucuggagcuc

SEQ ID NO: 22511 - RNA, 21 nt, Artificial Sequence
  RNA Oligomer
gauucuuaaaucucuuguccu

SEQ ID NO: 22512 - RNA, 21 nt, Artificial Sequence
  RNA Oligomer
uuuagugucuguauagcugac

SEQ ID NO: 22513 - RNA, 21 nt, Artificial Sequence
  RNA Oligomer
uggaagcugaugcagaagcag

SEQ ID NO: 22514 - RNA, 21 nt, Artificial Sequence
  RNA Oligomer
agaagcagcauuauuggucug

SEQ ID NO: 22515 - RNA, 21 nt, Artificial Sequence
  RNA Oligomer
aagcagcauuauuggucuguc

SEQ ID NO: 22516 - RNA, 21 nt, Artificial Sequence
  RNA Oligomer
uauuagcaucugacgcugcug

SEQ ID NO: 22517 - RNA, 21 nt, Artificial Sequence
  RNA Oligomer
aagcagcugcuugaauccgag

SEQ ID NO: 22518 - RNA, 21 nt, Artificial Sequence
  RNA Oligomer
uguauacuccagcagacggcu

SEQ ID NO: 22519 - RNA, 21 nt, Artificial Sequence
  RNA Oligomer
guuccugacgaauccuuaguc

SEQ ID NO: 22520 - RNA, 21 nt, Artificial Sequence
  RNA Oligomer
auccuuaguccaaggaugugc

SEQ ID NO: 22521 - RNA, 21 nt, Artificial Sequence
  RNA Oligomer
uccuuaguccaaggaugugcc

SEQ ID NO: 22522 - RNA, 21 nt, Artificial Sequence
  RNA Oligomer
gaaaaagacuucguccucuug

SEQ ID NO: 22523 - RNA, 21 nt, Artificial Sequence
  RNA Oligomer
acuugacauaaaucacaggga

SEQ ID NO: 22524 - RNA, 21 nt, Artificial Sequence
  RNA Oligomer
cuugacauaaaucacagggag

SEQ ID NO: 22525 - RNA, 21 nt, Artificial Sequence
  RNA Oligomer
guuuggcucgacuauaguguc

SEQ ID NO: 22526 - RNA, 21 nt, Artificial Sequence
  RNA Oligomer
gacuauagugucuggcaacuc

SEQ ID NO: 22527 - RNA, 21 nt, Artificial Sequence
  RNA Oligomer
uauagugucuggcaacucugu

SEQ ID NO: 22528 - RNA, 21 nt, Artificial Sequence
  RNA Oligomer
acuauguuacagugaucuagc

SEQ ID NO: 22529 - RNA, 21 nt, Artificial Sequence
  RNA Oligomer
cuccugaaucacaaaguuugg

SEQ ID NO: 22530 - RNA, 21 nt, Artificial Sequence
  RNA Oligomer
guuuggcuugauauaccacac

SEQ ID NO: 22531 - RNA, 21 nt, Artificial Sequence
  RNA Oligomer
caugcugccaaaagcugaagg

SEQ ID NO: 22532 - RNA, 21 nt, Artificial Sequence
  RNA Oligomer
aguguugcugagugacacuca

SEQ ID NO: 22533 - RNA, 21 nt, Artificial Sequence
  RNA Oligomer
uuggaagcugaugcagaagca

SEQ ID NO: 22534 - RNA, 21 nt, Artificial Sequence
  RNA Oligomer
gaagcagcauuauuggucugu

SEQ ID NO: 22535 - RNA, 21 nt, Artificial Sequence
  RNA Oligomer
uauuggucuguccacggucuc

SEQ ID NO: 22536 - RNA, 21 nt, Artificial Sequence
  RNA Oligomer
uuagcaucugacgcugcugug

SEQ ID NO: 22537 - RNA, 21 nt, Artificial Sequence
  RNA Oligomer
cuugaauccgagcaugaggag

SEQ ID NO: 22538 - RNA, 21 nt, Artificial Sequence
  RNA Oligomer
acuugacaguucuugaguggu

SEQ ID NO: 22539 - RNA, 21 nt, Artificial Sequence
  RNA Oligomer
aaaaaugaaugugcacaagcu

SEQ ID NO: 22540 - RNA, 21 nt, Artificial Sequence
  RNA Oligomer
augugcacaagcuuccagugg

SEQ ID NO: 22541 - RNA, 21 nt, Artificial Sequence
  RNA Oligomer
uguccuguuccugacgaaucc

SEQ ID NO: 22542 - RNA, 21 nt, Artificial Sequence
  RNA Oligomer
ugagggaauuuaaauucugug

SEQ ID NO: 22543 - RNA, 21 nt, Artificial Sequence
  RNA Oligomer
gagggaauuuaaauucugugu

SEQ ID NO: 22544 - RNA, 21 nt, Artificial Sequence
  RNA Oligomer
auacagcaguaucaggaucca

SEQ ID NO: 22545 - RNA, 21 nt, Artificial Sequence
  RNA Oligomer
ucucaugaucuggagcucucg

SEQ ID NO: 22546 - RNA, 21 nt, Artificial Sequence
  RNA Oligomer
augaucuggagcucucgauuc

SEQ ID NO: 22547 - RNA, 21 nt, Artificial Sequence
  RNA Oligomer
gagcucucgauucuuaaaucu

SEQ ID NO: 22548 - RNA, 21 nt, Artificial Sequence
  RNA Oligomer
uuccaaucacuuuagugucug

SEQ ID NO: 22549 - RNA, 21 nt, Artificial Sequence
  RNA Oligomer
cacuuuagugucuguauagcu

SEQ ID NO: 22550 - RNA, 21 nt, Artificial Sequence
  RNA Oligomer
ugcugccaaaagcugaaggcu

SEQ ID NO: 22551 - RNA, 21 nt, Artificial Sequence
  RNA Oligomer
uuauuggucuguccacggucu

SEQ ID NO: 22552 - RNA, 21 nt, Artificial Sequence
  RNA Oligomer
ugguguauacuccagcagacg

SEQ ID NO: 22553 - RNA, 21 nt, Artificial Sequence
  RNA Oligomer
guccuguuccugacgaauccu

SEQ ID NO: 22554 - RNA, 21 nt, Artificial Sequence
  RNA Oligomer
uaggcuaaacuucggaacagc

SEQ ID NO: 22555 - RNA, 21 nt, Artificial Sequence
  RNA Oligomer
uaagauagaccucaucuuucu

SEQ ID NO: 22556 - RNA, 21 nt, Artificial Sequence
  RNA Oligomer
gaucuagcuuucucaugaucu

SEQ ID NO: 22557 - RNA, 21 nt, Artificial Sequence
  RNA Oligomer
agcuuucucaugaucuggagc

SEQ ID NO: 22558 - RNA, 21 nt, Artificial Sequence
  RNA Oligomer
aggaguugccaccacuguugu

SEQ ID NO: 22559 - RNA, 21 nt, Artificial Sequence
  RNA Oligomer
uugcugagugacacucaagua

SEQ ID NO: 22560 - RNA, 21 nt, Artificial Sequence
  RNA Oligomer
ugacacucaaguaacuggugg

SEQ ID NO: 22561 - RNA, 21 nt, Artificial Sequence
  RNA Oligomer
caguauuagcaucugacgcug

SEQ ID NO: 22562 - RNA, 21 nt, Artificial Sequence
  RNA Oligomer
gggaauuuaaauucuguguag

SEQ ID NO: 22563 - RNA, 21 nt, Artificial Sequence
  RNA Oligomer
gaaaaagaaaaagacuucguc

SEQ ID NO: 22564 - RNA, 21 nt, Artificial Sequence
  RNA Oligomer
aagauagaccucaucuuucuu

SEQ ID NO: 22565 - RNA, 21 nt, Artificial Sequence
  RNA Oligomer
ugagugacacucaaguaacug

SEQ ID NO: 22566 - RNA, 21 nt, Artificial Sequence
  RNA Oligomer
agugacacucaaguaacuggu

SEQ ID NO: 22567 - RNA, 21 nt, Artificial Sequence
  RNA Oligomer
gugacacucaaguaacuggug

SEQ ID NO: 22568 - RNA, 21 nt, Artificial Sequence
  RNA Oligomer
gucuccaguauuagcaucuga

SEQ ID NO: 22569 - RNA, 21 nt, Artificial Sequence
  RNA Oligomer
auuagcaucugacgcugcugu

SEQ ID NO: 22570 - RNA, 21 nt, Artificial Sequence
  RNA Oligomer
ugacgaauccuuaguccaagg

SEQ ID NO: 22571 - RNA, 21 nt, Artificial Sequence
  RNA Oligomer
aauccuuaguccaaggaugug

SEQ ID NO: 22572 - RNA, 21 nt, Artificial Sequence
  RNA Oligomer
ccuuaguccaaggaugugccu

SEQ ID NO: 22573 - RNA, 21 nt, Artificial Sequence
  RNA Oligomer
uucucaccacuggaguagaag

SEQ ID NO: 22574 - RNA, 21 nt, Artificial Sequence
  RNA Oligomer
uccaaucacuuuagugucugu

SEQ ID NO: 22575 - RNA, 21 nt, Artificial Sequence
  RNA Oligomer
gagugacacucaaguaacugg

SEQ ID NO: 22576 - RNA, 21 nt, Artificial Sequence
  RNA Oligomer
uaguuuggguucauuucucug

SEQ ID NO: 22577 - RNA, 21 nt, Artificial Sequence
  RNA Oligomer
uggguucauuucucugauuug

SEQ ID NO: 22578 - RNA, 21 nt, Artificial Sequence
  RNA Oligomer
gauagaccucaucuuucuucu

SEQ ID NO: 22579 - RNA, 21 nt, Artificial Sequence
  RNA Oligomer
uccugaaucacaaaguuuggc

SEQ ID NO: 22580 - RNA, 21 nt, Artificial Sequence
  RNA Oligomer
ugcacaagcuuccaguggugu

SEQ ID NO: 22581 - RNA, 21 nt, Artificial Sequence
  RNA Oligomer
cuguuuccggaacauagucca

SEQ ID NO: 22582 - RNA, 21 nt, Artificial Sequence
  RNA Oligomer
agauagaccucaucuuucuuc

SEQ ID NO: 22583 - RNA, 21 nt, Artificial Sequence
  RNA Oligomer
aggaugugccuuaauuugagg

SEQ ID NO: 22584 - RNA, 21 nt, Artificial Sequence
  RNA Oligomer
aaucacaaaguuuggcuugau

SEQ ID NO: 22585 - RNA, 21 nt, Artificial Sequence
  RNA Oligomer
guucagguggaguuggaagcu

SEQ ID NO: 22586 - RNA, 21 nt, Artificial Sequence
  RNA Oligomer
aaggaugugccuuaauuugag

SEQ ID NO: 22587 - RNA, 21 nt, Artificial Sequence
  RNA Oligomer
ugaaucacaaaguuuggcuug

SEQ ID NO: 22588 - RNA, 21 nt, Artificial Sequence
  RNA Oligomer
guuuuuccugugcagcuggcu

SEQ ID NO: 22589 - RNA, 21 nt, Artificial Sequence
  RNA Oligomer
uucagguggaguuggaagcug

SEQ ID NO: 22590 - RNA, 21 nt, Artificial Sequence
  RNA Oligomer
uuuuuccugugcagcuggcug

SEQ ID NO: 22591 - RNA, 21 nt, Artificial Sequence
  RNA Oligomer
ucagguggaguuggaagcuga

SEQ ID NO: 22592 - RNA, 21 nt, Artificial Sequence
  RNA Oligomer
aguuuggguucauuucucuga

SEQ ID NO: 22593 - RNA, 21 nt, Artificial Sequence
  RNA Oligomer
uauacuguuuccggaacauag

SEQ ID NO: 22594 - RNA, 21 nt, Artificial Sequence
  RNA Oligomer
uacuguuuccggaacauaguc

SEQ ID NO: 22595 - RNA, 21 nt, Artificial Sequence
  RNA Oligomer
guaguuuggguucauuucucu

SEQ ID NO: 22596 - RNA, 21 nt, Artificial Sequence
  RNA Oligomer
guggaguuggaagcugaugca

SEQ ID NO: 22597 - RNA, 21 nt, Artificial Sequence
  RNA Oligomer
acuguuuccggaacauagucc

SEQ ID NO: 22598 - RNA, 21 nt, Artificial Sequence
  RNA Oligomer
ugcuuugcacuuccaaaguca

SEQ ID NO: 22599 - RNA, 21 nt, Artificial Sequence
  RNA Oligomer
ugaucaucuuuuccuacguuu

SEQ ID NO: 22600 - RNA, 21 nt, Artificial Sequence
  RNA Oligomer
gugaucaucuuuuccuacguu

SEQ ID NO: 22601 - RNA, 21 nt, Artificial Sequence
  RNA Oligomer
ccacgugaucaucuuuuccua

SEQ ID NO: 22602 - RNA, 21 nt, Artificial Sequence
  RNA Oligomer
cgugaucaucuuuuccuacgu

SEQ ID NO: 22603 - RNA, 21 nt, Artificial Sequence
  RNA Oligomer
cgagaaacaggcgauaauuuu

SEQ ID NO: 22604 - RNA, 21 nt, Artificial Sequence
  RNA Oligomer
ggcgauaauuuuucagaugug

SEQ ID NO: 22605 - RNA, 21 nt, Artificial Sequence
  RNA Oligomer
ccgagaaacaggcgauaauuu

SEQ ID NO: 22606 - RNA, 21 nt, Artificial Sequence
  RNA Oligomer
cgcagacuacaccuucccuuu

SEQ ID NO: 22607 - RNA, 21 nt, Artificial Sequence
  RNA Oligomer
caucuuuuccuacguuugcuu

SEQ ID NO: 22608 - RNA, 21 nt, Artificial Sequence
  RNA Oligomer
cggaggaaaauuugacauuau

SEQ ID NO: 22609 - RNA, 21 nt, Artificial Sequence
  RNA Oligomer
ccaguaugagacgaacaaagu

SEQ ID NO: 22610 - RNA, 21 nt, Artificial Sequence
  RNA Oligomer
uucuuccacgugaucaucuuu

SEQ ID NO: 22611 - RNA, 21 nt, Artificial Sequence
  RNA Oligomer
ggagauacagcugcuuagaaa

SEQ ID NO: 22612 - RNA, 21 nt, Artificial Sequence
  RNA Oligomer
gccaaagccgacauuaaagua

SEQ ID NO: 22613 - RNA, 21 nt, Artificial Sequence
  RNA Oligomer
ggaggaaaauuugacauuauc

SEQ ID NO: 22614 - RNA, 21 nt, Artificial Sequence
  RNA Oligomer
ccggaggaaaauuugacauua

SEQ ID NO: 22615 - RNA, 21 nt, Artificial Sequence
  RNA Oligomer
acaggcgauaauuuuucagau

SEQ ID NO: 22616 - RNA, 21 nt, Artificial Sequence
  RNA Oligomer
ccagguuuaaacaucacuugu

SEQ ID NO: 22617 - RNA, 21 nt, Artificial Sequence
  RNA Oligomer
caacuacaccacgagaaacau

SEQ ID NO: 22618 - RNA, 21 nt, Artificial Sequence
  RNA Oligomer
gaucaucuuuuccuacguuug

SEQ ID NO: 22619 - RNA, 21 nt, Artificial Sequence
  RNA Oligomer
cacgugaucaucuuuuccuac

SEQ ID NO: 22620 - RNA, 21 nt, Artificial Sequence
  RNA Oligomer
cugauaaaagucuucgggauc

SEQ ID NO: 22621 - RNA, 21 nt, Artificial Sequence
  RNA Oligomer
agguuuaaacaucacuuguac

SEQ ID NO: 22622 - RNA, 21 nt, Artificial Sequence
  RNA Oligomer
ugccgaaaacuucacugugcu

SEQ ID NO: 22623 - RNA, 21 nt, Artificial Sequence
  RNA Oligomer
ggagaauggagugaagaaguu

SEQ ID NO: 22624 - RNA, 21 nt, Artificial Sequence
  RNA Oligomer
aucuuuuccuacguuugcuuu

SEQ ID NO: 22625 - RNA, 21 nt, Artificial Sequence
  RNA Oligomer
ccaaagccgacauuaaaguau

SEQ ID NO: 22626 - RNA, 21 nt, Artificial Sequence
  RNA Oligomer
agagcaugaauuauggcacca

SEQ ID NO: 22627 - RNA, 21 nt, Artificial Sequence
  RNA Oligomer
ccagagcaugaauuauggcac

SEQ ID NO: 22628 - RNA, 21 nt, Artificial Sequence
  RNA Oligomer
cucugauaaaagucuucggga

SEQ ID NO: 22629 - RNA, 21 nt, Artificial Sequence
  RNA Oligomer
cgauaauuuuucagauguggc

SEQ ID NO: 22630 - RNA, 21 nt, Artificial Sequence
  RNA Oligomer
gcgauaauuuuucagaugugg

SEQ ID NO: 22631 - RNA, 21 nt, Artificial Sequence
  RNA Oligomer
aggcgauaauuuuucagaugu

SEQ ID NO: 22632 - RNA, 21 nt, Artificial Sequence
  RNA Oligomer
caggcgauaauuuuucagaug

SEQ ID NO: 22633 - RNA, 21 nt, Artificial Sequence
  RNA Oligomer
gccagguuuaaacaucacuug

SEQ ID NO: 22634 - RNA, 21 nt, Artificial Sequence
  RNA Oligomer
cgcagagcaaaggaauucaga

SEQ ID NO: 22635 - RNA, 21 nt, Artificial Sequence
  RNA Oligomer
ccgcagagcaaaggaauucag

SEQ ID NO: 22636 - RNA, 21 nt, Artificial Sequence
  RNA Oligomer
gcagacuacaccuucccuuug

SEQ ID NO: 22637 - RNA, 21 nt, Artificial Sequence
  RNA Oligomer
gggauagcagaggugaaagag

SEQ ID NO: 22638 - RNA, 21 nt, Artificial Sequence
  RNA Oligomer
caagaugucaagggccaagaa

SEQ ID NO: 22639 - RNA, 21 nt, Artificial Sequence
  RNA Oligomer
cuguguggucaacgaauacua

SEQ ID NO: 22640 - RNA, 21 nt, Artificial Sequence
  RNA Oligomer
ccguuuugacauccugguuuu

SEQ ID NO: 22641 - RNA, 21 nt, Artificial Sequence
  RNA Oligomer
gaaacaggcgauaauuuuuca

SEQ ID NO: 22642 - RNA, 21 nt, Artificial Sequence
  RNA Oligomer
gagaaacaggcgauaauuuuu

SEQ ID NO: 22643 - RNA, 21 nt, Artificial Sequence
  RNA Oligomer
cagguuuaaacaucacuugua

SEQ ID NO: 22644 - RNA, 21 nt, Artificial Sequence
  RNA Oligomer
ggcaguacaguggcuucaaga

SEQ ID NO: 22645 - RNA, 21 nt, Artificial Sequence
  RNA Oligomer
gcaagaugucaagggccaaga

SEQ ID NO: 22646 - RNA, 21 nt, Artificial Sequence
  RNA Oligomer
cgcuguguucaucgacuuccu

SEQ ID NO: 22647 - RNA, 21 nt, Artificial Sequence
  RNA Oligomer
accggaggaaaauuugacauu

SEQ ID NO: 22648 - RNA, 21 nt, Artificial Sequence
  RNA Oligomer
gcaccggaggaaaauuugaca

SEQ ID NO: 22649 - RNA, 21 nt, Artificial Sequence
  RNA Oligomer
caagaacaauaucgacuuccc

SEQ ID NO: 22650 - RNA, 21 nt, Artificial Sequence
  RNA Oligomer
ucucuugaacagugccgaaaa

SEQ ID NO: 22651 - RNA, 21 nt, Artificial Sequence
  RNA Oligomer
accgagguuguaaaaagggau

SEQ ID NO: 22652 - RNA, 21 nt, Artificial Sequence
  RNA Oligomer
ugacaaacuuucucaaaacag

SEQ ID NO: 22653 - RNA, 21 nt, Artificial Sequence
  RNA Oligomer
cuacguuugcuuugcucuggu

SEQ ID NO: 22654 - RNA, 21 nt, Artificial Sequence
  RNA Oligomer
aggagauacagcugcuuagaa

SEQ ID NO: 22655 - RNA, 21 nt, Artificial Sequence
  RNA Oligomer
gaggagauacagcugcuuaga

SEQ ID NO: 22656 - RNA, 21 nt, Artificial Sequence
  RNA Oligomer
caaagccgacauuaaaguaug

SEQ ID NO: 22657 - RNA, 21 nt, Artificial Sequence
  RNA Oligomer
gcaugaauuauggcaccauua

SEQ ID NO: 22658 - RNA, 21 nt, Artificial Sequence
  RNA Oligomer
gguuuaaacaucacuuguacc

SEQ ID NO: 22659 - RNA, 21 nt, Artificial Sequence
  RNA Oligomer
uuccaguaugagacgaacaaa

SEQ ID NO: 22660 - RNA, 21 nt, Artificial Sequence
  RNA Oligomer
gggaacucuuucuucgugaug

SEQ ID NO: 22661 - RNA, 21 nt, Artificial Sequence
  RNA Oligomer
agcagaggugaaagaggagau

SEQ ID NO: 22662 - RNA, 21 nt, Artificial Sequence
  RNA Oligomer
agggcaguacaguggcuucaa

SEQ ID NO: 22663 - RNA, 21 nt, Artificial Sequence
  RNA Oligomer
gagauacagcugcuuagaaag

SEQ ID NO: 22664 - RNA, 21 nt, Artificial Sequence
  RNA Oligomer
cagaggagauacagcugcuua

SEQ ID NO: 22665 - RNA, 21 nt, Artificial Sequence
  RNA Oligomer
ggaagaagugcgaguccauug

SEQ ID NO: 22666 - RNA, 21 nt, Artificial Sequence
  RNA Oligomer
guaacugcugucgcucccaua

SEQ ID NO: 22667 - RNA, 21 nt, Artificial Sequence
  RNA Oligomer
caccggaggaaaauuugacau

SEQ ID NO: 22668 - RNA, 21 nt, Artificial Sequence
  RNA Oligomer
uaccuuccacaagacucagaa

SEQ ID NO: 22669 - RNA, 21 nt, Artificial Sequence
  RNA Oligomer
cuacaccacgagaaacauccu

SEQ ID NO: 22670 - RNA, 21 nt, Artificial Sequence
  RNA Oligomer
uguuuuccaguaugagacgaa

SEQ ID NO: 22671 - RNA, 21 nt, Artificial Sequence
  RNA Oligomer
ccgagguuguaaaaagggaug

SEQ ID NO: 22672 - RNA, 21 nt, Artificial Sequence
  RNA Oligomer
gaacucuuucuucgugaugac

SEQ ID NO: 22673 - RNA, 21 nt, Artificial Sequence
  RNA Oligomer
gaauggagugaagaaguuggu

SEQ ID NO: 22674 - RNA, 21 nt, Artificial Sequence
  RNA Oligomer
cguggagaauggagugaagaa

SEQ ID NO: 22675 - RNA, 21 nt, Artificial Sequence
  RNA Oligomer
ggagaucguggagaauggagu

SEQ ID NO: 22676 - RNA, 21 nt, Artificial Sequence
  RNA Oligomer
cugcuuagaaaggaggcgacu

SEQ ID NO: 22677 - RNA, 21 nt, Artificial Sequence
  RNA Oligomer
cgauggacuucacagauuugu

SEQ ID NO: 22678 - RNA, 21 nt, Artificial Sequence
  RNA Oligomer
cguuuugacauccugguuuuu

SEQ ID NO: 22679 - RNA, 21 nt, Artificial Sequence
  RNA Oligomer
gaaaacaauguugagaaacgg

SEQ ID NO: 22680 - RNA, 21 nt, Artificial Sequence
  RNA Oligomer
agguuguaaaaagggauggau

SEQ ID NO: 22681 - RNA, 21 nt, Artificial Sequence
  RNA Oligomer
uggagugaagaaguuggugca

SEQ ID NO: 22682 - RNA, 21 nt, Artificial Sequence
  RNA Oligomer
gagaauggagugaagaaguug

SEQ ID NO: 22683 - RNA, 21 nt, Artificial Sequence
  RNA Oligomer
uggagaauggagugaagaagu

SEQ ID NO: 22684 - RNA, 21 nt, Artificial Sequence
  RNA Oligomer
gcaguacaguggcuucaagag

SEQ ID NO: 22685 - RNA, 21 nt, Artificial Sequence
  RNA Oligomer
cuacaggaagaagugcgaguc

SEQ ID NO: 22686 - RNA, 21 nt, Artificial Sequence
  RNA Oligomer
gcuguguucaucgacuuccuc

SEQ ID NO: 22687 - RNA, 21 nt, Artificial Sequence
  RNA Oligomer
caaguacuacaaggaaaacaa

SEQ ID NO: 22688 - RNA, 21 nt, Artificial Sequence
  RNA Oligomer
acaaagucacucggauccaga

SEQ ID NO: 22689 - RNA, 21 nt, Artificial Sequence
  RNA Oligomer
gaacaaagucacucggaucca

SEQ ID NO: 22690 - RNA, 21 nt, Artificial Sequence
  RNA Oligomer
ucguggagaauggagugaaga

SEQ ID NO: 22691 - RNA, 21 nt, Artificial Sequence
  RNA Oligomer
ggugagugacaagcuguacca

SEQ ID NO: 22692 - RNA, 21 nt, Artificial Sequence
  RNA Oligomer
acguuugcuuugcucugguga

SEQ ID NO: 22693 - RNA, 21 nt, Artificial Sequence
  RNA Oligomer
ugaagggcaguacaguggcuu

SEQ ID NO: 22694 - RNA, 21 nt, Artificial Sequence
  RNA Oligomer
caaggaaaacaauguugagaa

SEQ ID NO: 22695 - RNA, 21 nt, Artificial Sequence
  RNA Oligomer
gguuguaaaaagggauggaug

SEQ ID NO: 22696 - RNA, 21 nt, Artificial Sequence
  RNA Oligomer
cgagguuguaaaaagggaugg

SEQ ID NO: 22697 - RNA, 21 nt, Artificial Sequence
  RNA Oligomer
ggaacucuuucuucgugauga

SEQ ID NO: 22698 - RNA, 21 nt, Artificial Sequence
  RNA Oligomer
agacuacaccuucccuuugca

SEQ ID NO: 22699 - RNA, 21 nt, Artificial Sequence
  RNA Oligomer
gagguuguaaaaagggaugga

SEQ ID NO: 22700 - RNA, 21 nt, Artificial Sequence
  RNA Oligomer
gcagugauguuuuccaguaug

SEQ ID NO: 22701 - RNA, 21 nt, Artificial Sequence
  RNA Oligomer
cuggugagugacaagcuguac

SEQ ID NO: 22702 - RNA, 21 nt, Artificial Sequence
  RNA Oligomer
auguguccuuuguggaugaau

SEQ ID NO: 22703 - RNA, 21 nt, Artificial Sequence
  RNA Oligomer
cugguuguguacaucggcuca

SEQ ID NO: 22704 - RNA, 21 nt, Artificial Sequence
  RNA Oligomer
ugcagugauguuuuccaguau

SEQ ID NO: 22705 - RNA, 21 nt, Artificial Sequence
  RNA Oligomer
gaaagaggagaucguggagaa

SEQ ID NO: 22706 - RNA, 21 nt, Artificial Sequence
  RNA Oligomer
auccguuuugacauccugguu

SEQ ID NO: 22707 - RNA, 21 nt, Artificial Sequence
  RNA Oligomer
cuacaaggaaaacaauguuga

SEQ ID NO: 22708 - RNA, 21 nt, Artificial Sequence
  RNA Oligomer
cgccaaguacuacaaggaaaa

SEQ ID NO: 22709 - RNA, 21 nt, Artificial Sequence
  RNA Oligomer
uccguuuugacauccugguuu

SEQ ID NO: 22710 - RNA, 21 nt, Artificial Sequence
  RNA Oligomer
gaaacauccugccagguuuaa

SEQ ID NO: 22711 - RNA, 21 nt, Artificial Sequence
  RNA Oligomer
ggaaccagaagaccugugaag

SEQ ID NO: 22712 - RNA, 21 nt, Artificial Sequence
  RNA Oligomer
gcaaaggaauucagaccggaa

SEQ ID NO: 22713 - RNA, 21 nt, Artificial Sequence
  RNA Oligomer
cagugauguuuuccaguauga

SEQ ID NO: 22714 - RNA, 21 nt, Artificial Sequence
  RNA Oligomer
gugaugacaaacuuucucaaa

SEQ ID NO: 22715 - RNA, 21 nt, Artificial Sequence
  RNA Oligomer
ggagugaagaaguuggugcac

SEQ ID NO: 22716 - RNA, 21 nt, Artificial Sequence
  RNA Oligomer
uggcaccauuaagugguucuu

SEQ ID NO: 22717 - RNA, 21 nt, Artificial Sequence
  RNA Oligomer
cgaaaacuucacugugcucau

SEQ ID NO: 22718 - RNA, 21 nt, Artificial Sequence
  RNA Oligomer
cgugaugacaaacuuucucaa

SEQ ID NO: 22719 - RNA, 21 nt, Artificial Sequence
  RNA Oligomer
gcagaggugaaagaggagauc

SEQ ID NO: 22720 - RNA, 21 nt, Artificial Sequence
  RNA Oligomer
gacaagcuguaccagcggaaa

SEQ ID NO: 22721 - RNA, 21 nt, Artificial Sequence
  RNA Oligomer
ucccaggacauggcugacuuu

SEQ ID NO: 22722 - RNA, 21 nt, Artificial Sequence
  RNA Oligomer
ggcaccauuaagugguucuuc

SEQ ID NO: 22723 - RNA, 21 nt, Artificial Sequence
  RNA Oligomer
gcccuguguggucaacgaaua

SEQ ID NO: 22724 - RNA, 21 nt, Artificial Sequence
  RNA Oligomer
cugcugucgcucccauauuua

SEQ ID NO: 22725 - RNA, 21 nt, Artificial Sequence
  RNA Oligomer
gucuucgggauccguuuugac

SEQ ID NO: 22726 - RNA, 21 nt, Artificial Sequence
  RNA Oligomer
cggacucugauaaaagucuuc

SEQ ID NO: 22727 - RNA, 21 nt, Artificial Sequence
  RNA Oligomer
acggacucugauaaaagucuu

SEQ ID NO: 22728 - RNA, 21 nt, Artificial Sequence
  RNA Oligomer
aggaaaacaauguugagaaac

SEQ ID NO: 22729 - RNA, 21 nt, Artificial Sequence
  RNA Oligomer
guacuacaaggaaaacaaugu

SEQ ID NO: 22730 - RNA, 21 nt, Artificial Sequence
  RNA Oligomer
ucggauccagagcaugaauua

SEQ ID NO: 22731 - RNA, 21 nt, Artificial Sequence
  RNA Oligomer
gcagagcaaaggaauucagac

SEQ ID NO: 22732 - RNA, 21 nt, Artificial Sequence
  RNA Oligomer
gaggagaucguggagaaugga

SEQ ID NO: 22733 - RNA, 21 nt, Artificial Sequence
  RNA Oligomer
aaagaggagaucguggagaau

SEQ ID NO: 22734 - RNA, 21 nt, Artificial Sequence
  RNA Oligomer
ggagccaaagccgacauuaaa

SEQ ID NO: 22735 - RNA, 21 nt, Artificial Sequence
  RNA Oligomer
ugaauuauggcaccauuaagu

SEQ ID NO: 22736 - RNA, 21 nt, Artificial Sequence
  RNA Oligomer
ggaaaacaauguugagaaacg

SEQ ID NO: 22737 - RNA, 21 nt, Artificial Sequence
  RNA Oligomer
cggauccagagcaugaauuau

SEQ ID NO: 22738 - RNA, 21 nt, Artificial Sequence
  RNA Oligomer
ccacaacuacaccacgagaaa

SEQ ID NO: 22739 - RNA, 21 nt, Artificial Sequence
  RNA Oligomer
ugugcucaucaagaacaauau

SEQ ID NO: 22740 - RNA, 21 nt, Artificial Sequence
  RNA Oligomer
gaugacaaacuuucucaaaac

SEQ ID NO: 22741 - RNA, 21 nt, Artificial Sequence
  RNA Oligomer
aaguuggugcacagugucuuu

SEQ ID NO: 22742 - RNA, 21 nt, Artificial Sequence
  RNA Oligomer
gaaguuggugcacagugucuu

SEQ ID NO: 22743 - RNA, 21 nt, Artificial Sequence
  RNA Oligomer
gaagaaguuggugcacagugu

SEQ ID NO: 22744 - RNA, 21 nt, Artificial Sequence
  RNA Oligomer
gugaagaaguuggugcacagu

SEQ ID NO: 22745 - RNA, 21 nt, Artificial Sequence
  RNA Oligomer
gugaaagaggagaucguggag

SEQ ID NO: 22746 - RNA, 21 nt, Artificial Sequence
  RNA Oligomer
ucaucaguucugugcacacca

SEQ ID NO: 22747 - RNA, 21 nt, Artificial Sequence
  RNA Oligomer
uaagugguucuuccacgugau

SEQ ID NO: 22748 - RNA, 21 nt, Artificial Sequence
  RNA Oligomer
ccauauuuaucccuggugcaa

SEQ ID NO: 22749 - RNA, 21 nt, Artificial Sequence
  RNA Oligomer
cccauauuuaucccuggugca

SEQ ID NO: 22750 - RNA, 21 nt, Artificial Sequence
  RNA Oligomer
agcaugaauuauggcaccauu

SEQ ID NO: 22751 - RNA, 21 nt, Artificial Sequence
  RNA Oligomer
cagauacgccaaguacuacaa

SEQ ID NO: 22752 - RNA, 21 nt, Artificial Sequence
  RNA Oligomer
uccgagaaacaggcgauaauu

SEQ ID NO: 22753 - RNA, 21 nt, Artificial Sequence
  RNA Oligomer
gggaaccagaagaccugugaa

SEQ ID NO: 22754 - RNA, 21 nt, Artificial Sequence
  RNA Oligomer
agugaagaaguuggugcacag

SEQ ID NO: 22755 - RNA, 21 nt, Artificial Sequence
  RNA Oligomer
caggaagaagugcgaguccau

SEQ ID NO: 22756 - RNA, 21 nt, Artificial Sequence
  RNA Oligomer
cucccauauuuaucccuggug

SEQ ID NO: 22757 - RNA, 21 nt, Artificial Sequence
  RNA Oligomer
ggauccagagcaugaauuaug

SEQ ID NO: 22758 - RNA, 21 nt, Artificial Sequence
  RNA Oligomer
cacuuguaccuuccacaagac

SEQ ID NO: 22759 - RNA, 21 nt, Artificial Sequence
  RNA Oligomer
cgagaaacauccugccagguu

SEQ ID NO: 22760 - RNA, 21 nt, Artificial Sequence
  RNA Oligomer
gcucaucaagaacaauaucga

SEQ ID NO: 22761 - RNA, 21 nt, Artificial Sequence
  RNA Oligomer
gccgaaaacuucacugugcuc

SEQ ID NO: 22762 - RNA, 21 nt, Artificial Sequence
  RNA Oligomer
cugcagugauguuuuccagua

SEQ ID NO: 22763 - RNA, 21 nt, Artificial Sequence
  RNA Oligomer
gaggugaaagaggagaucgug

SEQ ID NO: 22764 - RNA, 21 nt, Artificial Sequence
  RNA Oligomer
gcaccauuaagugguucuucc

SEQ ID NO: 22765 - RNA, 21 nt, Artificial Sequence
  RNA Oligomer
gagcaugaauuauggcaccau

SEQ ID NO: 22766 - RNA, 21 nt, Artificial Sequence
  RNA Oligomer
agaaacauccugccagguuua

SEQ ID NO: 22767 - RNA, 21 nt, Artificial Sequence
  RNA Oligomer
ucgugaugacaaacuuucuca

SEQ ID NO: 22768 - RNA, 21 nt, Artificial Sequence
  RNA Oligomer
gcagcugcagugauguuuucc

SEQ ID NO: 22769 - RNA, 21 nt, Artificial Sequence
  RNA Oligomer
ugacaagcuguaccagcggaa

SEQ ID NO: 22770 - RNA, 21 nt, Artificial Sequence
  RNA Oligomer
caucaccaccucagagcuguu

SEQ ID NO: 22771 - RNA, 21 nt, Artificial Sequence
  RNA Oligomer
gaaaggaggcgacuccuagau

SEQ ID NO: 22772 - RNA, 21 nt, Artificial Sequence
  RNA Oligomer
guauguguccuuuguggauga

SEQ ID NO: 22773 - RNA, 21 nt, Artificial Sequence
  RNA Oligomer
caccauuaagugguucuucca

SEQ ID NO: 22774 - RNA, 21 nt, Artificial Sequence
  RNA Oligomer
guggagccaaagccgacauua

SEQ ID NO: 22775 - RNA, 21 nt, Artificial Sequence
  RNA Oligomer
cugugcucaucaagaacaaua

SEQ ID NO: 22776 - RNA, 21 nt, Artificial Sequence
  RNA Oligomer
acugugcucaucaagaacaau

SEQ ID NO: 22777 - RNA, 21 nt, Artificial Sequence
  RNA Oligomer
agcugcagugauguuuuccag

SEQ ID NO: 22778 - RNA, 21 nt, Artificial Sequence
  RNA Oligomer
gacauuaaaguauguguccuu

SEQ ID NO: 22779 - RNA, 21 nt, Artificial Sequence
  RNA Oligomer
uggagccaaagccgacauuaa

SEQ ID NO: 22780 - RNA, 21 nt, Artificial Sequence
  RNA Oligomer
cccuguguggucaacgaauac

SEQ ID NO: 22781 - RNA, 21 nt, Artificial Sequence
  RNA Oligomer
ugagaaacggacucugauaaa

SEQ ID NO: 22782 - RNA, 21 nt, Artificial Sequence
  RNA Oligomer
agauacgccaaguacuacaag

SEQ ID NO: 22783 - RNA, 21 nt, Artificial Sequence
  RNA Oligomer
cuaggagacaucuuccgagaa

SEQ ID NO: 22784 - RNA, 21 nt, Artificial Sequence
  RNA Oligomer
acaucacuuguaccuuccaca

SEQ ID NO: 22785 - RNA, 21 nt, Artificial Sequence
  RNA Oligomer
ccugccagguuuaaacaucac

SEQ ID NO: 22786 - RNA, 21 nt, Artificial Sequence
  RNA Oligomer
gugcucaucaagaacaauauc

SEQ ID NO: 22787 - RNA, 21 nt, Artificial Sequence
  RNA Oligomer
caccucagagcuguucaggaa

SEQ ID NO: 22788 - RNA, 21 nt, Artificial Sequence
  RNA Oligomer
ugcgauggacuucacagauuu

SEQ ID NO: 22789 - RNA, 21 nt, Artificial Sequence
  RNA Oligomer
agaagucccaagaccugcgau

SEQ ID NO: 22790 - RNA, 21 nt, Artificial Sequence
  RNA Oligomer
gcucccauauuuaucccuggu

SEQ ID NO: 22791 - RNA, 21 nt, Artificial Sequence
  RNA Oligomer
cgacacuuacuccaguaacug

SEQ ID NO: 22792 - RNA, 21 nt, Artificial Sequence
  RNA Oligomer
ucaucgacacuuacuccagua

SEQ ID NO: 22793 - RNA, 21 nt, Artificial Sequence
  RNA Oligomer
ggaaaauuugacauuauccag

SEQ ID NO: 22794 - RNA, 21 nt, Artificial Sequence
  RNA Oligomer
acgccaaguacuacaaggaaa

SEQ ID NO: 22795 - RNA, 21 nt, Artificial Sequence
  RNA Oligomer
acauccugccagguuuaaaca

SEQ ID NO: 22796 - RNA, 21 nt, Artificial Sequence
  RNA Oligomer
caucaagaacaauaucgacuu

SEQ ID NO: 22797 - RNA, 21 nt, Artificial Sequence
  RNA Oligomer
cucaucaagaacaauaucgac

SEQ ID NO: 22798 - RNA, 21 nt, Artificial Sequence
  RNA Oligomer
cacugugcucaucaagaacaa

SEQ ID NO: 22799 - RNA, 21 nt, Artificial Sequence
  RNA Oligomer
agaagaccugugaagucucug

SEQ ID NO: 22800 - RNA, 21 nt, Artificial Sequence
  RNA Oligomer
ccagaagaccugugaagucuc

SEQ ID NO: 22801 - RNA, 21 nt, Artificial Sequence
  RNA Oligomer
gaaccagaagaccugugaagu

SEQ ID NO: 22802 - RNA, 21 nt, Artificial Sequence
  RNA Oligomer
agggaaccagaagaccuguga

SEQ ID NO: 22803 - RNA, 21 nt, Artificial Sequence
  RNA Oligomer
agagcuguucaggaagcuggu

SEQ ID NO: 22804 - RNA, 21 nt, Artificial Sequence
  RNA Oligomer
ccagaggagauacagcugcuu

SEQ ID NO: 22805 - RNA, 21 nt, Artificial Sequence
  RNA Oligomer
gugguucuuccacgugaucau

SEQ ID NO: 22806 - RNA, 21 nt, Artificial Sequence
  RNA Oligomer
gcgauggacuucacagauuug

SEQ ID NO: 22807 - RNA, 21 nt, Artificial Sequence
  RNA Oligomer
ccugcgauggacuucacagau

SEQ ID NO: 22808 - RNA, 21 nt, Artificial Sequence
  RNA Oligomer
cgaguccauuguggagccaaa

SEQ ID NO: 22809 - RNA, 21 nt, Artificial Sequence
  RNA Oligomer
cuacuacaggaagaagugcga

SEQ ID NO: 22810 - RNA, 21 nt, Artificial Sequence
  RNA Oligomer
gccaaguacuacaaggaaaac

SEQ ID NO: 22811 - RNA, 21 nt, Artificial Sequence
  RNA Oligomer
uccacaagacucagaauccac

SEQ ID NO: 22812 - RNA, 21 nt, Artificial Sequence
  RNA Oligomer
accuuccacaagacucagaau

SEQ ID NO: 22813 - RNA, 21 nt, Artificial Sequence
  RNA Oligomer
caucacuuguaccuuccacaa

SEQ ID NO: 22814 - RNA, 21 nt, Artificial Sequence
  RNA Oligomer
gagaaacauccugccagguuu

SEQ ID NO: 22815 - RNA, 21 nt, Artificial Sequence
  RNA Oligomer
ccgaaaacuucacugugcuca

SEQ ID NO: 22816 - RNA, 21 nt, Artificial Sequence
  RNA Oligomer
ggaauucagaccggaaggugu

SEQ ID NO: 22817 - RNA, 21 nt, Artificial Sequence
  RNA Oligomer
cccgcagagcaaaggaauuca

SEQ ID NO: 22818 - RNA, 21 nt, Artificial Sequence
  RNA Oligomer
ugguucuuccacgugaucauc

SEQ ID NO: 22819 - RNA, 21 nt, Artificial Sequence
  RNA Oligomer
cgcucccauauuuaucccugg

SEQ ID NO: 22820 - RNA, 21 nt, Artificial Sequence
  RNA Oligomer
ggacucugauaaaagucuucg

SEQ ID NO: 22821 - RNA, 21 nt, Artificial Sequence
  RNA Oligomer
agaaacggacucugauaaaag

SEQ ID NO: 22822 - RNA, 21 nt, Artificial Sequence
  RNA Oligomer
gacgaacaaagucacucggau

SEQ ID NO: 22823 - RNA, 21 nt, Artificial Sequence
  RNA Oligomer
cagugucccauuuuccgacua

SEQ ID NO: 22824 - RNA, 21 nt, Artificial Sequence
  RNA Oligomer
ccacaagacucagaauccaca

SEQ ID NO: 22825 - RNA, 21 nt, Artificial Sequence
  RNA Oligomer
ugccagguuuaaacaucacuu

SEQ ID NO: 22826 - RNA, 21 nt, Artificial Sequence
  RNA Oligomer
gccacaacuacaccacgagaa

SEQ ID NO: 22827 - RNA, 21 nt, Artificial Sequence
  RNA Oligomer
gcucucuugaacagugccgaa

SEQ ID NO: 22828 - RNA, 21 nt, Artificial Sequence
  RNA Oligomer
ccucugaccgagguuguaaaa

SEQ ID NO: 22829 - RNA, 21 nt, Artificial Sequence
  RNA Oligomer
ucuguuccucugaccgagguu

SEQ ID NO: 22830 - RNA, 21 nt, Artificial Sequence
  RNA Oligomer
ucaccaccucagagcuguuca

SEQ ID NO: 22831 - RNA, 21 nt, Artificial Sequence
  RNA Oligomer
agaccugcgauggacuucaca

SEQ ID NO: 22832 - RNA, 21 nt, Artificial Sequence
  RNA Oligomer
ccuuuguggaugaaucccaca

SEQ ID NO: 22833 - RNA, 21 nt, Artificial Sequence
  RNA Oligomer
uuaaaguauguguccuuugug

SEQ ID NO: 22834 - RNA, 21 nt, Artificial Sequence
  RNA Oligomer
cgacauuaaaguauguguccu

SEQ ID NO: 22835 - RNA, 21 nt, Artificial Sequence
  RNA Oligomer
gccgacauuaaaguauguguc

SEQ ID NO: 22836 - RNA, 21 nt, Artificial Sequence
  RNA Oligomer
ugcugucgcucccauauuuau

SEQ ID NO: 22837 - RNA, 21 nt, Artificial Sequence
  RNA Oligomer
caucgacacuuacuccaguaa

SEQ ID NO: 22838 - RNA, 21 nt, Artificial Sequence
  RNA Oligomer
caugaauuauggcaccauuaa

SEQ ID NO: 22839 - RNA, 21 nt, Artificial Sequence
  RNA Oligomer
gacauuauccagcugguugug

SEQ ID NO: 22840 - RNA, 21 nt, Artificial Sequence
  RNA Oligomer
ccaaguacuacaaggaaaaca

SEQ ID NO: 22841 - RNA, 21 nt, Artificial Sequence
  RNA Oligomer
agucacucggauccagagcau

SEQ ID NO: 22842 - RNA, 21 nt, Artificial Sequence
  RNA Oligomer
ucacuuguaccuuccacaaga

SEQ ID NO: 22843 - RNA, 21 nt, Artificial Sequence
  RNA Oligomer
uucuucgugaugacaaacuuu

SEQ ID NO: 22844 - RNA, 21 nt, Artificial Sequence
  RNA Oligomer
accagaggagauacagcugcu

SEQ ID NO: 22845 - RNA, 21 nt, Artificial Sequence
  RNA Oligomer
ccacauuaggauggugaacca

SEQ ID NO: 22846 - RNA, 21 nt, Artificial Sequence
  RNA Oligomer
uccuuuguggaugaaucccac

SEQ ID NO: 22847 - RNA, 21 nt, Artificial Sequence
  RNA Oligomer
gagaaacggacucugauaaaa

SEQ ID NO: 22848 - RNA, 21 nt, Artificial Sequence
  RNA Oligomer
ccacagugucccauuuuccga

SEQ ID NO: 22849 - RNA, 21 nt, Artificial Sequence
  RNA Oligomer
cacaagacucagaauccacag

SEQ ID NO: 22850 - RNA, 21 nt, Artificial Sequence
  RNA Oligomer
ugucuuugacaccgcagacua

SEQ ID NO: 22851 - RNA, 21 nt, Artificial Sequence
  RNA Oligomer
aggacauggcugacuuugcca

SEQ ID NO: 22852 - RNA, 21 nt, Artificial Sequence
  RNA Oligomer
cugcgauggacuucacagauu

SEQ ID NO: 22853 - RNA, 21 nt, Artificial Sequence
  RNA Oligomer
ccgacauuaaaguaugugucc

SEQ ID NO: 22854 - RNA, 21 nt, Artificial Sequence
  RNA Oligomer
cucggauccagagcaugaauu

SEQ ID NO: 22855 - RNA, 21 nt, Artificial Sequence
  RNA Oligomer
acucggauccagagcaugaau

SEQ ID NO: 22856 - RNA, 21 nt, Artificial Sequence
  RNA Oligomer
cugccagguuuaaacaucacu

SEQ ID NO: 22857 - RNA, 21 nt, Artificial Sequence
  RNA Oligomer
uccugccagguuuaaacauca

SEQ ID NO: 22858 - RNA, 21 nt, Artificial Sequence
  RNA Oligomer
agaccugugaagucucugccu

SEQ ID NO: 22859 - RNA, 21 nt, Artificial Sequence
  RNA Oligomer
acagugucuuugacaccgcag

SEQ ID NO: 22860 - RNA, 21 nt, Artificial Sequence
  RNA Oligomer
ggaaagagccugucaucaguu

SEQ ID NO: 22861 - RNA, 21 nt, Artificial Sequence
  RNA Oligomer
gaguccauuguggagccaaag

SEQ ID NO: 22862 - RNA, 21 nt, Artificial Sequence
  RNA Oligomer
gguuguguacaucggcucaac

SEQ ID NO: 22863 - RNA, 21 nt, Artificial Sequence
  RNA Oligomer
gguuuuuggcaccggaggaaa

SEQ ID NO: 22864 - RNA, 21 nt, Artificial Sequence
  RNA Oligomer
cgggauccguuuugacauccu

SEQ ID NO: 22865 - RNA, 21 nt, Artificial Sequence
  RNA Oligomer
caauguugagaaacggacucu

SEQ ID NO: 22866 - RNA, 21 nt, Artificial Sequence
  RNA Oligomer
acgaacaaagucacucggauc

SEQ ID NO: 22867 - RNA, 21 nt, Artificial Sequence
  RNA Oligomer
guaugagacgaacaaagucac

SEQ ID NO: 22868 - RNA, 21 nt, Artificial Sequence
  RNA Oligomer
acgagaaacauccugccaggu

SEQ ID NO: 22869 - RNA, 21 nt, Artificial Sequence
  RNA Oligomer
aggaauucagaccggaaggug

SEQ ID NO: 22870 - RNA, 21 nt, Artificial Sequence
  RNA Oligomer
cucuuucuucgugaugacaaa

SEQ ID NO: 22871 - RNA, 21 nt, Artificial Sequence
  RNA Oligomer
cacagugucuuugacaccgca

SEQ ID NO: 22872 - RNA, 21 nt, Artificial Sequence
  RNA Oligomer
ucagagcuguucaggaagcug

SEQ ID NO: 22873 - RNA, 21 nt, Artificial Sequence
  RNA Oligomer
cucagagcuguucaggaagcu

SEQ ID NO: 22874 - RNA, 21 nt, Artificial Sequence
  RNA Oligomer
accucagagcuguucaggaag

SEQ ID NO: 22875 - RNA, 21 nt, Artificial Sequence
  RNA Oligomer
uggacuucacagauuugucca

SEQ ID NO: 22876 - RNA, 21 nt, Artificial Sequence
  RNA Oligomer
cauuaaaguauguguccuuug

SEQ ID NO: 22877 - RNA, 21 nt, Artificial Sequence
  RNA Oligomer
agccgacauuaaaguaugugu

SEQ ID NO: 22878 - RNA, 21 nt, Artificial Sequence
  RNA Oligomer
uguggagccaaagccgacauu

SEQ ID NO: 22879 - RNA, 21 nt, Artificial Sequence
  RNA Oligomer
gaagugcgaguccauugugga

SEQ ID NO: 22880 - RNA, 21 nt, Artificial Sequence
  RNA Oligomer
cacuuacuccaguaacugcug

SEQ ID NO: 22881 - RNA, 21 nt, Artificial Sequence
  RNA Oligomer
gggauccguuuugacauccug

SEQ ID NO: 22882 - RNA, 21 nt, Artificial Sequence
  RNA Oligomer
agacgaacaaagucacucgga

SEQ ID NO: 22883 - RNA, 21 nt, Artificial Sequence
  RNA Oligomer
gaauuauggcaccauuaagug

SEQ ID NO: 22884 - RNA, 21 nt, Artificial Sequence
  RNA Oligomer
gaggaaaauuugacauuaucc

SEQ ID NO: 22885 - RNA, 21 nt, Artificial Sequence
  RNA Oligomer
uccucugaccgagguuguaaa

SEQ ID NO: 22886 - RNA, 21 nt, Artificial Sequence
  RNA Oligomer
gccugucaucaguucugugca

SEQ ID NO: 22887 - RNA, 21 nt, Artificial Sequence
  RNA Oligomer
ucccaucucaacucccugaga

SEQ ID NO: 22888 - RNA, 21 nt, Artificial Sequence
  RNA Oligomer
acagugucccauuuuccgacu

SEQ ID NO: 22889 - RNA, 21 nt, Artificial Sequence
  RNA Oligomer
agcaaaggaauucagaccgga

SEQ ID NO: 22890 - RNA, 21 nt, Artificial Sequence
  RNA Oligomer
uuauggcaccauuaagugguu

SEQ ID NO: 22891 - RNA, 21 nt, Artificial Sequence
  RNA Oligomer
ugguuuuuggcaccggaggaa

SEQ ID NO: 22892 - RNA, 21 nt, Artificial Sequence
  RNA Oligomer
ggauccguuuugacauccugg

SEQ ID NO: 22893 - RNA, 21 nt, Artificial Sequence
  RNA Oligomer
cucuggugagugacaagcugu

SEQ ID NO: 22894 - RNA, 21 nt, Artificial Sequence
  RNA Oligomer
cacauuaggauggugaaccag

SEQ ID NO: 22895 - RNA, 21 nt, Artificial Sequence
  RNA Oligomer
ugcucuggugagugacaagcu

SEQ ID NO: 22896 - RNA, 21 nt, Artificial Sequence
  RNA Oligomer
gacuacaccuucccuuugcag

SEQ ID NO: 22897 - RNA, 21 nt, Artificial Sequence
  RNA Oligomer
cucaaaacagaaggccaagag

SEQ ID NO: 22898 - RNA, 21 nt, Artificial Sequence
  RNA Oligomer
uggugcacagugucuuugaca

SEQ ID NO: 22899 - RNA, 21 nt, Artificial Sequence
  RNA Oligomer
ucaagggccaagaagucccaa

SEQ ID NO: 22900 - RNA, 21 nt, Artificial Sequence
  RNA Oligomer
guguucaucgacuuccucauc

SEQ ID NO: 22901 - RNA, 21 nt, Artificial Sequence
  RNA Oligomer
gagccugucaucaguucugug

SEQ ID NO: 22902 - RNA, 21 nt, Artificial Sequence
  RNA Oligomer
aggauggugaaccagcagcua

SEQ ID NO: 22903 - RNA, 21 nt, Artificial Sequence
  RNA Oligomer
ugacauuauccagcugguugu

SEQ ID NO: 22904 - RNA, 21 nt, Artificial Sequence
  RNA Oligomer
cugcagcugcagugauguuuu

SEQ ID NO: 22905 - RNA, 21 nt, Artificial Sequence
  RNA Oligomer
cugucaucaguucugugcaca

SEQ ID NO: 22906 - RNA, 21 nt, Artificial Sequence
  RNA Oligomer
ggacuucacagauuuguccag

SEQ ID NO: 22907 - RNA, 21 nt, Artificial Sequence
  RNA Oligomer
guucaucgacuuccucaucga

SEQ ID NO: 22908 - RNA, 21 nt, Artificial Sequence
  RNA Oligomer
cggaaagagccugucaucagu

SEQ ID NO: 22909 - RNA, 21 nt, Artificial Sequence
  RNA Oligomer
gcugcagugauguuuuccagu

SEQ ID NO: 22910 - RNA, 21 nt, Artificial Sequence
  RNA Oligomer
ugcuuugcucuggugagugac

SEQ ID NO: 22911 - RNA, 21 nt, Artificial Sequence
  RNA Oligomer
gcugcagcugcagugauguuu

SEQ ID NO: 22912 - RNA, 21 nt, Artificial Sequence
  RNA Oligomer
auggugaaccagcagcuacua

SEQ ID NO: 22913 - RNA, 21 nt, Artificial Sequence
  RNA Oligomer
agagccugucaucaguucugu

SEQ ID NO: 22914 - RNA, 21 nt, Artificial Sequence
  RNA Oligomer
aaacguaggaaaagaugauca

SEQ ID NO: 22915 - RNA, 21 nt, Artificial Sequence
  RNA Oligomer
aacguaggaaaagaugaucac

SEQ ID NO: 22916 - RNA, 21 nt, Artificial Sequence
  RNA Oligomer
uaggaaaagaugaucacgugg

SEQ ID NO: 22917 - RNA, 21 nt, Artificial Sequence
  RNA Oligomer
acguaggaaaagaugaucacg

SEQ ID NO: 22918 - RNA, 21 nt, Artificial Sequence
  RNA Oligomer
aaaauuaucgccuguuucucg

SEQ ID NO: 22919 - RNA, 21 nt, Artificial Sequence
  RNA Oligomer
cacaucugaaaaauuaucgcc

SEQ ID NO: 22920 - RNA, 21 nt, Artificial Sequence
  RNA Oligomer
aaauuaucgccuguuucucgg

SEQ ID NO: 22921 - RNA, 21 nt, Artificial Sequence
  RNA Oligomer
aaagggaagguguagucugcg

SEQ ID NO: 22922 - RNA, 21 nt, Artificial Sequence
  RNA Oligomer
aagcaaacguaggaaaagaug

SEQ ID NO: 22923 - RNA, 21 nt, Artificial Sequence
  RNA Oligomer
auaaugucaaauuuuccuccg

SEQ ID NO: 22924 - RNA, 21 nt, Artificial Sequence
  RNA Oligomer
acuuuguucgucucauacugg

SEQ ID NO: 22925 - RNA, 21 nt, Artificial Sequence
  RNA Oligomer
aaagaugaucacguggaagaa

SEQ ID NO: 22926 - RNA, 21 nt, Artificial Sequence
  RNA Oligomer
uuucuaagcagcuguaucucc

SEQ ID NO: 22927 - RNA, 21 nt, Artificial Sequence
  RNA Oligomer
uacuuuaaugucggcuuuggc

SEQ ID NO: 22928 - RNA, 21 nt, Artificial Sequence
  RNA Oligomer
gauaaugucaaauuuuccucc

SEQ ID NO: 22929 - RNA, 21 nt, Artificial Sequence
  RNA Oligomer
uaaugucaaauuuuccuccgg

SEQ ID NO: 22930 - RNA, 21 nt, Artificial Sequence
  RNA Oligomer
aucugaaaaauuaucgccugu

SEQ ID NO: 22931 - RNA, 21 nt, Artificial Sequence
  RNA Oligomer
acaagugauguuuaaaccugg

SEQ ID NO: 22932 - RNA, 21 nt, Artificial Sequence
  RNA Oligomer
auguuucucgugguguaguug

SEQ ID NO: 22933 - RNA, 21 nt, Artificial Sequence
  RNA Oligomer
caaacguaggaaaagaugauc

SEQ ID NO: 22934 - RNA, 21 nt, Artificial Sequence
  RNA Oligomer
guaggaaaagaugaucacgug

SEQ ID NO: 22935 - RNA, 21 nt, Artificial Sequence
  RNA Oligomer
gaucccgaagacuuuuaucag

SEQ ID NO: 22936 - RNA, 21 nt, Artificial Sequence
  RNA Oligomer
guacaagugauguuuaaaccu

SEQ ID NO: 22937 - RNA, 21 nt, Artificial Sequence
  RNA Oligomer
agcacagugaaguuuucggca

SEQ ID NO: 22938 - RNA, 21 nt, Artificial Sequence
  RNA Oligomer
aacuucuucacuccauucucc

SEQ ID NO: 22939 - RNA, 21 nt, Artificial Sequence
  RNA Oligomer
aaagcaaacguaggaaaagau

SEQ ID NO: 22940 - RNA, 21 nt, Artificial Sequence
  RNA Oligomer
auacuuuaaugucggcuuugg

SEQ ID NO: 22941 - RNA, 21 nt, Artificial Sequence
  RNA Oligomer
uggugccauaauucaugcucu

SEQ ID NO: 22942 - RNA, 21 nt, Artificial Sequence
  RNA Oligomer
gugccauaauucaugcucugg

SEQ ID NO: 22943 - RNA, 21 nt, Artificial Sequence
  RNA Oligomer
ucccgaagacuuuuaucagag

SEQ ID NO: 22944 - RNA, 21 nt, Artificial Sequence
  RNA Oligomer
gccacaucugaaaaauuaucg

SEQ ID NO: 22945 - RNA, 21 nt, Artificial Sequence
  RNA Oligomer
ccacaucugaaaaauuaucgc

SEQ ID NO: 22946 - RNA, 21 nt, Artificial Sequence
  RNA Oligomer
acaucugaaaaauuaucgccu

SEQ ID NO: 22947 - RNA, 21 nt, Artificial Sequence
  RNA Oligomer
caucugaaaaauuaucgccug

SEQ ID NO: 22948 - RNA, 21 nt, Artificial Sequence
  RNA Oligomer
caagugauguuuaaaccuggc

SEQ ID NO: 22949 - RNA, 21 nt, Artificial Sequence
  RNA Oligomer
ucugaauuccuuugcucugcg

SEQ ID NO: 22950 - RNA, 21 nt, Artificial Sequence
  RNA Oligomer
cugaauuccuuugcucugcgg

SEQ ID NO: 22951 - RNA, 21 nt, Artificial Sequence
  RNA Oligomer
caaagggaagguguagucugc

SEQ ID NO: 22952 - RNA, 21 nt, Artificial Sequence
  RNA Oligomer
cucuuucaccucugcuauccc

SEQ ID NO: 22953 - RNA, 21 nt, Artificial Sequence
  RNA Oligomer
uucuuggcccuugacaucuug

SEQ ID NO: 22954 - RNA, 21 nt, Artificial Sequence
  RNA Oligomer
uaguauucguugaccacacag

SEQ ID NO: 22955 - RNA, 21 nt, Artificial Sequence
  RNA Oligomer
aaaaccaggaugucaaaacgg

SEQ ID NO: 22956 - RNA, 21 nt, Artificial Sequence
  RNA Oligomer
ugaaaaauuaucgccuguuuc

SEQ ID NO: 22957 - RNA, 21 nt, Artificial Sequence
  RNA Oligomer
aaaaauuaucgccuguuucuc

SEQ ID NO: 22958 - RNA, 21 nt, Artificial Sequence
  RNA Oligomer
uacaagugauguuuaaaccug

SEQ ID NO: 22959 - RNA, 21 nt, Artificial Sequence
  RNA Oligomer
ucuugaagccacuguacugcc

SEQ ID NO: 22960 - RNA, 21 nt, Artificial Sequence
  RNA Oligomer
ucuuggcccuugacaucuugc

SEQ ID NO: 22961 - RNA, 21 nt, Artificial Sequence
  RNA Oligomer
aggaagucgaugaacacagcg

SEQ ID NO: 22962 - RNA, 21 nt, Artificial Sequence
  RNA Oligomer
aaugucaaauuuuccuccggu

SEQ ID NO: 22963 - RNA, 21 nt, Artificial Sequence
  RNA Oligomer
ugucaaauuuuccuccggugc

SEQ ID NO: 22964 - RNA, 21 nt, Artificial Sequence
  RNA Oligomer
gggaagucgauauuguucuug

SEQ ID NO: 22965 - RNA, 21 nt, Artificial Sequence
  RNA Oligomer
uuuucggcacuguucaagaga

SEQ ID NO: 22966 - RNA, 21 nt, Artificial Sequence
  RNA Oligomer
aucccuuuuuacaaccucggu

SEQ ID NO: 22967 - RNA, 21 nt, Artificial Sequence
  RNA Oligomer
cuguuuugagaaaguuuguca

SEQ ID NO: 22968 - RNA, 21 nt, Artificial Sequence
  RNA Oligomer
accagagcaaagcaaacguag

SEQ ID NO: 22969 - RNA, 21 nt, Artificial Sequence
  RNA Oligomer
uucuaagcagcuguaucuccu

SEQ ID NO: 22970 - RNA, 21 nt, Artificial Sequence
  RNA Oligomer
ucuaagcagcuguaucuccuc

SEQ ID NO: 22971 - RNA, 21 nt, Artificial Sequence
  RNA Oligomer
cauacuuuaaugucggcuuug

SEQ ID NO: 22972 - RNA, 21 nt, Artificial Sequence
  RNA Oligomer
uaauggugccauaauucaugc

SEQ ID NO: 22973 - RNA, 21 nt, Artificial Sequence
  RNA Oligomer
gguacaagugauguuuaaacc

SEQ ID NO: 22974 - RNA, 21 nt, Artificial Sequence
  RNA Oligomer
uuuguucgucucauacuggaa

SEQ ID NO: 22975 - RNA, 21 nt, Artificial Sequence
  RNA Oligomer
caucacgaagaaagaguuccc

SEQ ID NO: 22976 - RNA, 21 nt, Artificial Sequence
  RNA Oligomer
aucuccucuuucaccucugcu

SEQ ID NO: 22977 - RNA, 21 nt, Artificial Sequence
  RNA Oligomer
uugaagccacuguacugcccu

SEQ ID NO: 22978 - RNA, 21 nt, Artificial Sequence
  RNA Oligomer
cuuucuaagcagcuguaucuc

SEQ ID NO: 22979 - RNA, 21 nt, Artificial Sequence
  RNA Oligomer
uaagcagcuguaucuccucug

SEQ ID NO: 22980 - RNA, 21 nt, Artificial Sequence
  RNA Oligomer
caauggacucgcacuucuucc

SEQ ID NO: 22981 - RNA, 21 nt, Artificial Sequence
  RNA Oligomer
uaugggagcgacagcaguuac

SEQ ID NO: 22982 - RNA, 21 nt, Artificial Sequence
  RNA Oligomer
augucaaauuuuccuccggug

SEQ ID NO: 22983 - RNA, 21 nt, Artificial Sequence
  RNA Oligomer
uucugagucuuguggaaggua

SEQ ID NO: 22984 - RNA, 21 nt, Artificial Sequence
  RNA Oligomer
aggauguuucucgugguguag

SEQ ID NO: 22985 - RNA, 21 nt, Artificial Sequence
  RNA Oligomer
uucgucucauacuggaaaaca

SEQ ID NO: 22986 - RNA, 21 nt, Artificial Sequence
  RNA Oligomer
caucccuuuuuacaaccucgg

SEQ ID NO: 22987 - RNA, 21 nt, Artificial Sequence
  RNA Oligomer
gucaucacgaagaaagaguuc

SEQ ID NO: 22988 - RNA, 21 nt, Artificial Sequence
  RNA Oligomer
accaacuucuucacuccauuc

SEQ ID NO: 22989 - RNA, 21 nt, Artificial Sequence
  RNA Oligomer
uucuucacuccauucuccacg

SEQ ID NO: 22990 - RNA, 21 nt, Artificial Sequence
  RNA Oligomer
acuccauucuccacgaucucc

SEQ ID NO: 22991 - RNA, 21 nt, Artificial Sequence
  RNA Oligomer
agucgccuccuuucuaagcag

SEQ ID NO: 22992 - RNA, 21 nt, Artificial Sequence
  RNA Oligomer
acaaaucugugaaguccaucg

SEQ ID NO: 22993 - RNA, 21 nt, Artificial Sequence
  RNA Oligomer
aaaaaccaggaugucaaaacg

SEQ ID NO: 22994 - RNA, 21 nt, Artificial Sequence
  RNA Oligomer
ccguuucucaacauuguuuuc

SEQ ID NO: 22995 - RNA, 21 nt, Artificial Sequence
  RNA Oligomer
auccaucccuuuuuacaaccu

SEQ ID NO: 22996 - RNA, 21 nt, Artificial Sequence
  RNA Oligomer
ugcaccaacuucuucacucca

SEQ ID NO: 22997 - RNA, 21 nt, Artificial Sequence
  RNA Oligomer
caacuucuucacuccauucuc

SEQ ID NO: 22998 - RNA, 21 nt, Artificial Sequence
  RNA Oligomer
acuucuucacuccauucucca

SEQ ID NO: 22999 - RNA, 21 nt, Artificial Sequence
  RNA Oligomer
cucuugaagccacuguacugc

SEQ ID NO: 23000 - RNA, 21 nt, Artificial Sequence
  RNA Oligomer
gacucgcacuucuuccuguag

SEQ ID NO: 23001 - RNA, 21 nt, Artificial Sequence
  RNA Oligomer
gaggaagucgaugaacacagc

SEQ ID NO: 23002 - RNA, 21 nt, Artificial Sequence
  RNA Oligomer
uuguuuuccuuguaguacuug

SEQ ID NO: 23003 - RNA, 21 nt, Artificial Sequence
  RNA Oligomer
ucuggauccgagugacuuugu

SEQ ID NO: 23004 - RNA, 21 nt, Artificial Sequence
  RNA Oligomer
uggauccgagugacuuuguuc

SEQ ID NO: 23005 - RNA, 21 nt, Artificial Sequence
  RNA Oligomer
ucuucacuccauucuccacga

SEQ ID NO: 23006 - RNA, 21 nt, Artificial Sequence
  RNA Oligomer
ugguacagcuugucacucacc

SEQ ID NO: 23007 - RNA, 21 nt, Artificial Sequence
  RNA Oligomer
ucaccagagcaaagcaaacgu

SEQ ID NO: 23008 - RNA, 21 nt, Artificial Sequence
  RNA Oligomer
aagccacuguacugcccuuca

SEQ ID NO: 23009 - RNA, 21 nt, Artificial Sequence
  RNA Oligomer
uucucaacauuguuuuccuug

SEQ ID NO: 23010 - RNA, 21 nt, Artificial Sequence
  RNA Oligomer
cauccaucccuuuuuacaacc

SEQ ID NO: 23011 - RNA, 21 nt, Artificial Sequence
  RNA Oligomer
ccaucccuuuuuacaaccucg

SEQ ID NO: 23012 - RNA, 21 nt, Artificial Sequence
  RNA Oligomer
ucaucacgaagaaagaguucc

SEQ ID NO: 23013 - RNA, 21 nt, Artificial Sequence
  RNA Oligomer
ugcaaagggaagguguagucu

SEQ ID NO: 23014 - RNA, 21 nt, Artificial Sequence
  RNA Oligomer
uccaucccuuuuuacaaccuc

SEQ ID NO: 23015 - RNA, 21 nt, Artificial Sequence
  RNA Oligomer
cauacuggaaaacaucacugc

SEQ ID NO: 23016 - RNA, 21 nt, Artificial Sequence
  RNA Oligomer
guacagcuugucacucaccag

SEQ ID NO: 23017 - RNA, 21 nt, Artificial Sequence
  RNA Oligomer
auucauccacaaaggacacau

SEQ ID NO: 23018 - RNA, 21 nt, Artificial Sequence
  RNA Oligomer
ugagccgauguacacaaccag

SEQ ID NO: 23019 - RNA, 21 nt, Artificial Sequence
  RNA Oligomer
auacuggaaaacaucacugca

SEQ ID NO: 23020 - RNA, 21 nt, Artificial Sequence
  RNA Oligomer
uucuccacgaucuccucuuuc

SEQ ID NO: 23021 - RNA, 21 nt, Artificial Sequence
  RNA Oligomer
aaccaggaugucaaaacggau

SEQ ID NO: 23022 - RNA, 21 nt, Artificial Sequence
  RNA Oligomer
ucaacauuguuuuccuuguag

SEQ ID NO: 23023 - RNA, 21 nt, Artificial Sequence
  RNA Oligomer
uuuuccuuguaguacuuggcg

SEQ ID NO: 23024 - RNA, 21 nt, Artificial Sequence
  RNA Oligomer
aaaccaggaugucaaaacgga

SEQ ID NO: 23025 - RNA, 21 nt, Artificial Sequence
  RNA Oligomer
uuaaaccuggcaggauguuuc

SEQ ID NO: 23026 - RNA, 21 nt, Artificial Sequence
  RNA Oligomer
cuucacaggucuucugguucc

SEQ ID NO: 23027 - RNA, 21 nt, Artificial Sequence
  RNA Oligomer
uuccggucugaauuccuuugc

SEQ ID NO: 23028 - RNA, 21 nt, Artificial Sequence
  RNA Oligomer
ucauacuggaaaacaucacug

SEQ ID NO: 23029 - RNA, 21 nt, Artificial Sequence
  RNA Oligomer
uuugagaaaguuugucaucac

SEQ ID NO: 23030 - RNA, 21 nt, Artificial Sequence
  RNA Oligomer
gugcaccaacuucuucacucc

SEQ ID NO: 23031 - RNA, 21 nt, Artificial Sequence
  RNA Oligomer
aagaaccacuuaauggugcca

SEQ ID NO: 23032 - RNA, 21 nt, Artificial Sequence
  RNA Oligomer
augagcacagugaaguuuucg

SEQ ID NO: 23033 - RNA, 21 nt, Artificial Sequence
  RNA Oligomer
uugagaaaguuugucaucacg

SEQ ID NO: 23034 - RNA, 21 nt, Artificial Sequence
  RNA Oligomer
gaucuccucuuucaccucugc

SEQ ID NO: 23035 - RNA, 21 nt, Artificial Sequence
  RNA Oligomer
uuuccgcugguacagcuuguc

SEQ ID NO: 23036 - RNA, 21 nt, Artificial Sequence
  RNA Oligomer
aaagucagccauguccuggga

SEQ ID NO: 23037 - RNA, 21 nt, Artificial Sequence
  RNA Oligomer
gaagaaccacuuaauggugcc

SEQ ID NO: 23038 - RNA, 21 nt, Artificial Sequence
  RNA Oligomer
uauucguugaccacacagggc

SEQ ID NO: 23039 - RNA, 21 nt, Artificial Sequence
  RNA Oligomer
uaaauaugggagcgacagcag

SEQ ID NO: 23040 - RNA, 21 nt, Artificial Sequence
  RNA Oligomer
gucaaaacggaucccgaagac

SEQ ID NO: 23041 - RNA, 21 nt, Artificial Sequence
  RNA Oligomer
gaagacuuuuaucagaguccg

SEQ ID NO: 23042 - RNA, 21 nt, Artificial Sequence
  RNA Oligomer
aagacuuuuaucagaguccgu

SEQ ID NO: 23043 - RNA, 21 nt, Artificial Sequence
  RNA Oligomer
guuucucaacauuguuuuccu

SEQ ID NO: 23044 - RNA, 21 nt, Artificial Sequence
  RNA Oligomer
acauuguuuuccuuguaguac

SEQ ID NO: 23045 - RNA, 21 nt, Artificial Sequence
  RNA Oligomer
uaauucaugcucuggauccga

SEQ ID NO: 23046 - RNA, 21 nt, Artificial Sequence
  RNA Oligomer
gucugaauuccuuugcucugc

SEQ ID NO: 23047 - RNA, 21 nt, Artificial Sequence
  RNA Oligomer
uccauucuccacgaucuccuc

SEQ ID NO: 23048 - RNA, 21 nt, Artificial Sequence
  RNA Oligomer
auucuccacgaucuccucuuu

SEQ ID NO: 23049 - RNA, 21 nt, Artificial Sequence
  RNA Oligomer
uuuaaugucggcuuuggcucc

SEQ ID NO: 23050 - RNA, 21 nt, Artificial Sequence
  RNA Oligomer
acuuaauggugccauaauuca

SEQ ID NO: 23051 - RNA, 21 nt, Artificial Sequence
  RNA Oligomer
cguuucucaacauuguuuucc

SEQ ID NO: 23052 - RNA, 21 nt, Artificial Sequence
  RNA Oligomer
auaauucaugcucuggauccg

SEQ ID NO: 23053 - RNA, 21 nt, Artificial Sequence
  RNA Oligomer
uuucucgugguguaguugugg

SEQ ID NO: 23054 - RNA, 21 nt, Artificial Sequence
  RNA Oligomer
auauuguucuugaugagcaca

SEQ ID NO: 23055 - RNA, 21 nt, Artificial Sequence
  RNA Oligomer
guuuugagaaaguuugucauc

SEQ ID NO: 23056 - RNA, 21 nt, Artificial Sequence
  RNA Oligomer
aaagacacugugcaccaacuu

SEQ ID NO: 23057 - RNA, 21 nt, Artificial Sequence
  RNA Oligomer
aagacacugugcaccaacuuc

SEQ ID NO: 23058 - RNA, 21 nt, Artificial Sequence
  RNA Oligomer
acacugugcaccaacuucuuc

SEQ ID NO: 23059 - RNA, 21 nt, Artificial Sequence
  RNA Oligomer
acugugcaccaacuucuucac

SEQ ID NO: 23060 - RNA, 21 nt, Artificial Sequence
  RNA Oligomer
cuccacgaucuccucuuucac

SEQ ID NO: 23061 - RNA, 21 nt, Artificial Sequence
  RNA Oligomer
uggugugcacagaacugauga

SEQ ID NO: 23062 - RNA, 21 nt, Artificial Sequence
  RNA Oligomer
aucacguggaagaaccacuua

SEQ ID NO: 23063 - RNA, 21 nt, Artificial Sequence
  RNA Oligomer
uugcaccagggauaaauaugg

SEQ ID NO: 23064 - RNA, 21 nt, Artificial Sequence
  RNA Oligomer
ugcaccagggauaaauauggg

SEQ ID NO: 23065 - RNA, 21 nt, Artificial Sequence
  RNA Oligomer
aauggugccauaauucaugcu

SEQ ID NO: 23066 - RNA, 21 nt, Artificial Sequence
  RNA Oligomer
uuguaguacuuggcguaucug

SEQ ID NO: 23067 - RNA, 21 nt, Artificial Sequence
  RNA Oligomer
aauuaucgccuguuucucgga

SEQ ID NO: 23068 - RNA, 21 nt, Artificial Sequence
  RNA Oligomer
uucacaggucuucugguuccc

SEQ ID NO: 23069 - RNA, 21 nt, Artificial Sequence
  RNA Oligomer
cugugcaccaacuucuucacu

SEQ ID NO: 23070 - RNA, 21 nt, Artificial Sequence
  RNA Oligomer
auggacucgcacuucuuccug

SEQ ID NO: 23071 - RNA, 21 nt, Artificial Sequence
  RNA Oligomer
caccagggauaaauaugggag

SEQ ID NO: 23072 - RNA, 21 nt, Artificial Sequence
  RNA Oligomer
cauaauucaugcucuggaucc

SEQ ID NO: 23073 - RNA, 21 nt, Artificial Sequence
  RNA Oligomer
gucuuguggaagguacaagug

SEQ ID NO: 23074 - RNA, 21 nt, Artificial Sequence
  RNA Oligomer
aaccuggcaggauguuucucg

SEQ ID NO: 23075 - RNA, 21 nt, Artificial Sequence
  RNA Oligomer
ucgauauuguucuugaugagc

SEQ ID NO: 23076 - RNA, 21 nt, Artificial Sequence
  RNA Oligomer
gagcacagugaaguuuucggc

SEQ ID NO: 23077 - RNA, 21 nt, Artificial Sequence
  RNA Oligomer
uacuggaaaacaucacugcag

SEQ ID NO: 23078 - RNA, 21 nt, Artificial Sequence
  RNA Oligomer
cacgaucuccucuuucaccuc

SEQ ID NO: 23079 - RNA, 21 nt, Artificial Sequence
  RNA Oligomer
ggaagaaccacuuaauggugc

SEQ ID NO: 23080 - RNA, 21 nt, Artificial Sequence
  RNA Oligomer
auggugccauaauucaugcuc

SEQ ID NO: 23081 - RNA, 21 nt, Artificial Sequence
  RNA Oligomer
uaaaccuggcaggauguuucu

SEQ ID NO: 23082 - RNA, 21 nt, Artificial Sequence
  RNA Oligomer
ugagaaaguuugucaucacga

SEQ ID NO: 23083 - RNA, 21 nt, Artificial Sequence
  RNA Oligomer
ggaaaacaucacugcagcugc

SEQ ID NO: 23084 - RNA, 21 nt, Artificial Sequence
  RNA Oligomer
uuccgcugguacagcuuguca

SEQ ID NO: 23085 - RNA, 21 nt, Artificial Sequence
  RNA Oligomer
aacagcucugagguggugaug

SEQ ID NO: 23086 - RNA, 21 nt, Artificial Sequence
  RNA Oligomer
aucuaggagucgccuccuuuc

SEQ ID NO: 23087 - RNA, 21 nt, Artificial Sequence
  RNA Oligomer
ucauccacaaaggacacauac

SEQ ID NO: 23088 - RNA, 21 nt, Artificial Sequence
  RNA Oligomer
uggaagaaccacuuaauggug

SEQ ID NO: 23089 - RNA, 21 nt, Artificial Sequence
  RNA Oligomer
uaaugucggcuuuggcuccac

SEQ ID NO: 23090 - RNA, 21 nt, Artificial Sequence
  RNA Oligomer
uauuguucuugaugagcacag

SEQ ID NO: 23091 - RNA, 21 nt, Artificial Sequence
  RNA Oligomer
auuguucuugaugagcacagu

SEQ ID NO: 23092 - RNA, 21 nt, Artificial Sequence
  RNA Oligomer
cuggaaaacaucacugcagcu

SEQ ID NO: 23093 - RNA, 21 nt, Artificial Sequence
  RNA Oligomer
aaggacacauacuuuaauguc

SEQ ID NO: 23094 - RNA, 21 nt, Artificial Sequence
  RNA Oligomer
uuaaugucggcuuuggcucca

SEQ ID NO: 23095 - RNA, 21 nt, Artificial Sequence
  RNA Oligomer
guauucguugaccacacaggg

SEQ ID NO: 23096 - RNA, 21 nt, Artificial Sequence
  RNA Oligomer
uuuaucagaguccguuucuca

SEQ ID NO: 23097 - RNA, 21 nt, Artificial Sequence
  RNA Oligomer
cuuguaguacuuggcguaucu

SEQ ID NO: 23098 - RNA, 21 nt, Artificial Sequence
  RNA Oligomer
uucucggaagaugucuccuag

SEQ ID NO: 23099 - RNA, 21 nt, Artificial Sequence
  RNA Oligomer
uguggaagguacaagugaugu

SEQ ID NO: 23100 - RNA, 21 nt, Artificial Sequence
  RNA Oligomer
gugauguuuaaaccuggcagg

SEQ ID NO: 23101 - RNA, 21 nt, Artificial Sequence
  RNA Oligomer
gauauuguucuugaugagcac

SEQ ID NO: 23102 - RNA, 21 nt, Artificial Sequence
  RNA Oligomer
uuccugaacagcucugaggug

SEQ ID NO: 23103 - RNA, 21 nt, Artificial Sequence
  RNA Oligomer
aaaucugugaaguccaucgca

SEQ ID NO: 23104 - RNA, 21 nt, Artificial Sequence
  RNA Oligomer
aucgcaggucuugggacuucu

SEQ ID NO: 23105 - RNA, 21 nt, Artificial Sequence
  RNA Oligomer
accagggauaaauaugggagc

SEQ ID NO: 23106 - RNA, 21 nt, Artificial Sequence
  RNA Oligomer
caguuacuggaguaagugucg

SEQ ID NO: 23107 - RNA, 21 nt, Artificial Sequence
  RNA Oligomer
uacuggaguaagugucgauga

SEQ ID NO: 23108 - RNA, 21 nt, Artificial Sequence
  RNA Oligomer
cuggauaaugucaaauuuucc

SEQ ID NO: 23109 - RNA, 21 nt, Artificial Sequence
  RNA Oligomer
uuuccuuguaguacuuggcgu

SEQ ID NO: 23110 - RNA, 21 nt, Artificial Sequence
  RNA Oligomer
uguuuaaaccuggcaggaugu

SEQ ID NO: 23111 - RNA, 21 nt, Artificial Sequence
  RNA Oligomer
aagucgauauuguucuugaug

SEQ ID NO: 23112 - RNA, 21 nt, Artificial Sequence
  RNA Oligomer
gucgauauuguucuugaugag

SEQ ID NO: 23113 - RNA, 21 nt, Artificial Sequence
  RNA Oligomer
uuguucuugaugagcacagug

SEQ ID NO: 23114 - RNA, 21 nt, Artificial Sequence
  RNA Oligomer
cagagacuucacaggucuucu

SEQ ID NO: 23115 - RNA, 21 nt, Artificial Sequence
  RNA Oligomer
gagacuucacaggucuucugg

SEQ ID NO: 23116 - RNA, 21 nt, Artificial Sequence
  RNA Oligomer
acuucacaggucuucugguuc

SEQ ID NO: 23117 - RNA, 21 nt, Artificial Sequence
  RNA Oligomer
ucacaggucuucugguucccu

SEQ ID NO: 23118 - RNA, 21 nt, Artificial Sequence
  RNA Oligomer
accagcuuccugaacagcucu

SEQ ID NO: 23119 - RNA, 21 nt, Artificial Sequence
  RNA Oligomer
aagcagcuguaucuccucugg

SEQ ID NO: 23120 - RNA, 21 nt, Artificial Sequence
  RNA Oligomer
augaucacguggaagaaccac

SEQ ID NO: 23121 - RNA, 21 nt, Artificial Sequence
  RNA Oligomer
caaaucugugaaguccaucgc

SEQ ID NO: 23122 - RNA, 21 nt, Artificial Sequence
  RNA Oligomer
aucugugaaguccaucgcagg

SEQ ID NO: 23123 - RNA, 21 nt, Artificial Sequence
  RNA Oligomer
uuuggcuccacaauggacucg

SEQ ID NO: 23124 - RNA, 21 nt, Artificial Sequence
  RNA Oligomer
ucgcacuucuuccuguaguag

SEQ ID NO: 23125 - RNA, 21 nt, Artificial Sequence
  RNA Oligomer
guuuuccuuguaguacuuggc

SEQ ID NO: 23126 - RNA, 21 nt, Artificial Sequence
  RNA Oligomer
guggauucugagucuugugga

SEQ ID NO: 23127 - RNA, 21 nt, Artificial Sequence
  RNA Oligomer
auucugagucuuguggaaggu

SEQ ID NO: 23128 - RNA, 21 nt, Artificial Sequence
  RNA Oligomer
uuguggaagguacaagugaug

SEQ ID NO: 23129 - RNA, 21 nt, Artificial Sequence
  RNA Oligomer
aaaccuggcaggauguuucuc

SEQ ID NO: 23130 - RNA, 21 nt, Artificial Sequence
  RNA Oligomer
ugagcacagugaaguuuucgg

SEQ ID NO: 23131 - RNA, 21 nt, Artificial Sequence
  RNA Oligomer
acaccuuccggucugaauucc

SEQ ID NO: 23132 - RNA, 21 nt, Artificial Sequence
  RNA Oligomer
ugaauuccuuugcucugcggg

SEQ ID NO: 23133 - RNA, 21 nt, Artificial Sequence
  RNA Oligomer
gaugaucacguggaagaacca

SEQ ID NO: 23134 - RNA, 21 nt, Artificial Sequence
  RNA Oligomer
ccagggauaaauaugggagcg

SEQ ID NO: 23135 - RNA, 21 nt, Artificial Sequence
  RNA Oligomer
cgaagacuuuuaucagagucc

SEQ ID NO: 23136 - RNA, 21 nt, Artificial Sequence
  RNA Oligomer
cuuuuaucagaguccguuucu

SEQ ID NO: 23137 - RNA, 21 nt, Artificial Sequence
  RNA Oligomer
auccgagugacuuuguucguc

SEQ ID NO: 23138 - RNA, 21 nt, Artificial Sequence
  RNA Oligomer
uagucggaaaaugggacacug

SEQ ID NO: 23139 - RNA, 21 nt, Artificial Sequence
  RNA Oligomer
uguggauucugagucuugugg

SEQ ID NO: 23140 - RNA, 21 nt, Artificial Sequence
  RNA Oligomer
aagugauguuuaaaccuggca

SEQ ID NO: 23141 - RNA, 21 nt, Artificial Sequence
  RNA Oligomer
uucucgugguguaguuguggc

SEQ ID NO: 23142 - RNA, 21 nt, Artificial Sequence
  RNA Oligomer
uucggcacuguucaagagagc

SEQ ID NO: 23143 - RNA, 21 nt, Artificial Sequence
  RNA Oligomer
uuuuacaaccucggucagagg

SEQ ID NO: 23144 - RNA, 21 nt, Artificial Sequence
  RNA Oligomer
aaccucggucagaggaacaga

SEQ ID NO: 23145 - RNA, 21 nt, Artificial Sequence
  RNA Oligomer
ugaacagcucugaggugguga

SEQ ID NO: 23146 - RNA, 21 nt, Artificial Sequence
  RNA Oligomer
ugugaaguccaucgcaggucu

SEQ ID NO: 23147 - RNA, 21 nt, Artificial Sequence
  RNA Oligomer
ugugggauucauccacaaagg

SEQ ID NO: 23148 - RNA, 21 nt, Artificial Sequence
  RNA Oligomer
cacaaaggacacauacuuuaa

SEQ ID NO: 23149 - RNA, 21 nt, Artificial Sequence
  RNA Oligomer
aggacacauacuuuaaugucg

SEQ ID NO: 23150 - RNA, 21 nt, Artificial Sequence
  RNA Oligomer
gacacauacuuuaaugucggc

SEQ ID NO: 23151 - RNA, 21 nt, Artificial Sequence
  RNA Oligomer
auaaauaugggagcgacagca

SEQ ID NO: 23152 - RNA, 21 nt, Artificial Sequence
  RNA Oligomer
uuacuggaguaagugucgaug

SEQ ID NO: 23153 - RNA, 21 nt, Artificial Sequence
  RNA Oligomer
uuaauggugccauaauucaug

SEQ ID NO: 23154 - RNA, 21 nt, Artificial Sequence
  RNA Oligomer
cacaaccagcuggauaauguc

SEQ ID NO: 23155 - RNA, 21 nt, Artificial Sequence
  RNA Oligomer
uguuuuccuuguaguacuugg

SEQ ID NO: 23156 - RNA, 21 nt, Artificial Sequence
  RNA Oligomer
augcucuggauccgagugacu

SEQ ID NO: 23157 - RNA, 21 nt, Artificial Sequence
  RNA Oligomer
ucuuguggaagguacaaguga

SEQ ID NO: 23158 - RNA, 21 nt, Artificial Sequence
  RNA Oligomer
aaaguuugucaucacgaagaa

SEQ ID NO: 23159 - RNA, 21 nt, Artificial Sequence
  RNA Oligomer
agcagcuguaucuccucuggu

SEQ ID NO: 23160 - RNA, 21 nt, Artificial Sequence
  RNA Oligomer
ugguucaccauccuaaugugg

SEQ ID NO: 23161 - RNA, 21 nt, Artificial Sequence
  RNA Oligomer
gugggauucauccacaaagga

SEQ ID NO: 23162 - RNA, 21 nt, Artificial Sequence
  RNA Oligomer
uuuuaucagaguccguuucuc

SEQ ID NO: 23163 - RNA, 21 nt, Artificial Sequence
  RNA Oligomer
ucggaaaaugggacacugugg

SEQ ID NO: 23164 - RNA, 21 nt, Artificial Sequence
  RNA Oligomer
cuguggauucugagucuugug

SEQ ID NO: 23165 - RNA, 21 nt, Artificial Sequence
  RNA Oligomer
uagucugcggugucaaagaca

SEQ ID NO: 23166 - RNA, 21 nt, Artificial Sequence
  RNA Oligomer
uggcaaagucagccauguccu

SEQ ID NO: 23167 - RNA, 21 nt, Artificial Sequence
  RNA Oligomer
aaucugugaaguccaucgcag

SEQ ID NO: 23168 - RNA, 21 nt, Artificial Sequence
  RNA Oligomer
ggacacauacuuuaaugucgg

SEQ ID NO: 23169 - RNA, 21 nt, Artificial Sequence
  RNA Oligomer
aauucaugcucuggauccgag

SEQ ID NO: 23170 - RNA, 21 nt, Artificial Sequence
  RNA Oligomer
auucaugcucuggauccgagu

SEQ ID NO: 23171 - RNA, 21 nt, Artificial Sequence
  RNA Oligomer
agugauguuuaaaccuggcag

SEQ ID NO: 23172 - RNA, 21 nt, Artificial Sequence
  RNA Oligomer
ugauguuuaaaccuggcagga

SEQ ID NO: 23173 - RNA, 21 nt, Artificial Sequence
  RNA Oligomer
aggcagagacuucacaggucu

SEQ ID NO: 23174 - RNA, 21 nt, Artificial Sequence
  RNA Oligomer
cugcggugucaaagacacugu

SEQ ID NO: 23175 - RNA, 21 nt, Artificial Sequence
  RNA Oligomer
aacugaugacaggcucuuucc

SEQ ID NO: 23176 - RNA, 21 nt, Artificial Sequence
  RNA Oligomer
cuuuggcuccacaauggacuc

SEQ ID NO: 23177 - RNA, 21 nt, Artificial Sequence
  RNA Oligomer
guugagccgauguacacaacc

SEQ ID NO: 23178 - RNA, 21 nt, Artificial Sequence
  RNA Oligomer
uuuccuccggugccaaaaacc

SEQ ID NO: 23179 - RNA, 21 nt, Artificial Sequence
  RNA Oligomer
aggaugucaaaacggaucccg

SEQ ID NO: 23180 - RNA, 21 nt, Artificial Sequence
  RNA Oligomer
agaguccguuucucaacauug

SEQ ID NO: 23181 - RNA, 21 nt, Artificial Sequence
  RNA Oligomer
gauccgagugacuuuguucgu

SEQ ID NO: 23182 - RNA, 21 nt, Artificial Sequence
  RNA Oligomer
gugacuuuguucgucucauac

SEQ ID NO: 23183 - RNA, 21 nt, Artificial Sequence
  RNA Oligomer
accuggcaggauguuucucgu

SEQ ID NO: 23184 - RNA, 21 nt, Artificial Sequence
  RNA Oligomer
caccuuccggucugaauuccu

SEQ ID NO: 23185 - RNA, 21 nt, Artificial Sequence
  RNA Oligomer
uuugucaucacgaagaaagag

SEQ ID NO: 23186 - RNA, 21 nt, Artificial Sequence
  RNA Oligomer
ugcggugucaaagacacugug

SEQ ID NO: 23187 - RNA, 21 nt, Artificial Sequence
  RNA Oligomer
cagcuuccugaacagcucuga

SEQ ID NO: 23188 - RNA, 21 nt, Artificial Sequence
  RNA Oligomer
agcuuccugaacagcucugag

SEQ ID NO: 23189 - RNA, 21 nt, Artificial Sequence
  RNA Oligomer
cuuccugaacagcucugaggu

SEQ ID NO: 23190 - RNA, 21 nt, Artificial Sequence
  RNA Oligomer
uggacaaaucugugaagucca

SEQ ID NO: 23191 - RNA, 21 nt, Artificial Sequence
  RNA Oligomer
caaaggacacauacuuuaaug

SEQ ID NO: 23192 - RNA, 21 nt, Artificial Sequence
  RNA Oligomer
acacauacuuuaaugucggcu

SEQ ID NO: 23193 - RNA, 21 nt, Artificial Sequence
  RNA Oligomer
aaugucggcuuuggcuccaca

SEQ ID NO: 23194 - RNA, 21 nt, Artificial Sequence
  RNA Oligomer
uccacaauggacucgcacuuc

SEQ ID NO: 23195 - RNA, 21 nt, Artificial Sequence
  RNA Oligomer
cagcaguuacuggaguaagug

SEQ ID NO: 23196 - RNA, 21 nt, Artificial Sequence
  RNA Oligomer
caggaugucaaaacggauccc

SEQ ID NO: 23197 - RNA, 21 nt, Artificial Sequence
  RNA Oligomer
uccgagugacuuuguucgucu

SEQ ID NO: 23198 - RNA, 21 nt, Artificial Sequence
  RNA Oligomer
cacuuaauggugccauaauuc

SEQ ID NO: 23199 - RNA, 21 nt, Artificial Sequence
  RNA Oligomer
ggauaaugucaaauuuuccuc

SEQ ID NO: 23200 - RNA, 21 nt, Artificial Sequence
  RNA Oligomer
uuuacaaccucggucagagga

SEQ ID NO: 23201 - RNA, 21 nt, Artificial Sequence
  RNA Oligomer
ugcacagaacugaugacaggc

SEQ ID NO: 23202 - RNA, 21 nt, Artificial Sequence
  RNA Oligomer
ucucagggaguugagauggga

SEQ ID NO: 23203 - RNA, 21 nt, Artificial Sequence
  RNA Oligomer
agucggaaaaugggacacugu

SEQ ID NO: 23204 - RNA, 21 nt, Artificial Sequence
  RNA Oligomer
uccggucugaauuccuuugcu

SEQ ID NO: 23205 - RNA, 21 nt, Artificial Sequence
  RNA Oligomer
aaccacuuaauggugccauaa

SEQ ID NO: 23206 - RNA, 21 nt, Artificial Sequence
  RNA Oligomer
uuccuccggugccaaaaacca

SEQ ID NO: 23207 - RNA, 21 nt, Artificial Sequence
  RNA Oligomer
ccaggaugucaaaacggaucc

SEQ ID NO: 23208 - RNA, 21 nt, Artificial Sequence
  RNA Oligomer
acagcuugucacucaccagag

SEQ ID NO: 23209 - RNA, 21 nt, Artificial Sequence
  RNA Oligomer
cugguucaccauccuaaugug

SEQ ID NO: 23210 - RNA, 21 nt, Artificial Sequence
  RNA Oligomer
agcuugucacucaccagagca

SEQ ID NO: 23211 - RNA, 21 nt, Artificial Sequence
  RNA Oligomer
cugcaaagggaagguguaguc

SEQ ID NO: 23212 - RNA, 21 nt, Artificial Sequence
  RNA Oligomer
cucuuggccuucuguuuugag

SEQ ID NO: 23213 - RNA, 21 nt, Artificial Sequence
  RNA Oligomer
ugucaaagacacugugcacca

SEQ ID NO: 23214 - RNA, 21 nt, Artificial Sequence
  RNA Oligomer
uugggacuucuuggcccuuga

SEQ ID NO: 23215 - RNA, 21 nt, Artificial Sequence
  RNA Oligomer
gaugaggaagucgaugaacac

SEQ ID NO: 23216 - RNA, 21 nt, Artificial Sequence
  RNA Oligomer
cacagaacugaugacaggcuc

SEQ ID NO: 23217 - RNA, 21 nt, Artificial Sequence
  RNA Oligomer
uagcugcugguucaccauccu

SEQ ID NO: 23218 - RNA, 21 nt, Artificial Sequence
  RNA Oligomer
acaaccagcuggauaauguca

SEQ ID NO: 23219 - RNA, 21 nt, Artificial Sequence
  RNA Oligomer
aaaacaucacugcagcugcag

SEQ ID NO: 23220 - RNA, 21 nt, Artificial Sequence
  RNA Oligomer
ugugcacagaacugaugacag

SEQ ID NO: 23221 - RNA, 21 nt, Artificial Sequence
  RNA Oligomer
cuggacaaaucugugaagucc

SEQ ID NO: 23222 - RNA, 21 nt, Artificial Sequence
  RNA Oligomer
ucgaugaggaagucgaugaac

SEQ ID NO: 23223 - RNA, 21 nt, Artificial Sequence
  RNA Oligomer
acugaugacaggcucuuuccg

SEQ ID NO: 23224 - RNA, 21 nt, Artificial Sequence
  RNA Oligomer
acuggaaaacaucacugcagc

SEQ ID NO: 23225 - RNA, 21 nt, Artificial Sequence
  RNA Oligomer
gucacucaccagagcaaagca

SEQ ID NO: 23226 - RNA, 21 nt, Artificial Sequence
  RNA Oligomer
aaacaucacugcagcugcagc

SEQ ID NO: 23227 - RNA, 21 nt, Artificial Sequence
  RNA Oligomer
uaguagcugcugguucaccau

SEQ ID NO: 23228 - RNA, 21 nt, Artificial Sequence
  RNA Oligomer
acagaacugaugacaggcucu

SEQ ID NO: 23229 - RNA, 21 nt, Artificial Sequence
  RNA Oligomer
ccaccugaacauccucuccua

SEQ ID NO: 23230 - RNA, 21 nt, Artificial Sequence
  RNA Oligomer
gcacaagcagcucaagaacaa

SEQ ID NO: 23231 - RNA, 21 nt, Artificial Sequence
  RNA Oligomer
gcccaagaucaucauugugaa

SEQ ID NO: 23232 - RNA, 21 nt, Artificial Sequence
  RNA Oligomer
ggcaacaaugacaagcaagaa

SEQ ID NO: 23233 - RNA, 21 nt, Artificial Sequence
  RNA Oligomer
cgaggacaucagcaauaaggu

SEQ ID NO: 23234 - RNA, 21 nt, Artificial Sequence
  RNA Oligomer
gcggaugaugaaggacgucuu

SEQ ID NO: 23235 - RNA, 21 nt, Artificial Sequence
  RNA Oligomer
ccugaacauccucuccuacuu

SEQ ID NO: 23236 - RNA, 21 nt, Artificial Sequence
  RNA Oligomer
ggccaaggacaugaaguuugu

SEQ ID NO: 23237 - RNA, 21 nt, Artificial Sequence
  RNA Oligomer
cgcagugagaucuucauggau

SEQ ID NO: 23238 - RNA, 21 nt, Artificial Sequence
  RNA Oligomer
gucuuuugaaaacuugcugaa

SEQ ID NO: 23239 - RNA, 21 nt, Artificial Sequence
  RNA Oligomer
caaccuccucaucgccauguu

SEQ ID NO: 23240 - RNA, 21 nt, Artificial Sequence
  RNA Oligomer
cccaagaucaucauugugaag

SEQ ID NO: 23241 - RNA, 21 nt, Artificial Sequence
  RNA Oligomer
ccgcagugagaucuucaugga

SEQ ID NO: 23242 - RNA, 21 nt, Artificial Sequence
  RNA Oligomer
ccaccugcagcucuucaucaa

SEQ ID NO: 23243 - RNA, 21 nt, Artificial Sequence
  RNA Oligomer
gcguguauuuuguggaaaguu

SEQ ID NO: 23244 - RNA, 21 nt, Artificial Sequence
  RNA Oligomer
gaagaaagaaugcguguauuu

SEQ ID NO: 23245 - RNA, 21 nt, Artificial Sequence
  RNA Oligomer
caccugaacauccucuccuac

SEQ ID NO: 23246 - RNA, 21 nt, Artificial Sequence
  RNA Oligomer
gcaacagcagccucuucaaga

SEQ ID NO: 23247 - RNA, 21 nt, Artificial Sequence
  RNA Oligomer
gcaacaaugacaagcaagaaa

SEQ ID NO: 23248 - RNA, 21 nt, Artificial Sequence
  RNA Oligomer
caggaagagcauaaagaagau

SEQ ID NO: 23249 - RNA, 21 nt, Artificial Sequence
  RNA Oligomer
ggacaucagcaauaagguuga

SEQ ID NO: 23250 - RNA, 21 nt, Artificial Sequence
  RNA Oligomer
gaucgaggacaucagcaauaa

SEQ ID NO: 23251 - RNA, 21 nt, Artificial Sequence
  RNA Oligomer
cugaacauccucuccuacuuc

SEQ ID NO: 23252 - RNA, 21 nt, Artificial Sequence
  RNA Oligomer
gccaaggacaugaaguuugug

SEQ ID NO: 23253 - RNA, 21 nt, Artificial Sequence
  RNA Oligomer
cccauccgugaccuucucauu

SEQ ID NO: 23254 - RNA, 21 nt, Artificial Sequence
  RNA Oligomer
caccuugcucuaccuguacga

SEQ ID NO: 23255 - RNA, 21 nt, Artificial Sequence
  RNA Oligomer
gaguacauacuggaugaggau

SEQ ID NO: 23256 - RNA, 21 nt, Artificial Sequence
  RNA Oligomer
ggugaaaaaguacguccgagu

SEQ ID NO: 23257 - RNA, 21 nt, Artificial Sequence
  RNA Oligomer
ccuccucaucgccauguucaa

SEQ ID NO: 23258 - RNA, 21 nt, Artificial Sequence
  RNA Oligomer
agaagaaagaaugcguguauu

SEQ ID NO: 23259 - RNA, 21 nt, Artificial Sequence
  RNA Oligomer
ggaggccaaggacaugaaguu

SEQ ID NO: 23260 - RNA, 21 nt, Artificial Sequence
  RNA Oligomer
cagugagaucuucauggauga

SEQ ID NO: 23261 - RNA, 21 nt, Artificial Sequence
  RNA Oligomer
ggaaagcaggauugucgagug

SEQ ID NO: 23262 - RNA, 21 nt, Artificial Sequence
  RNA Oligomer
gagcguguucuuccaggagau

SEQ ID NO: 23263 - RNA, 21 nt, Artificial Sequence
  RNA Oligomer
caucacuaucucccugaucca

SEQ ID NO: 23264 - RNA, 21 nt, Artificial Sequence
  RNA Oligomer
ccacucucacuucauccucgu

SEQ ID NO: 23265 - RNA, 21 nt, Artificial Sequence
  RNA Oligomer
gaaaguuccaaacugucugau

SEQ ID NO: 23266 - RNA, 21 nt, Artificial Sequence
  RNA Oligomer
ccacuccuaccucaccaucuu

SEQ ID NO: 23267 - RNA, 21 nt, Artificial Sequence
  RNA Oligomer
gaagcggaugaugaaggacgu

SEQ ID NO: 23268 - RNA, 21 nt, Artificial Sequence
  RNA Oligomer
agaucaucauugugaagcgga

SEQ ID NO: 23269 - RNA, 21 nt, Artificial Sequence
  RNA Oligomer
caagaucaucauugugaagcg

SEQ ID NO: 23270 - RNA, 21 nt, Artificial Sequence
  RNA Oligomer
gggcccaagaucaucauugug

SEQ ID NO: 23271 - RNA, 21 nt, Artificial Sequence
  RNA Oligomer
ugagaucuucauggaugagug

SEQ ID NO: 23272 - RNA, 21 nt, Artificial Sequence
  RNA Oligomer
ggagaaguucauaucggagca

SEQ ID NO: 23273 - RNA, 21 nt, Artificial Sequence
  RNA Oligomer
cggcaacaaugacaagcaaga

SEQ ID NO: 23274 - RNA, 21 nt, Artificial Sequence
  RNA Oligomer
gucuucauuuuccuaaaccug

SEQ ID NO: 23275 - RNA, 21 nt, Artificial Sequence
  RNA Oligomer
ugucuucauuuuccuaaaccu

SEQ ID NO: 23276 - RNA, 21 nt, Artificial Sequence
  RNA Oligomer
guacaaaggcuacauggauga

SEQ ID NO: 23277 - RNA, 21 nt, Artificial Sequence
  RNA Oligomer
agaucgaggacaucagcaaua

SEQ ID NO: 23278 - RNA, 21 nt, Artificial Sequence
  RNA Oligomer
gaagaucgaggacaucagcaa

SEQ ID NO: 23279 - RNA, 21 nt, Artificial Sequence
  RNA Oligomer
gcucuucaccaacauccugcu

SEQ ID NO: 23280 - RNA, 21 nt, Artificial Sequence
  RNA Oligomer
gaaugcguguauuuuguggaa

SEQ ID NO: 23281 - RNA, 21 nt, Artificial Sequence
  RNA Oligomer
gccuuguacuucagugacuuc

SEQ ID NO: 23282 - RNA, 21 nt, Artificial Sequence
  RNA Oligomer
gucuuccaccugaacauccuc

SEQ ID NO: 23283 - RNA, 21 nt, Artificial Sequence
  RNA Oligomer
ccaaggacaugaaguuugugu

SEQ ID NO: 23284 - RNA, 21 nt, Artificial Sequence
  RNA Oligomer
gaggccaaggacaugaaguuu

SEQ ID NO: 23285 - RNA, 21 nt, Artificial Sequence
  RNA Oligomer
ccuucucauuugggccauugu

SEQ ID NO: 23286 - RNA, 21 nt, Artificial Sequence
  RNA Oligomer
gcagugagaucuucauggaug

SEQ ID NO: 23287 - RNA, 21 nt, Artificial Sequence
  RNA Oligomer
ugaaacuggcaguggcaugga

SEQ ID NO: 23288 - RNA, 21 nt, Artificial Sequence
  RNA Oligomer
agaaagccucaguucguggau

SEQ ID NO: 23289 - RNA, 21 nt, Artificial Sequence
  RNA Oligomer
guguucuuccaggagauguuu

SEQ ID NO: 23290 - RNA, 21 nt, Artificial Sequence
  RNA Oligomer
caacaaugacaagcaagaaag

SEQ ID NO: 23291 - RNA, 21 nt, Artificial Sequence
  RNA Oligomer
ucggcaacaaugacaagcaag

SEQ ID NO: 23292 - RNA, 21 nt, Artificial Sequence
  RNA Oligomer
gugaaaaaguacguccgaguc

SEQ ID NO: 23293 - RNA, 21 nt, Artificial Sequence
  RNA Oligomer
ccugagccagaaggugaaaaa

SEQ ID NO: 23294 - RNA, 21 nt, Artificial Sequence
  RNA Oligomer
cugucuucauuuuccuaaacc

SEQ ID NO: 23295 - RNA, 21 nt, Artificial Sequence
  RNA Oligomer
gcugaacaggcugaacucuaa

SEQ ID NO: 23296 - RNA, 21 nt, Artificial Sequence
  RNA Oligomer
gcaggaagagcauaaagaaga

SEQ ID NO: 23297 - RNA, 21 nt, Artificial Sequence
  RNA Oligomer
gaucuaugacccacccuuuua

SEQ ID NO: 23298 - RNA, 21 nt, Artificial Sequence
  RNA Oligomer
gaggacaucagcaauaagguu

SEQ ID NO: 23299 - RNA, 21 nt, Artificial Sequence
  RNA Oligomer
cuaccacuccuaccucaccau

SEQ ID NO: 23300 - RNA, 21 nt, Artificial Sequence
  RNA Oligomer
aagaagaaagaaugcguguau

SEQ ID NO: 23301 - RNA, 21 nt, Artificial Sequence
  RNA Oligomer
gcauggaaucgcguggacauu

SEQ ID NO: 23302 - RNA, 21 nt, Artificial Sequence
  RNA Oligomer
aaacuggcaguggcauggaau

SEQ ID NO: 23303 - RNA, 21 nt, Artificial Sequence
  RNA Oligomer
gaaacuggcaguggcauggaa

SEQ ID NO: 23304 - RNA, 21 nt, Artificial Sequence
  RNA Oligomer
ggauugucgaguggaccaaaa

SEQ ID NO: 23305 - RNA, 21 nt, Artificial Sequence
  RNA Oligomer
cacggaaagcaggauugucga

SEQ ID NO: 23306 - RNA, 21 nt, Artificial Sequence
  RNA Oligomer
cguguucuuccaggagauguu

SEQ ID NO: 23307 - RNA, 21 nt, Artificial Sequence
  RNA Oligomer
gaaguucauaucggagcagac

SEQ ID NO: 23308 - RNA, 21 nt, Artificial Sequence
  RNA Oligomer
gcaaccacucucacuucaucc

SEQ ID NO: 23309 - RNA, 21 nt, Artificial Sequence
  RNA Oligomer
cgaguacauacuggaugagga

SEQ ID NO: 23310 - RNA, 21 nt, Artificial Sequence
  RNA Oligomer
uggugucaacagcucacagga

SEQ ID NO: 23311 - RNA, 21 nt, Artificial Sequence
  RNA Oligomer
cugaacaggcugaacucuaac

SEQ ID NO: 23312 - RNA, 21 nt, Artificial Sequence
  RNA Oligomer
cagaaugacguggagcugaac

SEQ ID NO: 23313 - RNA, 21 nt, Artificial Sequence
  RNA Oligomer
ugcggcauggagguguacaaa

SEQ ID NO: 23314 - RNA, 21 nt, Artificial Sequence
  RNA Oligomer
ugcguguauuuuguggaaagu

SEQ ID NO: 23315 - RNA, 21 nt, Artificial Sequence
  RNA Oligomer
ggcccaagaucaucauuguga

SEQ ID NO: 23316 - RNA, 21 nt, Artificial Sequence
  RNA Oligomer
caagaagaaagaaugcgugua

SEQ ID NO: 23317 - RNA, 21 nt, Artificial Sequence
  RNA Oligomer
ccauccgugaccuucucauuu

SEQ ID NO: 23318 - RNA, 21 nt, Artificial Sequence
  RNA Oligomer
ggacaccuugcucuaccugua

SEQ ID NO: 23319 - RNA, 21 nt, Artificial Sequence
  RNA Oligomer
cauggaugaguggcaguggaa

SEQ ID NO: 23320 - RNA, 21 nt, Artificial Sequence
  RNA Oligomer
cuacaaggaaggcgagcucau

SEQ ID NO: 23321 - RNA, 21 nt, Artificial Sequence
  RNA Oligomer
caaauaaaguuccugacacgu

SEQ ID NO: 23322 - RNA, 21 nt, Artificial Sequence
  RNA Oligomer
cucuaccugcucuucaccaac

SEQ ID NO: 23323 - RNA, 21 nt, Artificial Sequence
  RNA Oligomer
agaaugcguguauuuugugga

SEQ ID NO: 23324 - RNA, 21 nt, Artificial Sequence
  RNA Oligomer
gcaguggaagccuucagaucu

SEQ ID NO: 23325 - RNA, 21 nt, Artificial Sequence
  RNA Oligomer
agcguguucuuccaggagaug

SEQ ID NO: 23326 - RNA, 21 nt, Artificial Sequence
  RNA Oligomer
agaaguucauaucggagcaga

SEQ ID NO: 23327 - RNA, 21 nt, Artificial Sequence
  RNA Oligomer
acaaauaaaguuccugacacg

SEQ ID NO: 23328 - RNA, 21 nt, Artificial Sequence
  RNA Oligomer
ugguuuggugucaacagcuca

SEQ ID NO: 23329 - RNA, 21 nt, Artificial Sequence
  RNA Oligomer
cauggagguguacaaaggcua

SEQ ID NO: 23330 - RNA, 21 nt, Artificial Sequence
  RNA Oligomer
gcauggagguguacaaaggcu

SEQ ID NO: 23331 - RNA, 21 nt, Artificial Sequence
  RNA Oligomer
aggaagagcauaaagaagaug

SEQ ID NO: 23332 - RNA, 21 nt, Artificial Sequence
  RNA Oligomer
cacuccuaccucaccaucuuc

SEQ ID NO: 23333 - RNA, 21 nt, Artificial Sequence
  RNA Oligomer
ggacgucuucuucuuccucuu

SEQ ID NO: 23334 - RNA, 21 nt, Artificial Sequence
  RNA Oligomer
gaaagaaugcguguauuuugu

SEQ ID NO: 23335 - RNA, 21 nt, Artificial Sequence
  RNA Oligomer
agaaagaaugcguguauuuug

SEQ ID NO: 23336 - RNA, 21 nt, Artificial Sequence
  RNA Oligomer
cauccucuccuacuucgccuu

SEQ ID NO: 23337 - RNA, 21 nt, Artificial Sequence
  RNA Oligomer
gcguguucuuccaggagaugu

SEQ ID NO: 23338 - RNA, 21 nt, Artificial Sequence
  RNA Oligomer
gcuggagaaguucauaucgga

SEQ ID NO: 23339 - RNA, 21 nt, Artificial Sequence
  RNA Oligomer
ccaggcuggagaaguucauau

SEQ ID NO: 23340 - RNA, 21 nt, Artificial Sequence
  RNA Oligomer
caaagaaacauguccaggaga

SEQ ID NO: 23341 - RNA, 21 nt, Artificial Sequence
  RNA Oligomer
ccuucugguuuggugucaaca

SEQ ID NO: 23342 - RNA, 21 nt, Artificial Sequence
  RNA Oligomer
gcacuggccgucuuuugaaaa

SEQ ID NO: 23343 - RNA, 21 nt, Artificial Sequence
  RNA Oligomer
caagaacaagcuggagaagaa

SEQ ID NO: 23344 - RNA, 21 nt, Artificial Sequence
  RNA Oligomer
cgccauguucaacuacaccuu

SEQ ID NO: 23345 - RNA, 21 nt, Artificial Sequence
  RNA Oligomer
cguguauuuuguggaaaguuc

SEQ ID NO: 23346 - RNA, 21 nt, Artificial Sequence
  RNA Oligomer
cgaagagagagcccagaaacu

SEQ ID NO: 23347 - RNA, 21 nt, Artificial Sequence
  RNA Oligomer
acgaagagagagcccagaaac

SEQ ID NO: 23348 - RNA, 21 nt, Artificial Sequence
  RNA Oligomer
gacgaagagagagcccagaaa

SEQ ID NO: 23349 - RNA, 21 nt, Artificial Sequence
  RNA Oligomer
guggaagccuucagaucugca

SEQ ID NO: 23350 - RNA, 21 nt, Artificial Sequence
  RNA Oligomer
gcaagaaagccucaguucgug

SEQ ID NO: 23351 - RNA, 21 nt, Artificial Sequence
  RNA Oligomer
gagaaguucauaucggagcag

SEQ ID NO: 23352 - RNA, 21 nt, Artificial Sequence
  RNA Oligomer
cuacauggaugacccgaggaa

SEQ ID NO: 23353 - RNA, 21 nt, Artificial Sequence
  RNA Oligomer
gaaccgacaguuccagcaaaa

SEQ ID NO: 23354 - RNA, 21 nt, Artificial Sequence
  RNA Oligomer
gcagcugaaggaguuugucac

SEQ ID NO: 23355 - RNA, 21 nt, Artificial Sequence
  RNA Oligomer
ccugucuucauuuuccuaaac

SEQ ID NO: 23356 - RNA, 21 nt, Artificial Sequence
  RNA Oligomer
ugcuuuccacaaauaaaguuc

SEQ ID NO: 23357 - RNA, 21 nt, Artificial Sequence
  RNA Oligomer
acggaccagauuuggaaguuc

SEQ ID NO: 23358 - RNA, 21 nt, Artificial Sequence
  RNA Oligomer
gacaccuugcucuaccuguac

SEQ ID NO: 23359 - RNA, 21 nt, Artificial Sequence
  RNA Oligomer
accaaaaagauccaagauauc

SEQ ID NO: 23360 - RNA, 21 nt, Artificial Sequence
  RNA Oligomer
cuggagaaguucauaucggag

SEQ ID NO: 23361 - RNA, 21 nt, Artificial Sequence
  RNA Oligomer
caggcuggagaaguucauauc

SEQ ID NO: 23362 - RNA, 21 nt, Artificial Sequence
  RNA Oligomer
cacaagcagcucaagaacaag

SEQ ID NO: 23363 - RNA, 21 nt, Artificial Sequence
  RNA Oligomer
ccucaucgccauguucaacua

SEQ ID NO: 23364 - RNA, 21 nt, Artificial Sequence
  RNA Oligomer
gacuucauccuguucugccuc

SEQ ID NO: 23365 - RNA, 21 nt, Artificial Sequence
  RNA Oligomer
ggagauguuugagaccuucac

SEQ ID NO: 23366 - RNA, 21 nt, Artificial Sequence
  RNA Oligomer
aggagauguuugagaccuuca

SEQ ID NO: 23367 - RNA, 21 nt, Artificial Sequence
  RNA Oligomer
cugaucuaugacccacccuuu

SEQ ID NO: 23368 - RNA, 21 nt, Artificial Sequence
  RNA Oligomer
gcagaagaucgaggacaucag

SEQ ID NO: 23369 - RNA, 21 nt, Artificial Sequence
  RNA Oligomer
gaaggagaacuaccuccagaa

SEQ ID NO: 23370 - RNA, 21 nt, Artificial Sequence
  RNA Oligomer
ccaugaccugaucgaggagua

SEQ ID NO: 23371 - RNA, 21 nt, Artificial Sequence
  RNA Oligomer
ggacaucacuaucucccugau

SEQ ID NO: 23372 - RNA, 21 nt, Artificial Sequence
  RNA Oligomer
cucccugucuucauuuuccua

SEQ ID NO: 23373 - RNA, 21 nt, Artificial Sequence
  RNA Oligomer
gucauuggccugaggcaaguu

SEQ ID NO: 23374 - RNA, 21 nt, Artificial Sequence
  RNA Oligomer
ccgucuuuugaaaacuugcug

SEQ ID NO: 23375 - RNA, 21 nt, Artificial Sequence
  RNA Oligomer
ggagacggaguuccugaucua

SEQ ID NO: 23376 - RNA, 21 nt, Artificial Sequence
  RNA Oligomer
gccauguucaacuacaccuuc

SEQ ID NO: 23377 - RNA, 21 nt, Artificial Sequence
  RNA Oligomer
ccucuaccugcucuucaccaa

SEQ ID NO: 23378 - RNA, 21 nt, Artificial Sequence
  RNA Oligomer
gcacauuuuuaccaucaguaa

SEQ ID NO: 23379 - RNA, 21 nt, Artificial Sequence
  RNA Oligomer
ccuccggcucaugcacauuuu

SEQ ID NO: 23380 - RNA, 21 nt, Artificial Sequence
  RNA Oligomer
ccaggagauguuugagaccuu

SEQ ID NO: 23381 - RNA, 21 nt, Artificial Sequence
  RNA Oligomer
gcagaaacugagcguguucuu

SEQ ID NO: 23382 - RNA, 21 nt, Artificial Sequence
  RNA Oligomer
ccaucagcucccugucuucau

SEQ ID NO: 23383 - RNA, 21 nt, Artificial Sequence
  RNA Oligomer
cuggccgucuuuugaaaacuu

SEQ ID NO: 23384 - RNA, 21 nt, Artificial Sequence
  RNA Oligomer
ccaucugcaggaagagcauaa

SEQ ID NO: 23385 - RNA, 21 nt, Artificial Sequence
  RNA Oligomer
gagcagaagaucgaggacauc

SEQ ID NO: 23386 - RNA, 21 nt, Artificial Sequence
  RNA Oligomer
cgacaguuccagcaaaagcag

SEQ ID NO: 23387 - RNA, 21 nt, Artificial Sequence
  RNA Oligomer
gaucuaccugaaggagaacua

SEQ ID NO: 23388 - RNA, 21 nt, Artificial Sequence
  RNA Oligomer
caagcuggagaagaacgagga

SEQ ID NO: 23389 - RNA, 21 nt, Artificial Sequence
  RNA Oligomer
caagaggcacaagcagcucaa

SEQ ID NO: 23390 - RNA, 21 nt, Artificial Sequence
  RNA Oligomer
gcacacggaccagauuuggaa

SEQ ID NO: 23391 - RNA, 21 nt, Artificial Sequence
  RNA Oligomer
aggagcacacggaccagauuu

SEQ ID NO: 23392 - RNA, 21 nt, Artificial Sequence
  RNA Oligomer
cgucuucuucuuccucuuccu

SEQ ID NO: 23393 - RNA, 21 nt, Artificial Sequence
  RNA Oligomer
cuccggcucaugcacauuuuu

SEQ ID NO: 23394 - RNA, 21 nt, Artificial Sequence
  RNA Oligomer
ucaagaagaaagaaugcgugu

SEQ ID NO: 23395 - RNA, 21 nt, Artificial Sequence
  RNA Oligomer
ccaacaagccugaguuuguga

SEQ ID NO: 23396 - RNA, 21 nt, Artificial Sequence
  RNA Oligomer
gcucccugucuucauuuuccu

SEQ ID NO: 23397 - RNA, 21 nt, Artificial Sequence
  RNA Oligomer
cauaaagaagaugcuggaagu

SEQ ID NO: 23398 - RNA, 21 nt, Artificial Sequence
  RNA Oligomer
ccugcuauccugggagaucua

SEQ ID NO: 23399 - RNA, 21 nt, Artificial Sequence
  RNA Oligomer
gcagcucuucaucaagagggu

SEQ ID NO: 23400 - RNA, 21 nt, Artificial Sequence
  RNA Oligomer
gacgucuucuucuuccucuuc

SEQ ID NO: 23401 - RNA, 21 nt, Artificial Sequence
  RNA Oligomer
gccugaguuugugaagcucuu

SEQ ID NO: 23402 - RNA, 21 nt, Artificial Sequence
  RNA Oligomer
gauugucgaguggaccaaaaa

SEQ ID NO: 23403 - RNA, 21 nt, Artificial Sequence
  RNA Oligomer
ccagaaggugaaaaaguacgu

SEQ ID NO: 23404 - RNA, 21 nt, Artificial Sequence
  RNA Oligomer
cugccugaaguucuccucgau

SEQ ID NO: 23405 - RNA, 21 nt, Artificial Sequence
  RNA Oligomer
ggccuucugguuuggugucaa

SEQ ID NO: 23406 - RNA, 21 nt, Artificial Sequence
  RNA Oligomer
acacagugggacccaaagaaa

SEQ ID NO: 23407 - RNA, 21 nt, Artificial Sequence
  RNA Oligomer
guccacuuccaggaccagaau

SEQ ID NO: 23408 - RNA, 21 nt, Artificial Sequence
  RNA Oligomer
cagcaacagcagccucuucaa

SEQ ID NO: 23409 - RNA, 21 nt, Artificial Sequence
  RNA Oligomer
acggaguuccugaucuaugac

SEQ ID NO: 23410 - RNA, 21 nt, Artificial Sequence
  RNA Oligomer
cuaccuccagaaccgacaguu

SEQ ID NO: 23411 - RNA, 21 nt, Artificial Sequence
  RNA Oligomer
aggcacaagcagcucaagaac

SEQ ID NO: 23412 - RNA, 21 nt, Artificial Sequence
  RNA Oligomer
cucaucgccauguucaacuac

SEQ ID NO: 23413 - RNA, 21 nt, Artificial Sequence
  RNA Oligomer
accaacauccugcugcucaac

SEQ ID NO: 23414 - RNA, 21 nt, Artificial Sequence
  RNA Oligomer
cgucauccucucucuggacuu

SEQ ID NO: 23415 - RNA, 21 nt, Artificial Sequence
  RNA Oligomer
ugagaccuucacggaaagcag

SEQ ID NO: 23416 - RNA, 21 nt, Artificial Sequence
  RNA Oligomer
gccugucucggacaucacuau

SEQ ID NO: 23417 - RNA, 21 nt, Artificial Sequence
  RNA Oligomer
ggagguguacaaaggcuacau

SEQ ID NO: 23418 - RNA, 21 nt, Artificial Sequence
  RNA Oligomer
gccgucuuuugaaaacuugcu

SEQ ID NO: 23419 - RNA, 21 nt, Artificial Sequence
  RNA Oligomer
caucugcaggaagagcauaaa

SEQ ID NO: 23420 - RNA, 21 nt, Artificial Sequence
  RNA Oligomer
ccugaucuaugacccacccuu

SEQ ID NO: 23421 - RNA, 21 nt, Artificial Sequence
  RNA Oligomer
cagaaccgacaguuccagcaa

SEQ ID NO: 23422 - RNA, 21 nt, Artificial Sequence
  RNA Oligomer
gagaucuaccugaaggagaac

SEQ ID NO: 23423 - RNA, 21 nt, Artificial Sequence
  RNA Oligomer
ggagaucuaccugaaggagaa

SEQ ID NO: 23424 - RNA, 21 nt, Artificial Sequence
  RNA Oligomer
ggacaugaaguuugugucuca

SEQ ID NO: 23425 - RNA, 21 nt, Artificial Sequence
  RNA Oligomer
cugaaggaacuguccaaggag

SEQ ID NO: 23426 - RNA, 21 nt, Artificial Sequence
  RNA Oligomer
agcugcacucaucuccaacaa

SEQ ID NO: 23427 - RNA, 21 nt, Artificial Sequence
  RNA Oligomer
cgaugacagcugcacucaucu

SEQ ID NO: 23428 - RNA, 21 nt, Artificial Sequence
  RNA Oligomer
aggauugucgaguggaccaaa

SEQ ID NO: 23429 - RNA, 21 nt, Artificial Sequence
  RNA Oligomer
cggacaucacuaucucccuga

SEQ ID NO: 23430 - RNA, 21 nt, Artificial Sequence
  RNA Oligomer
cgccgaguacauacuggauga

SEQ ID NO: 23431 - RNA, 21 nt, Artificial Sequence
  RNA Oligomer
gggccaagaacuucaacauga

SEQ ID NO: 23432 - RNA, 21 nt, Artificial Sequence
  RNA Oligomer
acgugguaaaacccaagacau

SEQ ID NO: 23433 - RNA, 21 nt, Artificial Sequence
  RNA Oligomer
ggaacgugguaaaacccaaga

SEQ ID NO: 23434 - RNA, 21 nt, Artificial Sequence
  RNA Oligomer
gggaacgugguaaaacccaag

SEQ ID NO: 23435 - RNA, 21 nt, Artificial Sequence
  RNA Oligomer
gaacacggacaaugccuggau

SEQ ID NO: 23436 - RNA, 21 nt, Artificial Sequence
  RNA Oligomer
uggccgucuuuugaaaacuug

SEQ ID NO: 23437 - RNA, 21 nt, Artificial Sequence
  RNA Oligomer
gccaucugcaggaagagcaua

SEQ ID NO: 23438 - RNA, 21 nt, Artificial Sequence
  RNA Oligomer
uccugaucuaugacccacccu

SEQ ID NO: 23439 - RNA, 21 nt, Artificial Sequence
  RNA Oligomer
gcaauaagguugacgccaugg

SEQ ID NO: 23440 - RNA, 21 nt, Artificial Sequence
  RNA Oligomer
auccugggagaucuaccugaa

SEQ ID NO: 23441 - RNA, 21 nt, Artificial Sequence
  RNA Oligomer
ccagauuuggaaguuccagcg

SEQ ID NO: 23442 - RNA, 21 nt, Artificial Sequence
  RNA Oligomer
ggaccagauuuggaaguucca

SEQ ID NO: 23443 - RNA, 21 nt, Artificial Sequence
  RNA Oligomer
ccugcucuucaccaacauccu

SEQ ID NO: 23444 - RNA, 21 nt, Artificial Sequence
  RNA Oligomer
ugcacauuuuuaccaucagua

SEQ ID NO: 23445 - RNA, 21 nt, Artificial Sequence
  RNA Oligomer
uccggcucaugcacauuuuua

SEQ ID NO: 23446 - RNA, 21 nt, Artificial Sequence
  RNA Oligomer
cucucuggacuucauccuguu

SEQ ID NO: 23447 - RNA, 21 nt, Artificial Sequence
  RNA Oligomer
cuucagugacuucuggaauaa

SEQ ID NO: 23448 - RNA, 21 nt, Artificial Sequence
  RNA Oligomer
gcugaugaagaaggcagccuu

SEQ ID NO: 23449 - RNA, 21 nt, Artificial Sequence
  RNA Oligomer
accuucacggaaagcaggauu

SEQ ID NO: 23450 - RNA, 21 nt, Artificial Sequence
  RNA Oligomer
cucggacaucacuaucucccu

SEQ ID NO: 23451 - RNA, 21 nt, Artificial Sequence
  RNA Oligomer
cacguugcacaccaucgacaa

SEQ ID NO: 23452 - RNA, 21 nt, Artificial Sequence
  RNA Oligomer
cuagacagcaaccacucucac

SEQ ID NO: 23453 - RNA, 21 nt, Artificial Sequence
  RNA Oligomer
cgugguaaaacccaagacauu

SEQ ID NO: 23454 - RNA, 21 nt, Artificial Sequence
  RNA Oligomer
ucauccaccauggaggucauu

SEQ ID NO: 23455 - RNA, 21 nt, Artificial Sequence
  RNA Oligomer
ccagaaugacguggagcugaa

SEQ ID NO: 23456 - RNA, 21 nt, Artificial Sequence
  RNA Oligomer
ccacuuccaggaccagaauga

SEQ ID NO: 23457 - RNA, 21 nt, Artificial Sequence
  RNA Oligomer
cugcaggaagagcauaaagaa

SEQ ID NO: 23458 - RNA, 21 nt, Artificial Sequence
  RNA Oligomer
gaguuccugaucuaugaccca

SEQ ID NO: 23459 - RNA, 21 nt, Artificial Sequence
  RNA Oligomer
agaaccgacaguuccagcaaa

SEQ ID NO: 23460 - RNA, 21 nt, Artificial Sequence
  RNA Oligomer
ggaaaguuccaaacugucuga

SEQ ID NO: 23461 - RNA, 21 nt, Artificial Sequence
  RNA Oligomer
cuaccugcucuucaccaacau

SEQ ID NO: 23462 - RNA, 21 nt, Artificial Sequence
  RNA Oligomer
gucuucuucuuccucuuccug

SEQ ID NO: 23463 - RNA, 21 nt, Artificial Sequence
  RNA Oligomer
ggcagccuuguacuucaguga

SEQ ID NO: 23464 - RNA, 21 nt, Artificial Sequence
  RNA Oligomer
gaagaaggcagccuuguacuu

SEQ ID NO: 23465 - RNA, 21 nt, Artificial Sequence
  RNA Oligomer
ggugcagcugaaggaguuugu

SEQ ID NO: 23466 - RNA, 21 nt, Artificial Sequence
  RNA Oligomer
caguucguggauuccugaaaa

SEQ ID NO: 23467 - RNA, 21 nt, Artificial Sequence
  RNA Oligomer
cgaguggaccaaaaagaucca

SEQ ID NO: 23468 - RNA, 21 nt, Artificial Sequence
  RNA Oligomer
cagcaaccacucucacuucau

SEQ ID NO: 23469 - RNA, 21 nt, Artificial Sequence
  RNA Oligomer
aucagcucccugucuucauuu

SEQ ID NO: 23470 - RNA, 21 nt, Artificial Sequence
  RNA Oligomer
ugccugaaguucuccucgauc

SEQ ID NO: 23471 - RNA, 21 nt, Artificial Sequence
  RNA Oligomer
gagguguacaaaggcuacaug

SEQ ID NO: 23472 - RNA, 21 nt, Artificial Sequence
  RNA Oligomer
gagacggaguuccugaucuau

SEQ ID NO: 23473 - RNA, 21 nt, Artificial Sequence
  RNA Oligomer
gcagcucaagaacaagcugga

SEQ ID NO: 23474 - RNA, 21 nt, Artificial Sequence
  RNA Oligomer
cacggaccagauuuggaaguu

SEQ ID NO: 23475 - RNA, 21 nt, Artificial Sequence
  RNA Oligomer
caccaacauccugcugcucaa

SEQ ID NO: 23476 - RNA, 21 nt, Artificial Sequence
  RNA Oligomer
ggcucaugcacauuuuuacca

SEQ ID NO: 23477 - RNA, 21 nt, Artificial Sequence
  RNA Oligomer
gcagccuuguacuucagugac

SEQ ID NO: 23478 - RNA, 21 nt, Artificial Sequence
  RNA Oligomer
ugaagaaggcagccuuguacu

SEQ ID NO: 23479 - RNA, 21 nt, Artificial Sequence
  RNA Oligomer
cauuugggccauuguccagaa

SEQ ID NO: 23480 - RNA, 21 nt, Artificial Sequence
  RNA Oligomer
guuugucaccugggacaccuu

SEQ ID NO: 23481 - RNA, 21 nt, Artificial Sequence
  RNA Oligomer
caacaagccugaguuugugaa

SEQ ID NO: 23482 - RNA, 21 nt, Artificial Sequence
  RNA Oligomer
caucuccaacaagccugaguu

SEQ ID NO: 23483 - RNA, 21 nt, Artificial Sequence
  RNA Oligomer
acagcugcacucaucuccaac

SEQ ID NO: 23484 - RNA, 21 nt, Artificial Sequence
  RNA Oligomer
ucacggagccaagaccacuuu

SEQ ID NO: 23485 - RNA, 21 nt, Artificial Sequence
  RNA Oligomer
ccagcagaaacugagcguguu

SEQ ID NO: 23486 - RNA, 21 nt, Artificial Sequence
  RNA Oligomer
gacaucacuaucucccugauc

SEQ ID NO: 23487 - RNA, 21 nt, Artificial Sequence
  RNA Oligomer
ugaagagcauuuuccgcagag

SEQ ID NO: 23488 - RNA, 21 nt, Artificial Sequence
  RNA Oligomer
gcgugaucuaccaccucauga

SEQ ID NO: 23489 - RNA, 21 nt, Artificial Sequence
  RNA Oligomer
ucauuuuccuaaaccugggcu

SEQ ID NO: 23490 - RNA, 21 nt, Artificial Sequence
  RNA Oligomer
cuucugugcuuuccacaaaua

SEQ ID NO: 23491 - RNA, 21 nt, Artificial Sequence
  RNA Oligomer
gaacgugguaaaacccaagac

SEQ ID NO: 23492 - RNA, 21 nt, Artificial Sequence
  RNA Oligomer
ccauguuucgaggugccucaa

SEQ ID NO: 23493 - RNA, 21 nt, Artificial Sequence
  RNA Oligomer
cgucuuuugaaaacuugcuga

SEQ ID NO: 23494 - RNA, 21 nt, Artificial Sequence
  RNA Oligomer
agaugcuaccucggaagcuga

SEQ ID NO: 23495 - RNA, 21 nt, Artificial Sequence
  RNA Oligomer
cacgauccaguacaacguggu

SEQ ID NO: 23496 - RNA, 21 nt, Artificial Sequence
  RNA Oligomer
acuguccacgauccaguacaa

SEQ ID NO: 23497 - RNA, 21 nt, Artificial Sequence
  RNA Oligomer
ugaucuaugacccacccuuuu

SEQ ID NO: 23498 - RNA, 21 nt, Artificial Sequence
  RNA Oligomer
gaggcacaagcagcucaagaa

SEQ ID NO: 23499 - RNA, 21 nt, Artificial Sequence
  RNA Oligomer
cggaugaugaaggacgucuuc

SEQ ID NO: 23500 - RNA, 21 nt, Artificial Sequence
  RNA Oligomer
ucauccucucucuggacuuca

SEQ ID NO: 23501 - RNA, 21 nt, Artificial Sequence
  RNA Oligomer
ugacuucuggaauaagcugga

SEQ ID NO: 23502 - RNA, 21 nt, Artificial Sequence
  RNA Oligomer
ggauuccugaaaacaucaaga

SEQ ID NO: 23503 - RNA, 21 nt, Artificial Sequence
  RNA Oligomer
gcucuaccuguacgagaaccu

SEQ ID NO: 23504 - RNA, 21 nt, Artificial Sequence
  RNA Oligomer
cguggauuccugaaaacauca

SEQ ID NO: 23505 - RNA, 21 nt, Artificial Sequence
  RNA Oligomer
gcugaaggaguuugucaccug

SEQ ID NO: 23506 - RNA, 21 nt, Artificial Sequence
  RNA Oligomer
aucuccaacaagccugaguuu

SEQ ID NO: 23507 - RNA, 21 nt, Artificial Sequence
  RNA Oligomer
ugacagcugcacucaucucca

SEQ ID NO: 23508 - RNA, 21 nt, Artificial Sequence
  RNA Oligomer
uggaccaaaaagauccaagau

SEQ ID NO: 23509 - RNA, 21 nt, Artificial Sequence
  RNA Oligomer
caggauugucgaguggaccaa

SEQ ID NO: 23510 - RNA, 21 nt, Artificial Sequence
  RNA Oligomer
cagcgugaucuaccaccucau

SEQ ID NO: 23511 - RNA, 21 nt, Artificial Sequence
  RNA Oligomer
ccacaaauaaaguuccugaca

SEQ ID NO: 23512 - RNA, 21 nt, Artificial Sequence
  RNA Oligomer
caggccuaugucugugaggaa

SEQ ID NO: 23513 - RNA, 21 nt, Artificial Sequence
  RNA Oligomer
cccuucggcaacaaugacaag

SEQ ID NO: 23514 - RNA, 21 nt, Artificial Sequence
  RNA Oligomer
cacacagugggacccaaagaa

SEQ ID NO: 23515 - RNA, 21 nt, Artificial Sequence
  RNA Oligomer
agccaucugcaggaagagcau

SEQ ID NO: 23516 - RNA, 21 nt, Artificial Sequence
  RNA Oligomer
ccaaacugucugaugcuggga

SEQ ID NO: 23517 - RNA, 21 nt, Artificial Sequence
  RNA Oligomer
ggaguuccugaucuaugaccc

SEQ ID NO: 23518 - RNA, 21 nt, Artificial Sequence
  RNA Oligomer
agcaauaagguugacgccaug

SEQ ID NO: 23519 - RNA, 21 nt, Artificial Sequence
  RNA Oligomer
ccgacaguuccagcaaaagca

SEQ ID NO: 23520 - RNA, 21 nt, Artificial Sequence
  RNA Oligomer
ccugaaggagaacuaccucca

SEQ ID NO: 23521 - RNA, 21 nt, Artificial Sequence
  RNA Oligomer
ggcacaagcagcucaagaaca

SEQ ID NO: 23522 - RNA, 21 nt, Artificial Sequence
  RNA Oligomer
ccugcagcucuucaucaagag

SEQ ID NO: 23523 - RNA, 21 nt, Artificial Sequence
  RNA Oligomer
gcaaucuugcucuucguggca

SEQ ID NO: 23524 - RNA, 21 nt, Artificial Sequence
  RNA Oligomer
gguggucuuccaccugaacau

SEQ ID NO: 23525 - RNA, 21 nt, Artificial Sequence
  RNA Oligomer
ccaugugaccuucaccaugga

SEQ ID NO: 23526 - RNA, 21 nt, Artificial Sequence
  RNA Oligomer
ucaguucguggauuccugaaa

SEQ ID NO: 23527 - RNA, 21 nt, Artificial Sequence
  RNA Oligomer
gaguggaccaaaaagauccaa

SEQ ID NO: 23528 - RNA, 21 nt, Artificial Sequence
  RNA Oligomer
ccuucacggaaagcaggauug

SEQ ID NO: 23529 - RNA, 21 nt, Artificial Sequence
  RNA Oligomer
cagcagaaacugagcguguuc

SEQ ID NO: 23530 - RNA, 21 nt, Artificial Sequence
  RNA Oligomer
ccuagacagcaaccacucuca

SEQ ID NO: 23531 - RNA, 21 nt, Artificial Sequence
  RNA Oligomer
ggccaagaacuucaacaugaa

SEQ ID NO: 23532 - RNA, 21 nt, Artificial Sequence
  RNA Oligomer
ccaaagaaacauguccaggag

SEQ ID NO: 23533 - RNA, 21 nt, Artificial Sequence
  RNA Oligomer
gacugucaggauaaacuccgu

SEQ ID NO: 23534 - RNA, 21 nt, Artificial Sequence
  RNA Oligomer
aacuccugacugucaggauaa

SEQ ID NO: 23535 - RNA, 21 nt, Artificial Sequence
  RNA Oligomer
cucauccaccauggaggucau

SEQ ID NO: 23536 - RNA, 21 nt, Artificial Sequence
  RNA Oligomer
caggcugaacucuaaccugca

SEQ ID NO: 23537 - RNA, 21 nt, Artificial Sequence
  RNA Oligomer
ucaguguggcuacacgcauga

SEQ ID NO: 23538 - RNA, 21 nt, Artificial Sequence
  RNA Oligomer
ggccgucuuuugaaaacuugc

SEQ ID NO: 23539 - RNA, 21 nt, Artificial Sequence
  RNA Oligomer
cagcaauaagguugacgccau

SEQ ID NO: 23540 - RNA, 21 nt, Artificial Sequence
  RNA Oligomer
caacuacaccuuccagcaggu

SEQ ID NO: 23541 - RNA, 21 nt, Artificial Sequence
  RNA Oligomer
acucugccucuaccugcucuu

SEQ ID NO: 23542 - RNA, 21 nt, Artificial Sequence
  RNA Oligomer
gcucaugcacauuuuuaccau

SEQ ID NO: 23543 - RNA, 21 nt, Artificial Sequence
  RNA Oligomer
cggcucaugcacauuuuuacc

SEQ ID NO: 23544 - RNA, 21 nt, Artificial Sequence
  RNA Oligomer
ccggcucaugcacauuuuuac

SEQ ID NO: 23545 - RNA, 21 nt, Artificial Sequence
  RNA Oligomer
agccuuguacuucagugacuu

SEQ ID NO: 23546 - RNA, 21 nt, Artificial Sequence
  RNA Oligomer
guggucuuccaccugaacauc

SEQ ID NO: 23547 - RNA, 21 nt, Artificial Sequence
  RNA Oligomer
caaggacaugaaguuuguguc

SEQ ID NO: 23548 - RNA, 21 nt, Artificial Sequence
  RNA Oligomer
gaccuucucauuugggccauu

SEQ ID NO: 23549 - RNA, 21 nt, Artificial Sequence
  RNA Oligomer
gacuucacgcagccgcuuuau

SEQ ID NO: 23550 - RNA, 21 nt, Artificial Sequence
  RNA Oligomer
guggauuccugaaaacaucaa

SEQ ID NO: 23551 - RNA, 21 nt, Artificial Sequence
  RNA Oligomer
caagccugaguuugugaagcu

SEQ ID NO: 23552 - RNA, 21 nt, Artificial Sequence
  RNA Oligomer
cacgaugacagcugcacucau

SEQ ID NO: 23553 - RNA, 21 nt, Artificial Sequence
  RNA Oligomer
ugucgaguggaccaaaaagau

SEQ ID NO: 23554 - RNA, 21 nt, Artificial Sequence
  RNA Oligomer
caggagauguuugagaccuuc

SEQ ID NO: 23555 - RNA, 21 nt, Artificial Sequence
  RNA Oligomer
ucccugauccagcagaaacug

SEQ ID NO: 23556 - RNA, 21 nt, Artificial Sequence
  RNA Oligomer
ccugucucggacaucacuauc

SEQ ID NO: 23557 - RNA, 21 nt, Artificial Sequence
  RNA Oligomer
agacagcaaccacucucacuu

SEQ ID NO: 23558 - RNA, 21 nt, Artificial Sequence
  RNA Oligomer
gccgaguacauacuggaugag

SEQ ID NO: 23559 - RNA, 21 nt, Artificial Sequence
  RNA Oligomer
ucagcucccugucuucauuuu

SEQ ID NO: 23560 - RNA, 21 nt, Artificial Sequence
  RNA Oligomer
acauuaaaucugccaucucag

SEQ ID NO: 23561 - RNA, 21 nt, Artificial Sequence
  RNA Oligomer
gccuucugguuuggugucaac

SEQ ID NO: 23562 - RNA, 21 nt, Artificial Sequence
  RNA Oligomer
cccacucuaugcgaaccacaa

SEQ ID NO: 23563 - RNA, 21 nt, Artificial Sequence
  RNA Oligomer
gaacaggcugaacucuaaccu

SEQ ID NO: 23564 - RNA, 21 nt, Artificial Sequence
  RNA Oligomer
gaagagcauaaagaagaugcu

SEQ ID NO: 23565 - RNA, 21 nt, Artificial Sequence
  RNA Oligomer
caccugcagcucuucaucaag

SEQ ID NO: 23566 - RNA, 21 nt, Artificial Sequence
  RNA Oligomer
cggaccagauuuggaaguucc

SEQ ID NO: 23567 - RNA, 21 nt, Artificial Sequence
  RNA Oligomer
cauguucaacuacaccuucca

SEQ ID NO: 23568 - RNA, 21 nt, Artificial Sequence
  RNA Oligomer
caucauugugaagcggaugau

SEQ ID NO: 23569 - RNA, 21 nt, Artificial Sequence
  RNA Oligomer
uacuucagugacuucuggaau

SEQ ID NO: 23570 - RNA, 21 nt, Artificial Sequence
  RNA Oligomer
guacuucagugacuucuggaa

SEQ ID NO: 23571 - RNA, 21 nt, Artificial Sequence
  RNA Oligomer
ugccaucuaccucuggcucuu

SEQ ID NO: 23572 - RNA, 21 nt, Artificial Sequence
  RNA Oligomer
ggaguaugagcacagagccau

SEQ ID NO: 23573 - RNA, 21 nt, Artificial Sequence
  RNA Oligomer
uggauuccugaaaacaucaag

SEQ ID NO: 23574 - RNA, 21 nt, Artificial Sequence
  RNA Oligomer
ccucaguucguggauuccuga

SEQ ID NO: 23575 - RNA, 21 nt, Artificial Sequence
  RNA Oligomer
agaccacuuuggccacgagaa

SEQ ID NO: 23576 - RNA, 21 nt, Artificial Sequence
  RNA Oligomer
guggaccaaaaagauccaaga

SEQ ID NO: 23577 - RNA, 21 nt, Artificial Sequence
  RNA Oligomer
cccugauccagcagaaacuga

SEQ ID NO: 23578 - RNA, 21 nt, Artificial Sequence
  RNA Oligomer
aggagguguggccaucaagau

SEQ ID NO: 23579 - RNA, 21 nt, Artificial Sequence
  RNA Oligomer
cccaaucucuugaucucggug

SEQ ID NO: 23580 - RNA, 21 nt, Artificial Sequence
  RNA Oligomer
agccagaaggugaaaaaguac

SEQ ID NO: 23581 - RNA, 21 nt, Artificial Sequence
  RNA Oligomer
uucggcaacaaugacaagcaa

SEQ ID NO: 23582 - RNA, 21 nt, Artificial Sequence
  RNA Oligomer
gccugagccagaaggugaaaa

SEQ ID NO: 23583 - RNA, 21 nt, Artificial Sequence
  RNA Oligomer
cagcucccugucuucauuuuc

SEQ ID NO: 23584 - RNA, 21 nt, Artificial Sequence
  RNA Oligomer
ccacucuaugcgaaccacaag

SEQ ID NO: 23585 - RNA, 21 nt, Artificial Sequence
  RNA Oligomer
guguacaaaggcuacauggau

SEQ ID NO: 23586 - RNA, 21 nt, Artificial Sequence
  RNA Oligomer
gacaucagcaauaagguugac

SEQ ID NO: 23587 - RNA, 21 nt, Artificial Sequence
  RNA Oligomer
cgagcagaagaucgaggacau

SEQ ID NO: 23588 - RNA, 21 nt, Artificial Sequence
  RNA Oligomer
gaaggacgucuucuucuuccu

SEQ ID NO: 23589 - RNA, 21 nt, Artificial Sequence
  RNA Oligomer
ucaugcacauuuuuaccauca

SEQ ID NO: 23590 - RNA, 21 nt, Artificial Sequence
  RNA Oligomer
cagugacuucuggaauaagcu

SEQ ID NO: 23591 - RNA, 21 nt, Artificial Sequence
  RNA Oligomer
ccaucuaccucuggcucuucu

SEQ ID NO: 23592 - RNA, 21 nt, Artificial Sequence
  RNA Oligomer
gacaugaaguuugugucucac

SEQ ID NO: 23593 - RNA, 21 nt, Artificial Sequence
  RNA Oligomer
cugcagcaagauccugaagga

SEQ ID NO: 23594 - RNA, 21 nt, Artificial Sequence
  RNA Oligomer
gauuccugaaaacaucaagaa

SEQ ID NO: 23595 - RNA, 21 nt, Artificial Sequence
  RNA Oligomer
accuucucauuugggccauug

SEQ ID NO: 23596 - RNA, 21 nt, Artificial Sequence
  RNA Oligomer
ugaccuucucauuugggccau

SEQ ID NO: 23597 - RNA, 21 nt, Artificial Sequence
  RNA Oligomer
agccugaguuugugaagcucu

SEQ ID NO: 23598 - RNA, 21 nt, Artificial Sequence
  RNA Oligomer
uggcaguggaagccuucagau

SEQ ID NO: 23599 - RNA, 21 nt, Artificial Sequence
  RNA Oligomer
gacagcaaccacucucacuuc

SEQ ID NO: 23600 - RNA, 21 nt, Artificial Sequence
  RNA Oligomer
agcgugaucuaccaccucaug

SEQ ID NO: 23601 - RNA, 21 nt, Artificial Sequence
  RNA Oligomer
gagccagaaggugaaaaagua

SEQ ID NO: 23602 - RNA, 21 nt, Artificial Sequence
  RNA Oligomer
ggcucuucugugcuuuccaca

SEQ ID NO: 23603 - RNA, 21 nt, Artificial Sequence
  RNA Oligomer
cuacacgcaugagcagcacuu

SEQ ID NO: 23604 - RNA, 21 nt, Artificial Sequence
  RNA Oligomer
ggaagagcauaaagaagaugc

SEQ ID NO: 23605 - RNA, 21 nt, Artificial Sequence
  RNA Oligomer
ggaugaugaaggacgucuucu

SEQ ID NO: 23606 - RNA, 21 nt, Artificial Sequence
  RNA Oligomer
gaaggcagccuuguacuucag

SEQ ID NO: 23607 - RNA, 21 nt, Artificial Sequence
  RNA Oligomer
aggccaugugaccuucaccau

SEQ ID NO: 23608 - RNA, 21 nt, Artificial Sequence
  RNA Oligomer
ugugaagcucuuccuggagaa

SEQ ID NO: 23609 - RNA, 21 nt, Artificial Sequence
  RNA Oligomer
ccugaguuugugaagcucuuc

SEQ ID NO: 23610 - RNA, 21 nt, Artificial Sequence
  RNA Oligomer
ugccugucucggacaucacua

SEQ ID NO: 23611 - RNA, 21 nt, Artificial Sequence
  RNA Oligomer
cugaagagcauuuuccgcaga

SEQ ID NO: 23612 - RNA, 21 nt, Artificial Sequence
  RNA Oligomer
gcugaagagcauuuuccgcag

SEQ ID NO: 23613 - RNA, 21 nt, Artificial Sequence
  RNA Oligomer
ccaaucucuugaucucgguga

SEQ ID NO: 23614 - RNA, 21 nt, Artificial Sequence
  RNA Oligomer
aaccgaugccuuuggcgacau

SEQ ID NO: 23615 - RNA, 21 nt, Artificial Sequence
  RNA Oligomer
ucuucugugcuuuccacaaau

SEQ ID NO: 23616 - RNA, 21 nt, Artificial Sequence
  RNA Oligomer
ggacccaaagaaacaugucca

SEQ ID NO: 23617 - RNA, 21 nt, Artificial Sequence
  RNA Oligomer
ccugacugucaggauaaacuc

SEQ ID NO: 23618 - RNA, 21 nt, Artificial Sequence
  RNA Oligomer
cuccugacugucaggauaaac

SEQ ID NO: 23619 - RNA, 21 nt, Artificial Sequence
  RNA Oligomer
ucccacucuaugcgaaccaca

SEQ ID NO: 23620 - RNA, 21 nt, Artificial Sequence
  RNA Oligomer
gcucuucaucaagaggguggu

SEQ ID NO: 23621 - RNA, 21 nt, Artificial Sequence
  RNA Oligomer
guauuuuguggaaaguuccaa

SEQ ID NO: 23622 - RNA, 21 nt, Artificial Sequence
  RNA Oligomer
cucaugcacauuuuuaccauc

SEQ ID NO: 23623 - RNA, 21 nt, Artificial Sequence
  RNA Oligomer
ucccucuacaagcguuccuca

SEQ ID NO: 23624 - RNA, 21 nt, Artificial Sequence
  RNA Oligomer
gaccaaaaagauccaagauau

SEQ ID NO: 23625 - RNA, 21 nt, Artificial Sequence
  RNA Oligomer
gaccaggcuggagaaguucau

SEQ ID NO: 23626 - RNA, 21 nt, Artificial Sequence
  RNA Oligomer
gccaagaacuucaacaugaag

SEQ ID NO: 23627 - RNA, 21 nt, Artificial Sequence
  RNA Oligomer
ugccuuuggcgacaucgucuu

SEQ ID NO: 23628 - RNA, 21 nt, Artificial Sequence
  RNA Oligomer
uucugugcuuuccacaaauaa

SEQ ID NO: 23629 - RNA, 21 nt, Artificial Sequence
  RNA Oligomer
cucuucugugcuuuccacaaa

SEQ ID NO: 23630 - RNA, 21 nt, Artificial Sequence
  RNA Oligomer
gguaaaacccaagacauuaaa

SEQ ID NO: 23631 - RNA, 21 nt, Artificial Sequence
  RNA Oligomer
agcugaacaggcugaacucua

SEQ ID NO: 23632 - RNA, 21 nt, Artificial Sequence
  RNA Oligomer
gcucaagaacaagcuggagaa

SEQ ID NO: 23633 - RNA, 21 nt, Artificial Sequence
  RNA Oligomer
augcacauuuuuaccaucagu

SEQ ID NO: 23634 - RNA, 21 nt, Artificial Sequence
  RNA Oligomer
caugcacauuuuuaccaucag

SEQ ID NO: 23635 - RNA, 21 nt, Artificial Sequence
  RNA Oligomer
cucuucuaugacccugacgag

SEQ ID NO: 23636 - RNA, 21 nt, Artificial Sequence
  RNA Oligomer
gaguaugagcacagagccauc

SEQ ID NO: 23637 - RNA, 21 nt, Artificial Sequence
  RNA Oligomer
gcacucaucuccaacaagccu

SEQ ID NO: 23638 - RNA, 21 nt, Artificial Sequence
  RNA Oligomer
ccgaguacauacuggaugagg

SEQ ID NO: 23639 - RNA, 21 nt, Artificial Sequence
  RNA Oligomer
gugcuuuccacaaauaaaguu

SEQ ID NO: 23640 - RNA, 21 nt, Artificial Sequence
  RNA Oligomer
gcucuucugugcuuuccacaa

SEQ ID NO: 23641 - RNA, 21 nt, Artificial Sequence
  RNA Oligomer
cccaaagaaacauguccagga

SEQ ID NO: 23642 - RNA, 21 nt, Artificial Sequence
  RNA Oligomer
acccuuuuacacggcagagag

SEQ ID NO: 23643 - RNA, 21 nt, Artificial Sequence
  RNA Oligomer
cugggagaucuaccugaagga

SEQ ID NO: 23644 - RNA, 21 nt, Artificial Sequence
  RNA Oligomer
uccugggagaucuaccugaag

SEQ ID NO: 23645 - RNA, 21 nt, Artificial Sequence
  RNA Oligomer
guguauuuuguggaaaguucc

SEQ ID NO: 23646 - RNA, 21 nt, Artificial Sequence
  RNA Oligomer
ggacuucauccuguucugccu

SEQ ID NO: 23647 - RNA, 21 nt, Artificial Sequence
  RNA Oligomer
caagauccugaaggaacuguc

SEQ ID NO: 23648 - RNA, 21 nt, Artificial Sequence
  RNA Oligomer
gcagcaagauccugaaggaac

SEQ ID NO: 23649 - RNA, 21 nt, Artificial Sequence
  RNA Oligomer
gaguuugugaagcucuuccug

SEQ ID NO: 23650 - RNA, 21 nt, Artificial Sequence
  RNA Oligomer
ggaccaaaaagauccaagaua

SEQ ID NO: 23651 - RNA, 21 nt, Artificial Sequence
  RNA Oligomer
accaggcuggagaaguucaua

SEQ ID NO: 23652 - RNA, 21 nt, Artificial Sequence
  RNA Oligomer
cucucacuucauccucgugga

SEQ ID NO: 23653 - RNA, 21 nt, Artificial Sequence
  RNA Oligomer
cacucucacuucauccucgug

SEQ ID NO: 23654 - RNA, 21 nt, Artificial Sequence
  RNA Oligomer
uccacaaauaaaguuccugac

SEQ ID NO: 23655 - RNA, 21 nt, Artificial Sequence
  RNA Oligomer
gagaacuaccuccagaaccga

SEQ ID NO: 23656 - RNA, 21 nt, Artificial Sequence
  RNA Oligomer
cuacgugcucaugguggacuu

SEQ ID NO: 23657 - RNA, 21 nt, Artificial Sequence
  RNA Oligomer
ccugaaaacaucaagaagaaa

SEQ ID NO: 23658 - RNA, 21 nt, Artificial Sequence
  RNA Oligomer
uccugaaaacaucaagaagaa

SEQ ID NO: 23659 - RNA, 21 nt, Artificial Sequence
  RNA Oligomer
gcaagauccugaaggaacugu

SEQ ID NO: 23660 - RNA, 21 nt, Artificial Sequence
  RNA Oligomer
ugaguuugugaagcucuuccu

SEQ ID NO: 23661 - RNA, 21 nt, Artificial Sequence
  RNA Oligomer
uggagauuccucugaggacca

SEQ ID NO: 23662 - RNA, 21 nt, Artificial Sequence
  RNA Oligomer
gacccaaagaaacauguccag

SEQ ID NO: 23663 - RNA, 21 nt, Artificial Sequence
  RNA Oligomer
caagcagcucaagaacaagcu

SEQ ID NO: 23664 - RNA, 21 nt, Artificial Sequence
  RNA Oligomer
cuaccucuggcucuucuccuu

SEQ ID NO: 23665 - RNA, 21 nt, Artificial Sequence
  RNA Oligomer
ccucaucuccuucagggagaa

SEQ ID NO: 23666 - RNA, 21 nt, Artificial Sequence
  RNA Oligomer
gaaggaacuguccaaggagga

SEQ ID NO: 23667 - RNA, 21 nt, Artificial Sequence
  RNA Oligomer
guuccacagcaagcugcagaa

SEQ ID NO: 23668 - RNA, 21 nt, Artificial Sequence
  RNA Oligomer
gcugcacucaucuccaacaag

SEQ ID NO: 23669 - RNA, 21 nt, Artificial Sequence
  RNA Oligomer
ugguaaaacccaagacauuaa

SEQ ID NO: 23670 - RNA, 21 nt, Artificial Sequence
  RNA Oligomer
ugggacccaaagaaacauguc

SEQ ID NO: 23671 - RNA, 21 nt, Artificial Sequence
  RNA Oligomer
agcauaaagaagaugcuggaa

SEQ ID NO: 23672 - RNA, 21 nt, Artificial Sequence
  RNA Oligomer
cucaucuccuucagggagaag

SEQ ID NO: 23673 - RNA, 21 nt, Artificial Sequence
  RNA Oligomer
acaagcaagaaagccucaguu

SEQ ID NO: 23674 - RNA, 21 nt, Artificial Sequence
  RNA Oligomer
cucaagaacaagcuggagaag

SEQ ID NO: 23675 - RNA, 21 nt, Artificial Sequence
  RNA Oligomer
cugaugaagaaggcagccuug

SEQ ID NO: 23676 - RNA, 21 nt, Artificial Sequence
  RNA Oligomer
ugcagcaagauccugaaggaa

SEQ ID NO: 23677 - RNA, 21 nt, Artificial Sequence
  RNA Oligomer
gugaagcucuuccuggagaac

SEQ ID NO: 23678 - RNA, 21 nt, Artificial Sequence
  RNA Oligomer
gugguaaaacccaagacauua

SEQ ID NO: 23679 - RNA, 21 nt, Artificial Sequence
  RNA Oligomer
gcauaaagaagaugcuggaag

SEQ ID NO: 23680 - RNA, 21 nt, Artificial Sequence
  RNA Oligomer
agcaagauccugaaggaacug

SEQ ID NO: 23681 - RNA, 21 nt, Artificial Sequence
  RNA Oligomer
gagcauaaagaagaugcugga

SEQ ID NO: 23682 - RNA, 21 nt, Artificial Sequence
  RNA Oligomer
gggagaucuaccugaaggaga

SEQ ID NO: 23683 - RNA, 21 nt, Artificial Sequence
  RNA Oligomer
aggaaucaucugggcucagag

SEQ ID NO: 23684 - RNA, 21 nt, Artificial Sequence
  RNA Oligomer
gacaagcaagaaagccucagu

SEQ ID NO: 23685 - RNA, 21 nt, Artificial Sequence
  RNA Oligomer
auacuggaugaggauggccaa

SEQ ID NO: 23686 - RNA, 21 nt, Artificial Sequence
  RNA Oligomer
caaucucuugaucucggugac

SEQ ID NO: 23687 - RNA, 21 nt, Artificial Sequence
  RNA Oligomer
agcacuggccgucuuuugaaa

SEQ ID NO: 23688 - RNA, 21 nt, Artificial Sequence
  RNA Oligomer
gagcacuggccgucuuuugaa

SEQ ID NO: 23689 - RNA, 21 nt, Artificial Sequence
  RNA Oligomer
caagcaagaaagccucaguuc

SEQ ID NO: 23690 - RNA, 21 nt, Artificial Sequence
  RNA Oligomer
uaggagaggauguucaggugg

SEQ ID NO: 23691 - RNA, 21 nt, Artificial Sequence
  RNA Oligomer
uuguucuugagcugcuugugc

SEQ ID NO: 23692 - RNA, 21 nt, Artificial Sequence
  RNA Oligomer
uucacaaugaugaucuugggc

SEQ ID NO: 23693 - RNA, 21 nt, Artificial Sequence
  RNA Oligomer
uucuugcuugucauuguugcc

SEQ ID NO: 23694 - RNA, 21 nt, Artificial Sequence
  RNA Oligomer
accuuauugcugauguccucg

SEQ ID NO: 23695 - RNA, 21 nt, Artificial Sequence
  RNA Oligomer
aagacguccuucaucauccgc

SEQ ID NO: 23696 - RNA, 21 nt, Artificial Sequence
  RNA Oligomer
aaguaggagaggauguucagg

SEQ ID NO: 23697 - RNA, 21 nt, Artificial Sequence
  RNA Oligomer
acaaacuucauguccuuggcc

SEQ ID NO: 23698 - RNA, 21 nt, Artificial Sequence
  RNA Oligomer
auccaugaagaucucacugcg

SEQ ID NO: 23699 - RNA, 21 nt, Artificial Sequence
  RNA Oligomer
uucagcaaguuuucaaaagac

SEQ ID NO: 23700 - RNA, 21 nt, Artificial Sequence
  RNA Oligomer
aacauggcgaugaggagguug

SEQ ID NO: 23701 - RNA, 21 nt, Artificial Sequence
  RNA Oligomer
cuucacaaugaugaucuuggg

SEQ ID NO: 23702 - RNA, 21 nt, Artificial Sequence
  RNA Oligomer
uccaugaagaucucacugcgg

SEQ ID NO: 23703 - RNA, 21 nt, Artificial Sequence
  RNA Oligomer
uugaugaagagcugcaggugg

SEQ ID NO: 23704 - RNA, 21 nt, Artificial Sequence
  RNA Oligomer
aacuuuccacaaaauacacgc

SEQ ID NO: 23705 - RNA, 21 nt, Artificial Sequence
  RNA Oligomer
aaauacacgcauucuuucuuc

SEQ ID NO: 23706 - RNA, 21 nt, Artificial Sequence
  RNA Oligomer
guaggagaggauguucaggug

SEQ ID NO: 23707 - RNA, 21 nt, Artificial Sequence
  RNA Oligomer
ucuugaagaggcugcuguugc

SEQ ID NO: 23708 - RNA, 21 nt, Artificial Sequence
  RNA Oligomer
uuucuugcuugucauuguugc

SEQ ID NO: 23709 - RNA, 21 nt, Artificial Sequence
  RNA Oligomer
aucuucuuuaugcucuuccug

SEQ ID NO: 23710 - RNA, 21 nt, Artificial Sequence
  RNA Oligomer
ucaaccuuauugcugaugucc

SEQ ID NO: 23711 - RNA, 21 nt, Artificial Sequence
  RNA Oligomer
uuauugcugauguccucgauc

SEQ ID NO: 23712 - RNA, 21 nt, Artificial Sequence
  RNA Oligomer
gaaguaggagaggauguucag

SEQ ID NO: 23713 - RNA, 21 nt, Artificial Sequence
  RNA Oligomer
cacaaacuucauguccuuggc

SEQ ID NO: 23714 - RNA, 21 nt, Artificial Sequence
  RNA Oligomer
aaugagaaggucacggauggg

SEQ ID NO: 23715 - RNA, 21 nt, Artificial Sequence
  RNA Oligomer
ucguacagguagagcaaggug

SEQ ID NO: 23716 - RNA, 21 nt, Artificial Sequence
  RNA Oligomer
auccucauccaguauguacuc

SEQ ID NO: 23717 - RNA, 21 nt, Artificial Sequence
  RNA Oligomer
acucggacguacuuuuucacc

SEQ ID NO: 23718 - RNA, 21 nt, Artificial Sequence
  RNA Oligomer
uugaacauggcgaugaggagg

SEQ ID NO: 23719 - RNA, 21 nt, Artificial Sequence
  RNA Oligomer
aauacacgcauucuuucuucu

SEQ ID NO: 23720 - RNA, 21 nt, Artificial Sequence
  RNA Oligomer
aacuucauguccuuggccucc

SEQ ID NO: 23721 - RNA, 21 nt, Artificial Sequence
  RNA Oligomer
ucauccaugaagaucucacug

SEQ ID NO: 23722 - RNA, 21 nt, Artificial Sequence
  RNA Oligomer
cacucgacaauccugcuuucc

SEQ ID NO: 23723 - RNA, 21 nt, Artificial Sequence
  RNA Oligomer
aucuccuggaagaacacgcuc

SEQ ID NO: 23724 - RNA, 21 nt, Artificial Sequence
  RNA Oligomer
uggaucagggagauagugaug

SEQ ID NO: 23725 - RNA, 21 nt, Artificial Sequence
  RNA Oligomer
acgaggaugaagugagagugg

SEQ ID NO: 23726 - RNA, 21 nt, Artificial Sequence
  RNA Oligomer
aucagacaguuuggaacuuuc

SEQ ID NO: 23727 - RNA, 21 nt, Artificial Sequence
  RNA Oligomer
aagauggugagguaggagugg

SEQ ID NO: 23728 - RNA, 21 nt, Artificial Sequence
  RNA Oligomer
acguccuucaucauccgcuuc

SEQ ID NO: 23729 - RNA, 21 nt, Artificial Sequence
  RNA Oligomer
uccgcuucacaaugaugaucu

SEQ ID NO: 23730 - RNA, 21 nt, Artificial Sequence
  RNA Oligomer
cgcuucacaaugaugaucuug

SEQ ID NO: 23731 - RNA, 21 nt, Artificial Sequence
  RNA Oligomer
cacaaugaugaucuugggccc

SEQ ID NO: 23732 - RNA, 21 nt, Artificial Sequence
  RNA Oligomer
cacucauccaugaagaucuca

SEQ ID NO: 23733 - RNA, 21 nt, Artificial Sequence
  RNA Oligomer
ugcuccgauaugaacuucucc

SEQ ID NO: 23734 - RNA, 21 nt, Artificial Sequence
  RNA Oligomer
ucuugcuugucauuguugccg

SEQ ID NO: 23735 - RNA, 21 nt, Artificial Sequence
  RNA Oligomer
cagguuuaggaaaaugaagac

SEQ ID NO: 23736 - RNA, 21 nt, Artificial Sequence
  RNA Oligomer
agguuuaggaaaaugaagaca

SEQ ID NO: 23737 - RNA, 21 nt, Artificial Sequence
  RNA Oligomer
ucauccauguagccuuuguac

SEQ ID NO: 23738 - RNA, 21 nt, Artificial Sequence
  RNA Oligomer
uauugcugauguccucgaucu

SEQ ID NO: 23739 - RNA, 21 nt, Artificial Sequence
  RNA Oligomer
uugcugauguccucgaucuuc

SEQ ID NO: 23740 - RNA, 21 nt, Artificial Sequence
  RNA Oligomer
agcaggauguuggugaagagc

SEQ ID NO: 23741 - RNA, 21 nt, Artificial Sequence
  RNA Oligomer
uuccacaaaauacacgcauuc

SEQ ID NO: 23742 - RNA, 21 nt, Artificial Sequence
  RNA Oligomer
gaagucacugaaguacaaggc

SEQ ID NO: 23743 - RNA, 21 nt, Artificial Sequence
  RNA Oligomer
gaggauguucagguggaagac

SEQ ID NO: 23744 - RNA, 21 nt, Artificial Sequence
  RNA Oligomer
acacaaacuucauguccuugg

SEQ ID NO: 23745 - RNA, 21 nt, Artificial Sequence
  RNA Oligomer
aaacuucauguccuuggccuc

SEQ ID NO: 23746 - RNA, 21 nt, Artificial Sequence
  RNA Oligomer
acaauggcccaaaugagaagg

SEQ ID NO: 23747 - RNA, 21 nt, Artificial Sequence
  RNA Oligomer
cauccaugaagaucucacugc

SEQ ID NO: 23748 - RNA, 21 nt, Artificial Sequence
  RNA Oligomer
uccaugccacugccaguuuca

SEQ ID NO: 23749 - RNA, 21 nt, Artificial Sequence
  RNA Oligomer
auccacgaacugaggcuuucu

SEQ ID NO: 23750 - RNA, 21 nt, Artificial Sequence
  RNA Oligomer
aaacaucuccuggaagaacac

SEQ ID NO: 23751 - RNA, 21 nt, Artificial Sequence
  RNA Oligomer
cuuucuugcuugucauuguug

SEQ ID NO: 23752 - RNA, 21 nt, Artificial Sequence
  RNA Oligomer
cuugcuugucauuguugccga

SEQ ID NO: 23753 - RNA, 21 nt, Artificial Sequence
  RNA Oligomer
gacucggacguacuuuuucac

SEQ ID NO: 23754 - RNA, 21 nt, Artificial Sequence
  RNA Oligomer
uuuuucaccuucuggcucagg

SEQ ID NO: 23755 - RNA, 21 nt, Artificial Sequence
  RNA Oligomer
gguuuaggaaaaugaagacag

SEQ ID NO: 23756 - RNA, 21 nt, Artificial Sequence
  RNA Oligomer
uuagaguucagccuguucagc

SEQ ID NO: 23757 - RNA, 21 nt, Artificial Sequence
  RNA Oligomer
ucuucuuuaugcucuuccugc

SEQ ID NO: 23758 - RNA, 21 nt, Artificial Sequence
  RNA Oligomer
uaaaagggugggucauagauc

SEQ ID NO: 23759 - RNA, 21 nt, Artificial Sequence
  RNA Oligomer
aaccuuauugcugauguccuc

SEQ ID NO: 23760 - RNA, 21 nt, Artificial Sequence
  RNA Oligomer
auggugagguaggagugguag

SEQ ID NO: 23761 - RNA, 21 nt, Artificial Sequence
  RNA Oligomer
auacacgcauucuuucuucuu

SEQ ID NO: 23762 - RNA, 21 nt, Artificial Sequence
  RNA Oligomer
aauguccacgcgauuccaugc

SEQ ID NO: 23763 - RNA, 21 nt, Artificial Sequence
  RNA Oligomer
auuccaugccacugccaguuu

SEQ ID NO: 23764 - RNA, 21 nt, Artificial Sequence
  RNA Oligomer
uuccaugccacugccaguuuc

SEQ ID NO: 23765 - RNA, 21 nt, Artificial Sequence
  RNA Oligomer
uuuugguccacucgacaaucc

SEQ ID NO: 23766 - RNA, 21 nt, Artificial Sequence
  RNA Oligomer
ucgacaauccugcuuuccgug

SEQ ID NO: 23767 - RNA, 21 nt, Artificial Sequence
  RNA Oligomer
aacaucuccuggaagaacacg

SEQ ID NO: 23768 - RNA, 21 nt, Artificial Sequence
  RNA Oligomer
gucugcuccgauaugaacuuc

SEQ ID NO: 23769 - RNA, 21 nt, Artificial Sequence
  RNA Oligomer
ggaugaagugagagugguugc

SEQ ID NO: 23770 - RNA, 21 nt, Artificial Sequence
  RNA Oligomer
uccucauccaguauguacucg

SEQ ID NO: 23771 - RNA, 21 nt, Artificial Sequence
  RNA Oligomer
uccugugagcuguugacacca

SEQ ID NO: 23772 - RNA, 21 nt, Artificial Sequence
  RNA Oligomer
guuagaguucagccuguucag

SEQ ID NO: 23773 - RNA, 21 nt, Artificial Sequence
  RNA Oligomer
guucagcuccacgucauucug

SEQ ID NO: 23774 - RNA, 21 nt, Artificial Sequence
  RNA Oligomer
uuuguacaccuccaugccgca

SEQ ID NO: 23775 - RNA, 21 nt, Artificial Sequence
  RNA Oligomer
acuuuccacaaaauacacgca

SEQ ID NO: 23776 - RNA, 21 nt, Artificial Sequence
  RNA Oligomer
ucacaaugaugaucuugggcc

SEQ ID NO: 23777 - RNA, 21 nt, Artificial Sequence
  RNA Oligomer
uacacgcauucuuucuucuug

SEQ ID NO: 23778 - RNA, 21 nt, Artificial Sequence
  RNA Oligomer
aaaugagaaggucacggaugg

SEQ ID NO: 23779 - RNA, 21 nt, Artificial Sequence
  RNA Oligomer
uacagguagagcaaggugucc

SEQ ID NO: 23780 - RNA, 21 nt, Artificial Sequence
  RNA Oligomer
uuccacugccacucauccaug

SEQ ID NO: 23781 - RNA, 21 nt, Artificial Sequence
  RNA Oligomer
augagcucgccuuccuuguag

SEQ ID NO: 23782 - RNA, 21 nt, Artificial Sequence
  RNA Oligomer
acgugucaggaacuuuauuug

SEQ ID NO: 23783 - RNA, 21 nt, Artificial Sequence
  RNA Oligomer
guuggugaagagcagguagag

SEQ ID NO: 23784 - RNA, 21 nt, Artificial Sequence
  RNA Oligomer
uccacaaaauacacgcauucu

SEQ ID NO: 23785 - RNA, 21 nt, Artificial Sequence
  RNA Oligomer
agaucugaaggcuuccacugc

SEQ ID NO: 23786 - RNA, 21 nt, Artificial Sequence
  RNA Oligomer
caucuccuggaagaacacgcu

SEQ ID NO: 23787 - RNA, 21 nt, Artificial Sequence
  RNA Oligomer
ucugcuccgauaugaacuucu

SEQ ID NO: 23788 - RNA, 21 nt, Artificial Sequence
  RNA Oligomer
cgugucaggaacuuuauuugu

SEQ ID NO: 23789 - RNA, 21 nt, Artificial Sequence
  RNA Oligomer
ugagcuguugacaccaaacca

SEQ ID NO: 23790 - RNA, 21 nt, Artificial Sequence
  RNA Oligomer
uagccuuuguacaccuccaug

SEQ ID NO: 23791 - RNA, 21 nt, Artificial Sequence
  RNA Oligomer
agccuuuguacaccuccaugc

SEQ ID NO: 23792 - RNA, 21 nt, Artificial Sequence
  RNA Oligomer
caucuucuuuaugcucuuccu

SEQ ID NO: 23793 - RNA, 21 nt, Artificial Sequence
  RNA Oligomer
gaagauggugagguaggagug

SEQ ID NO: 23794 - RNA, 21 nt, Artificial Sequence
  RNA Oligomer
aagaggaagaagaagacgucc

SEQ ID NO: 23795 - RNA, 21 nt, Artificial Sequence
  RNA Oligomer
acaaaauacacgcauucuuuc

SEQ ID NO: 23796 - RNA, 21 nt, Artificial Sequence
  RNA Oligomer
caaaauacacgcauucuuucu

SEQ ID NO: 23797 - RNA, 21 nt, Artificial Sequence
  RNA Oligomer
aaggcgaaguaggagaggaug

SEQ ID NO: 23798 - RNA, 21 nt, Artificial Sequence
  RNA Oligomer
acaucuccuggaagaacacgc

SEQ ID NO: 23799 - RNA, 21 nt, Artificial Sequence
  RNA Oligomer
uccgauaugaacuucuccagc

SEQ ID NO: 23800 - RNA, 21 nt, Artificial Sequence
  RNA Oligomer
auaugaacuucuccagccugg

SEQ ID NO: 23801 - RNA, 21 nt, Artificial Sequence
  RNA Oligomer
ucuccuggacauguuucuuug

SEQ ID NO: 23802 - RNA, 21 nt, Artificial Sequence
  RNA Oligomer
uguugacaccaaaccagaagg

SEQ ID NO: 23803 - RNA, 21 nt, Artificial Sequence
  RNA Oligomer
uuuucaaaagacggccagugc

SEQ ID NO: 23804 - RNA, 21 nt, Artificial Sequence
  RNA Oligomer
uucuucuccagcuuguucuug

SEQ ID NO: 23805 - RNA, 21 nt, Artificial Sequence
  RNA Oligomer
aagguguaguugaacauggcg

SEQ ID NO: 23806 - RNA, 21 nt, Artificial Sequence
  RNA Oligomer
gaacuuuccacaaaauacacg

SEQ ID NO: 23807 - RNA, 21 nt, Artificial Sequence
  RNA Oligomer
aguuucugggcucucucuucg

SEQ ID NO: 23808 - RNA, 21 nt, Artificial Sequence
  RNA Oligomer
guuucugggcucucucuucgu

SEQ ID NO: 23809 - RNA, 21 nt, Artificial Sequence
  RNA Oligomer
uuucugggcucucucuucguc

SEQ ID NO: 23810 - RNA, 21 nt, Artificial Sequence
  RNA Oligomer
ugcagaucugaaggcuuccac

SEQ ID NO: 23811 - RNA, 21 nt, Artificial Sequence
  RNA Oligomer
cacgaacugaggcuuucuugc

SEQ ID NO: 23812 - RNA, 21 nt, Artificial Sequence
  RNA Oligomer
cugcuccgauaugaacuucuc

SEQ ID NO: 23813 - RNA, 21 nt, Artificial Sequence
  RNA Oligomer
uuccucgggucauccauguag

SEQ ID NO: 23814 - RNA, 21 nt, Artificial Sequence
  RNA Oligomer
uuuugcuggaacugucgguuc

SEQ ID NO: 23815 - RNA, 21 nt, Artificial Sequence
  RNA Oligomer
gugacaaacuccuucagcugc

SEQ ID NO: 23816 - RNA, 21 nt, Artificial Sequence
  RNA Oligomer
guuuaggaaaaugaagacagg

SEQ ID NO: 23817 - RNA, 21 nt, Artificial Sequence
  RNA Oligomer
gaacuuuauuuguggaaagca

SEQ ID NO: 23818 - RNA, 21 nt, Artificial Sequence
  RNA Oligomer
gaacuuccaaaucugguccgu

SEQ ID NO: 23819 - RNA, 21 nt, Artificial Sequence
  RNA Oligomer
guacagguagagcaagguguc

SEQ ID NO: 23820 - RNA, 21 nt, Artificial Sequence
  RNA Oligomer
gauaucuuggaucuuuuuggu

SEQ ID NO: 23821 - RNA, 21 nt, Artificial Sequence
  RNA Oligomer
cuccgauaugaacuucuccag

SEQ ID NO: 23822 - RNA, 21 nt, Artificial Sequence
  RNA Oligomer
gauaugaacuucuccagccug

SEQ ID NO: 23823 - RNA, 21 nt, Artificial Sequence
  RNA Oligomer
cuuguucuugagcugcuugug

SEQ ID NO: 23824 - RNA, 21 nt, Artificial Sequence
  RNA Oligomer
uaguugaacauggcgaugagg

SEQ ID NO: 23825 - RNA, 21 nt, Artificial Sequence
  RNA Oligomer
gaggcagaacaggaugaaguc

SEQ ID NO: 23826 - RNA, 21 nt, Artificial Sequence
  RNA Oligomer
gugaaggucucaaacaucucc

SEQ ID NO: 23827 - RNA, 21 nt, Artificial Sequence
  RNA Oligomer
ugaaggucucaaacaucuccu

SEQ ID NO: 23828 - RNA, 21 nt, Artificial Sequence
  RNA Oligomer
aaagggugggucauagaucag

SEQ ID NO: 23829 - RNA, 21 nt, Artificial Sequence
  RNA Oligomer
cugauguccucgaucuucugc

SEQ ID NO: 23830 - RNA, 21 nt, Artificial Sequence
  RNA Oligomer
uucuggagguaguucuccuuc

SEQ ID NO: 23831 - RNA, 21 nt, Artificial Sequence
  RNA Oligomer
uacuccucgaucaggucaugg

SEQ ID NO: 23832 - RNA, 21 nt, Artificial Sequence
  RNA Oligomer
aucagggagauagugaugucc

SEQ ID NO: 23833 - RNA, 21 nt, Artificial Sequence
  RNA Oligomer
uaggaaaaugaagacagggag

SEQ ID NO: 23834 - RNA, 21 nt, Artificial Sequence
  RNA Oligomer
aacuugccucaggccaaugac

SEQ ID NO: 23835 - RNA, 21 nt, Artificial Sequence
  RNA Oligomer
cagcaaguuuucaaaagacgg

SEQ ID NO: 23836 - RNA, 21 nt, Artificial Sequence
  RNA Oligomer
uagaucaggaacuccgucucc

SEQ ID NO: 23837 - RNA, 21 nt, Artificial Sequence
  RNA Oligomer
gaagguguaguugaacauggc

SEQ ID NO: 23838 - RNA, 21 nt, Artificial Sequence
  RNA Oligomer
uuggugaagagcagguagagg

SEQ ID NO: 23839 - RNA, 21 nt, Artificial Sequence
  RNA Oligomer
uuacugaugguaaaaaugugc

SEQ ID NO: 23840 - RNA, 21 nt, Artificial Sequence
  RNA Oligomer
aaaaugugcaugagccggagg

SEQ ID NO: 23841 - RNA, 21 nt, Artificial Sequence
  RNA Oligomer
aaggucucaaacaucuccugg

SEQ ID NO: 23842 - RNA, 21 nt, Artificial Sequence
  RNA Oligomer
aagaacacgcucaguuucugc

SEQ ID NO: 23843 - RNA, 21 nt, Artificial Sequence
  RNA Oligomer
augaagacagggagcugaugg

SEQ ID NO: 23844 - RNA, 21 nt, Artificial Sequence
  RNA Oligomer
aaguuuucaaaagacggccag

SEQ ID NO: 23845 - RNA, 21 nt, Artificial Sequence
  RNA Oligomer
uuaugcucuuccugcagaugg

SEQ ID NO: 23846 - RNA, 21 nt, Artificial Sequence
  RNA Oligomer
gauguccucgaucuucugcuc

SEQ ID NO: 23847 - RNA, 21 nt, Artificial Sequence
  RNA Oligomer
cugcuuuugcuggaacugucg

SEQ ID NO: 23848 - RNA, 21 nt, Artificial Sequence
  RNA Oligomer
uaguucuccuucagguagauc

SEQ ID NO: 23849 - RNA, 21 nt, Artificial Sequence
  RNA Oligomer
uccucguucuucuccagcuug

SEQ ID NO: 23850 - RNA, 21 nt, Artificial Sequence
  RNA Oligomer
uugagcugcuugugccucuug

SEQ ID NO: 23851 - RNA, 21 nt, Artificial Sequence
  RNA Oligomer
uuccaaaucugguccgugugc

SEQ ID NO: 23852 - RNA, 21 nt, Artificial Sequence
  RNA Oligomer
aaaucugguccgugugcuccu

SEQ ID NO: 23853 - RNA, 21 nt, Artificial Sequence
  RNA Oligomer
aggaagaggaagaagaagacg

SEQ ID NO: 23854 - RNA, 21 nt, Artificial Sequence
  RNA Oligomer
aaaaaugugcaugagccggag

SEQ ID NO: 23855 - RNA, 21 nt, Artificial Sequence
  RNA Oligomer
acacgcauucuuucuucuuga

SEQ ID NO: 23856 - RNA, 21 nt, Artificial Sequence
  RNA Oligomer
ucacaaacucaggcuuguugg

SEQ ID NO: 23857 - RNA, 21 nt, Artificial Sequence
  RNA Oligomer
aggaaaaugaagacagggagc

SEQ ID NO: 23858 - RNA, 21 nt, Artificial Sequence
  RNA Oligomer
acuuccagcaucuucuuuaug

SEQ ID NO: 23859 - RNA, 21 nt, Artificial Sequence
  RNA Oligomer
uagaucucccaggauagcagg

SEQ ID NO: 23860 - RNA, 21 nt, Artificial Sequence
  RNA Oligomer
acccucuugaugaagagcugc

SEQ ID NO: 23861 - RNA, 21 nt, Artificial Sequence
  RNA Oligomer
gaagaggaagaagaagacguc

SEQ ID NO: 23862 - RNA, 21 nt, Artificial Sequence
  RNA Oligomer
aagagcuucacaaacucaggc

SEQ ID NO: 23863 - RNA, 21 nt, Artificial Sequence
  RNA Oligomer
uuuuugguccacucgacaauc

SEQ ID NO: 23864 - RNA, 21 nt, Artificial Sequence
  RNA Oligomer
acguacuuuuucaccuucugg

SEQ ID NO: 23865 - RNA, 21 nt, Artificial Sequence
  RNA Oligomer
aucgaggagaacuucaggcag

SEQ ID NO: 23866 - RNA, 21 nt, Artificial Sequence
  RNA Oligomer
uugacaccaaaccagaaggcc

SEQ ID NO: 23867 - RNA, 21 nt, Artificial Sequence
  RNA Oligomer
uuucuuugggucccacugugu

SEQ ID NO: 23868 - RNA, 21 nt, Artificial Sequence
  RNA Oligomer
auucugguccuggaaguggac

SEQ ID NO: 23869 - RNA, 21 nt, Artificial Sequence
  RNA Oligomer
uugaagaggcugcuguugcug

SEQ ID NO: 23870 - RNA, 21 nt, Artificial Sequence
  RNA Oligomer
gucauagaucaggaacuccgu

SEQ ID NO: 23871 - RNA, 21 nt, Artificial Sequence
  RNA Oligomer
aacugucgguucuggagguag

SEQ ID NO: 23872 - RNA, 21 nt, Artificial Sequence
  RNA Oligomer
guucuugagcugcuugugccu

SEQ ID NO: 23873 - RNA, 21 nt, Artificial Sequence
  RNA Oligomer
guaguugaacauggcgaugag

SEQ ID NO: 23874 - RNA, 21 nt, Artificial Sequence
  RNA Oligomer
guugagcagcaggauguuggu

SEQ ID NO: 23875 - RNA, 21 nt, Artificial Sequence
  RNA Oligomer
aaguccagagagaggaugacg

SEQ ID NO: 23876 - RNA, 21 nt, Artificial Sequence
  RNA Oligomer
cugcuuuccgugaaggucuca

SEQ ID NO: 23877 - RNA, 21 nt, Artificial Sequence
  RNA Oligomer
auagugauguccgagacaggc

SEQ ID NO: 23878 - RNA, 21 nt, Artificial Sequence
  RNA Oligomer
auguagccuuuguacaccucc

SEQ ID NO: 23879 - RNA, 21 nt, Artificial Sequence
  RNA Oligomer
agcaaguuuucaaaagacggc

SEQ ID NO: 23880 - RNA, 21 nt, Artificial Sequence
  RNA Oligomer
uuuaugcucuuccugcagaug

SEQ ID NO: 23881 - RNA, 21 nt, Artificial Sequence
  RNA Oligomer
aagggugggucauagaucagg

SEQ ID NO: 23882 - RNA, 21 nt, Artificial Sequence
  RNA Oligomer
uugcuggaacugucgguucug

SEQ ID NO: 23883 - RNA, 21 nt, Artificial Sequence
  RNA Oligomer
guucuccuucagguagaucuc

SEQ ID NO: 23884 - RNA, 21 nt, Artificial Sequence
  RNA Oligomer
uucuccuucagguagaucucc

SEQ ID NO: 23885 - RNA, 21 nt, Artificial Sequence
  RNA Oligomer
ugagacacaaacuucaugucc

SEQ ID NO: 23886 - RNA, 21 nt, Artificial Sequence
  RNA Oligomer
cuccuuggacaguuccuucag

SEQ ID NO: 23887 - RNA, 21 nt, Artificial Sequence
  RNA Oligomer
uuguuggagaugagugcagcu

SEQ ID NO: 23888 - RNA, 21 nt, Artificial Sequence
  RNA Oligomer
agaugagugcagcugucaucg

SEQ ID NO: 23889 - RNA, 21 nt, Artificial Sequence
  RNA Oligomer
uuugguccacucgacaauccu

SEQ ID NO: 23890 - RNA, 21 nt, Artificial Sequence
  RNA Oligomer
ucagggagauagugauguccg

SEQ ID NO: 23891 - RNA, 21 nt, Artificial Sequence
  RNA Oligomer
ucauccaguauguacucggcg

SEQ ID NO: 23892 - RNA, 21 nt, Artificial Sequence
  RNA Oligomer
ucauguugaaguucuuggccc

SEQ ID NO: 23893 - RNA, 21 nt, Artificial Sequence
  RNA Oligomer
augucuuggguuuuaccacgu

SEQ ID NO: 23894 - RNA, 21 nt, Artificial Sequence
  RNA Oligomer
ucuuggguuuuaccacguucc

SEQ ID NO: 23895 - RNA, 21 nt, Artificial Sequence
  RNA Oligomer
cuuggguuuuaccacguuccc

SEQ ID NO: 23896 - RNA, 21 nt, Artificial Sequence
  RNA Oligomer
auccaggcauuguccguguuc

SEQ ID NO: 23897 - RNA, 21 nt, Artificial Sequence
  RNA Oligomer
caaguuuucaaaagacggcca

SEQ ID NO: 23898 - RNA, 21 nt, Artificial Sequence
  RNA Oligomer
uaugcucuuccugcagauggc

SEQ ID NO: 23899 - RNA, 21 nt, Artificial Sequence
  RNA Oligomer
agggugggucauagaucagga

SEQ ID NO: 23900 - RNA, 21 nt, Artificial Sequence
  RNA Oligomer
ccauggcgucaaccuuauugc

SEQ ID NO: 23901 - RNA, 21 nt, Artificial Sequence
  RNA Oligomer
uucagguagaucucccaggau

SEQ ID NO: 23902 - RNA, 21 nt, Artificial Sequence
  RNA Oligomer
cgcuggaacuuccaaaucugg

SEQ ID NO: 23903 - RNA, 21 nt, Artificial Sequence
  RNA Oligomer
uggaacuuccaaaucuggucc

SEQ ID NO: 23904 - RNA, 21 nt, Artificial Sequence
  RNA Oligomer
aggauguuggugaagagcagg

SEQ ID NO: 23905 - RNA, 21 nt, Artificial Sequence
  RNA Oligomer
uacugaugguaaaaaugugca

SEQ ID NO: 23906 - RNA, 21 nt, Artificial Sequence
  RNA Oligomer
uaaaaaugugcaugagccgga

SEQ ID NO: 23907 - RNA, 21 nt, Artificial Sequence
  RNA Oligomer
aacaggaugaaguccagagag

SEQ ID NO: 23908 - RNA, 21 nt, Artificial Sequence
  RNA Oligomer
uuauuccagaagucacugaag

SEQ ID NO: 23909 - RNA, 21 nt, Artificial Sequence
  RNA Oligomer
aaggcugccuucuucaucagc

SEQ ID NO: 23910 - RNA, 21 nt, Artificial Sequence
  RNA Oligomer
aauccugcuuuccgugaaggu

SEQ ID NO: 23911 - RNA, 21 nt, Artificial Sequence
  RNA Oligomer
agggagauagugauguccgag

SEQ ID NO: 23912 - RNA, 21 nt, Artificial Sequence
  RNA Oligomer
uugucgauggugugcaacgug

SEQ ID NO: 23913 - RNA, 21 nt, Artificial Sequence
  RNA Oligomer
gugagagugguugcugucuag

SEQ ID NO: 23914 - RNA, 21 nt, Artificial Sequence
  RNA Oligomer
aaugucuuggguuuuaccacg

SEQ ID NO: 23915 - RNA, 21 nt, Artificial Sequence
  RNA Oligomer
aaugaccuccaugguggauga

SEQ ID NO: 23916 - RNA, 21 nt, Artificial Sequence
  RNA Oligomer
uucagcuccacgucauucugg

SEQ ID NO: 23917 - RNA, 21 nt, Artificial Sequence
  RNA Oligomer
ucauucugguccuggaagugg

SEQ ID NO: 23918 - RNA, 21 nt, Artificial Sequence
  RNA Oligomer
uucuuuaugcucuuccugcag

SEQ ID NO: 23919 - RNA, 21 nt, Artificial Sequence
  RNA Oligomer
ugggucauagaucaggaacuc

SEQ ID NO: 23920 - RNA, 21 nt, Artificial Sequence
  RNA Oligomer
uuugcuggaacugucgguucu

SEQ ID NO: 23921 - RNA, 21 nt, Artificial Sequence
  RNA Oligomer
ucagacaguuuggaacuuucc

SEQ ID NO: 23922 - RNA, 21 nt, Artificial Sequence
  RNA Oligomer
auguuggugaagagcagguag

SEQ ID NO: 23923 - RNA, 21 nt, Artificial Sequence
  RNA Oligomer
caggaagaggaagaagaagac

SEQ ID NO: 23924 - RNA, 21 nt, Artificial Sequence
  RNA Oligomer
ucacugaaguacaaggcugcc

SEQ ID NO: 23925 - RNA, 21 nt, Artificial Sequence
  RNA Oligomer
aaguacaaggcugccuucuuc

SEQ ID NO: 23926 - RNA, 21 nt, Artificial Sequence
  RNA Oligomer
acaaacuccuucagcugcacc

SEQ ID NO: 23927 - RNA, 21 nt, Artificial Sequence
  RNA Oligomer
uuuucaggaauccacgaacug

SEQ ID NO: 23928 - RNA, 21 nt, Artificial Sequence
  RNA Oligomer
uggaucuuuuugguccacucg

SEQ ID NO: 23929 - RNA, 21 nt, Artificial Sequence
  RNA Oligomer
augaagugagagugguugcug

SEQ ID NO: 23930 - RNA, 21 nt, Artificial Sequence
  RNA Oligomer
aaaugaagacagggagcugau

SEQ ID NO: 23931 - RNA, 21 nt, Artificial Sequence
  RNA Oligomer
gaucgaggagaacuucaggca

SEQ ID NO: 23932 - RNA, 21 nt, Artificial Sequence
  RNA Oligomer
cauguagccuuuguacaccuc

SEQ ID NO: 23933 - RNA, 21 nt, Artificial Sequence
  RNA Oligomer
auagaucaggaacuccgucuc

SEQ ID NO: 23934 - RNA, 21 nt, Artificial Sequence
  RNA Oligomer
uccagcuuguucuugagcugc

SEQ ID NO: 23935 - RNA, 21 nt, Artificial Sequence
  RNA Oligomer
aacuuccaaaucugguccgug

SEQ ID NO: 23936 - RNA, 21 nt, Artificial Sequence
  RNA Oligomer
uugagcagcaggauguuggug

SEQ ID NO: 23937 - RNA, 21 nt, Artificial Sequence
  RNA Oligomer
ugguaaaaaugugcaugagcc

SEQ ID NO: 23938 - RNA, 21 nt, Artificial Sequence
  RNA Oligomer
gucacugaaguacaaggcugc

SEQ ID NO: 23939 - RNA, 21 nt, Artificial Sequence
  RNA Oligomer
aguacaaggcugccuucuuca

SEQ ID NO: 23940 - RNA, 21 nt, Artificial Sequence
  RNA Oligomer
uucuggacaauggcccaaaug

SEQ ID NO: 23941 - RNA, 21 nt, Artificial Sequence
  RNA Oligomer
aaggugucccaggugacaaac

SEQ ID NO: 23942 - RNA, 21 nt, Artificial Sequence
  RNA Oligomer
uucacaaacucaggcuuguug

SEQ ID NO: 23943 - RNA, 21 nt, Artificial Sequence
  RNA Oligomer
aacucaggcuuguuggagaug

SEQ ID NO: 23944 - RNA, 21 nt, Artificial Sequence
  RNA Oligomer
guuggagaugagugcagcugu

SEQ ID NO: 23945 - RNA, 21 nt, Artificial Sequence
  RNA Oligomer
aaaguggucuuggcuccguga

SEQ ID NO: 23946 - RNA, 21 nt, Artificial Sequence
  RNA Oligomer
aacacgcucaguuucugcugg

SEQ ID NO: 23947 - RNA, 21 nt, Artificial Sequence
  RNA Oligomer
gaucagggagauagugauguc

SEQ ID NO: 23948 - RNA, 21 nt, Artificial Sequence
  RNA Oligomer
cucugcggaaaaugcucuuca

SEQ ID NO: 23949 - RNA, 21 nt, Artificial Sequence
  RNA Oligomer
ucaugaggugguagaucacgc

SEQ ID NO: 23950 - RNA, 21 nt, Artificial Sequence
  RNA Oligomer
agcccagguuuaggaaaauga

SEQ ID NO: 23951 - RNA, 21 nt, Artificial Sequence
  RNA Oligomer
uauuuguggaaagcacagaag

SEQ ID NO: 23952 - RNA, 21 nt, Artificial Sequence
  RNA Oligomer
gucuuggguuuuaccacguuc

SEQ ID NO: 23953 - RNA, 21 nt, Artificial Sequence
  RNA Oligomer
uugaggcaccucgaaacaugg

SEQ ID NO: 23954 - RNA, 21 nt, Artificial Sequence
  RNA Oligomer
ucagcaaguuuucaaaagacg

SEQ ID NO: 23955 - RNA, 21 nt, Artificial Sequence
  RNA Oligomer
ucagcuuccgagguagcaucu

SEQ ID NO: 23956 - RNA, 21 nt, Artificial Sequence
  RNA Oligomer
accacguuguacuggaucgug

SEQ ID NO: 23957 - RNA, 21 nt, Artificial Sequence
  RNA Oligomer
uuguacuggaucguggacagu

SEQ ID NO: 23958 - RNA, 21 nt, Artificial Sequence
  RNA Oligomer
aaaagggugggucauagauca

SEQ ID NO: 23959 - RNA, 21 nt, Artificial Sequence
  RNA Oligomer
uucuugagcugcuugugccuc

SEQ ID NO: 23960 - RNA, 21 nt, Artificial Sequence
  RNA Oligomer
gaagacguccuucaucauccg

SEQ ID NO: 23961 - RNA, 21 nt, Artificial Sequence
  RNA Oligomer
ugaaguccagagagaggauga

SEQ ID NO: 23962 - RNA, 21 nt, Artificial Sequence
  RNA Oligomer
uccagcuuauuccagaaguca

SEQ ID NO: 23963 - RNA, 21 nt, Artificial Sequence
  RNA Oligomer
ucuugauguuuucaggaaucc

SEQ ID NO: 23964 - RNA, 21 nt, Artificial Sequence
  RNA Oligomer
agguucucguacagguagagc

SEQ ID NO: 23965 - RNA, 21 nt, Artificial Sequence
  RNA Oligomer
ugauguuuucaggaauccacg

SEQ ID NO: 23966 - RNA, 21 nt, Artificial Sequence
  RNA Oligomer
caggugacaaacuccuucagc

SEQ ID NO: 23967 - RNA, 21 nt, Artificial Sequence
  RNA Oligomer
aaacucaggcuuguuggagau

SEQ ID NO: 23968 - RNA, 21 nt, Artificial Sequence
  RNA Oligomer
uggagaugagugcagcuguca

SEQ ID NO: 23969 - RNA, 21 nt, Artificial Sequence
  RNA Oligomer
aucuuggaucuuuuuggucca

SEQ ID NO: 23970 - RNA, 21 nt, Artificial Sequence
  RNA Oligomer
uugguccacucgacaauccug

SEQ ID NO: 23971 - RNA, 21 nt, Artificial Sequence
  RNA Oligomer
augaggugguagaucacgcug

SEQ ID NO: 23972 - RNA, 21 nt, Artificial Sequence
  RNA Oligomer
ugucaggaacuuuauuugugg

SEQ ID NO: 23973 - RNA, 21 nt, Artificial Sequence
  RNA Oligomer
uuccucacagacauaggccug

SEQ ID NO: 23974 - RNA, 21 nt, Artificial Sequence
  RNA Oligomer
cuugucauuguugccgaaggg

SEQ ID NO: 23975 - RNA, 21 nt, Artificial Sequence
  RNA Oligomer
uucuuugggucccacugugug

SEQ ID NO: 23976 - RNA, 21 nt, Artificial Sequence
  RNA Oligomer
augcucuuccugcagauggcu

SEQ ID NO: 23977 - RNA, 21 nt, Artificial Sequence
  RNA Oligomer
ucccagcaucagacaguuugg

SEQ ID NO: 23978 - RNA, 21 nt, Artificial Sequence
  RNA Oligomer
gggucauagaucaggaacucc

SEQ ID NO: 23979 - RNA, 21 nt, Artificial Sequence
  RNA Oligomer
cauggcgucaaccuuauugcu

SEQ ID NO: 23980 - RNA, 21 nt, Artificial Sequence
  RNA Oligomer
ugcuuuugcuggaacugucgg

SEQ ID NO: 23981 - RNA, 21 nt, Artificial Sequence
  RNA Oligomer
uggagguaguucuccuucagg

SEQ ID NO: 23982 - RNA, 21 nt, Artificial Sequence
  RNA Oligomer
uguucuugagcugcuugugcc

SEQ ID NO: 23983 - RNA, 21 nt, Artificial Sequence
  RNA Oligomer
cucuugaugaagagcugcagg

SEQ ID NO: 23984 - RNA, 21 nt, Artificial Sequence
  RNA Oligomer
ugccacgaagagcaagauugc

SEQ ID NO: 23985 - RNA, 21 nt, Artificial Sequence
  RNA Oligomer
auguucagguggaagaccacc

SEQ ID NO: 23986 - RNA, 21 nt, Artificial Sequence
  RNA Oligomer
uccauggugaaggucacaugg

SEQ ID NO: 23987 - RNA, 21 nt, Artificial Sequence
  RNA Oligomer
uuucaggaauccacgaacuga

SEQ ID NO: 23988 - RNA, 21 nt, Artificial Sequence
  RNA Oligomer
uuggaucuuuuugguccacuc

SEQ ID NO: 23989 - RNA, 21 nt, Artificial Sequence
  RNA Oligomer
caauccugcuuuccgugaagg

SEQ ID NO: 23990 - RNA, 21 nt, Artificial Sequence
  RNA Oligomer
gaacacgcucaguuucugcug

SEQ ID NO: 23991 - RNA, 21 nt, Artificial Sequence
  RNA Oligomer
ugagagugguugcugucuagg

SEQ ID NO: 23992 - RNA, 21 nt, Artificial Sequence
  RNA Oligomer
uucauguugaaguucuuggcc

SEQ ID NO: 23993 - RNA, 21 nt, Artificial Sequence
  RNA Oligomer
cuccuggacauguuucuuugg

SEQ ID NO: 23994 - RNA, 21 nt, Artificial Sequence
  RNA Oligomer
acggaguuuauccugacaguc

SEQ ID NO: 23995 - RNA, 21 nt, Artificial Sequence
  RNA Oligomer
uuauccugacagucaggaguu

SEQ ID NO: 23996 - RNA, 21 nt, Artificial Sequence
  RNA Oligomer
augaccuccaugguggaugag

SEQ ID NO: 23997 - RNA, 21 nt, Artificial Sequence
  RNA Oligomer
ugcagguuagaguucagccug

SEQ ID NO: 23998 - RNA, 21 nt, Artificial Sequence
  RNA Oligomer
ucaugcguguagccacacuga

SEQ ID NO: 23999 - RNA, 21 nt, Artificial Sequence
  RNA Oligomer
gcaaguuuucaaaagacggcc

SEQ ID NO: 24000 - RNA, 21 nt, Artificial Sequence
  RNA Oligomer
auggcgucaaccuuauugcug

SEQ ID NO: 24001 - RNA, 21 nt, Artificial Sequence
  RNA Oligomer
accugcuggaagguguaguug

SEQ ID NO: 24002 - RNA, 21 nt, Artificial Sequence
  RNA Oligomer
aagagcagguagaggcagagu

SEQ ID NO: 24003 - RNA, 21 nt, Artificial Sequence
  RNA Oligomer
augguaaaaaugugcaugagc

SEQ ID NO: 24004 - RNA, 21 nt, Artificial Sequence
  RNA Oligomer
gguaaaaaugugcaugagccg

SEQ ID NO: 24005 - RNA, 21 nt, Artificial Sequence
  RNA Oligomer
guaaaaaugugcaugagccgg

SEQ ID NO: 24006 - RNA, 21 nt, Artificial Sequence
  RNA Oligomer
aagucacugaaguacaaggcu

SEQ ID NO: 24007 - RNA, 21 nt, Artificial Sequence
  RNA Oligomer
gauguucagguggaagaccac

SEQ ID NO: 24008 - RNA, 21 nt, Artificial Sequence
  RNA Oligomer
gacacaaacuucauguccuug

SEQ ID NO: 24009 - RNA, 21 nt, Artificial Sequence
  RNA Oligomer
aauggcccaaaugagaagguc

SEQ ID NO: 24010 - RNA, 21 nt, Artificial Sequence
  RNA Oligomer
auaaagcggcugcgugaaguc

SEQ ID NO: 24011 - RNA, 21 nt, Artificial Sequence
  RNA Oligomer
uugauguuuucaggaauccac

SEQ ID NO: 24012 - RNA, 21 nt, Artificial Sequence
  RNA Oligomer
agcuucacaaacucaggcuug

SEQ ID NO: 24013 - RNA, 21 nt, Artificial Sequence
  RNA Oligomer
augagugcagcugucaucgug

SEQ ID NO: 24014 - RNA, 21 nt, Artificial Sequence
  RNA Oligomer
aucuuuuugguccacucgaca

SEQ ID NO: 24015 - RNA, 21 nt, Artificial Sequence
  RNA Oligomer
gaaggucucaaacaucuccug

SEQ ID NO: 24016 - RNA, 21 nt, Artificial Sequence
  RNA Oligomer
caguuucugcuggaucaggga

SEQ ID NO: 24017 - RNA, 21 nt, Artificial Sequence
  RNA Oligomer
gauagugauguccgagacagg

SEQ ID NO: 24018 - RNA, 21 nt, Artificial Sequence
  RNA Oligomer
aagugagagugguugcugucu

SEQ ID NO: 24019 - RNA, 21 nt, Artificial Sequence
  RNA Oligomer
cucauccaguauguacucggc

SEQ ID NO: 24020 - RNA, 21 nt, Artificial Sequence
  RNA Oligomer
aaaaugaagacagggagcuga

SEQ ID NO: 24021 - RNA, 21 nt, Artificial Sequence
  RNA Oligomer
cugagauggcagauuuaaugu

SEQ ID NO: 24022 - RNA, 21 nt, Artificial Sequence
  RNA Oligomer
guugacaccaaaccagaaggc

SEQ ID NO: 24023 - RNA, 21 nt, Artificial Sequence
  RNA Oligomer
uugugguucgcauagaguggg

SEQ ID NO: 24024 - RNA, 21 nt, Artificial Sequence
  RNA Oligomer
agguuagaguucagccuguuc

SEQ ID NO: 24025 - RNA, 21 nt, Artificial Sequence
  RNA Oligomer
agcaucuucuuuaugcucuuc

SEQ ID NO: 24026 - RNA, 21 nt, Artificial Sequence
  RNA Oligomer
cuugaugaagagcugcaggug

SEQ ID NO: 24027 - RNA, 21 nt, Artificial Sequence
  RNA Oligomer
ggaacuuccaaaucugguccg

SEQ ID NO: 24028 - RNA, 21 nt, Artificial Sequence
  RNA Oligomer
uggaagguguaguugaacaug

SEQ ID NO: 24029 - RNA, 21 nt, Artificial Sequence
  RNA Oligomer
aucauccgcuucacaaugaug

SEQ ID NO: 24030 - RNA, 21 nt, Artificial Sequence
  RNA Oligomer
auuccagaagucacugaagua

SEQ ID NO: 24031 - RNA, 21 nt, Artificial Sequence
  RNA Oligomer
uuccagaagucacugaaguac

SEQ ID NO: 24032 - RNA, 21 nt, Artificial Sequence
  RNA Oligomer
aagagccagagguagauggca

SEQ ID NO: 24033 - RNA, 21 nt, Artificial Sequence
  RNA Oligomer
auggcucugugcucauacucc

SEQ ID NO: 24034 - RNA, 21 nt, Artificial Sequence
  RNA Oligomer
cuugauguuuucaggaaucca

SEQ ID NO: 24035 - RNA, 21 nt, Artificial Sequence
  RNA Oligomer
ucaggaauccacgaacugagg

SEQ ID NO: 24036 - RNA, 21 nt, Artificial Sequence
  RNA Oligomer
uucucguggccaaaguggucu

SEQ ID NO: 24037 - RNA, 21 nt, Artificial Sequence
  RNA Oligomer
ucuuggaucuuuuugguccac

SEQ ID NO: 24038 - RNA, 21 nt, Artificial Sequence
  RNA Oligomer
ucaguuucugcuggaucaggg

SEQ ID NO: 24039 - RNA, 21 nt, Artificial Sequence
  RNA Oligomer
aucuugauggccacaccuccu

SEQ ID NO: 24040 - RNA, 21 nt, Artificial Sequence
  RNA Oligomer
caccgagaucaagagauuggg

SEQ ID NO: 24041 - RNA, 21 nt, Artificial Sequence
  RNA Oligomer
guacuuuuucaccuucuggcu

SEQ ID NO: 24042 - RNA, 21 nt, Artificial Sequence
  RNA Oligomer
uugcuugucauuguugccgaa

SEQ ID NO: 24043 - RNA, 21 nt, Artificial Sequence
  RNA Oligomer
uuuucaccuucuggcucaggc

SEQ ID NO: 24044 - RNA, 21 nt, Artificial Sequence
  RNA Oligomer
gaaaaugaagacagggagcug

SEQ ID NO: 24045 - RNA, 21 nt, Artificial Sequence
  RNA Oligomer
cuugugguucgcauagagugg

SEQ ID NO: 24046 - RNA, 21 nt, Artificial Sequence
  RNA Oligomer
auccauguagccuuuguacac

SEQ ID NO: 24047 - RNA, 21 nt, Artificial Sequence
  RNA Oligomer
gucaaccuuauugcugauguc

SEQ ID NO: 24048 - RNA, 21 nt, Artificial Sequence
  RNA Oligomer
auguccucgaucuucugcucg

SEQ ID NO: 24049 - RNA, 21 nt, Artificial Sequence
  RNA Oligomer
aggaagaagaagacguccuuc

SEQ ID NO: 24050 - RNA, 21 nt, Artificial Sequence
  RNA Oligomer
ugaugguaaaaaugugcauga

SEQ ID NO: 24051 - RNA, 21 nt, Artificial Sequence
  RNA Oligomer
agcuuauuccagaagucacug

SEQ ID NO: 24052 - RNA, 21 nt, Artificial Sequence
  RNA Oligomer
agaagagccagagguagaugg

SEQ ID NO: 24053 - RNA, 21 nt, Artificial Sequence
  RNA Oligomer
gugagacacaaacuucauguc

SEQ ID NO: 24054 - RNA, 21 nt, Artificial Sequence
  RNA Oligomer
uccuucaggaucuugcugcag

SEQ ID NO: 24055 - RNA, 21 nt, Artificial Sequence
  RNA Oligomer
uucuugauguuuucaggaauc

SEQ ID NO: 24056 - RNA, 21 nt, Artificial Sequence
  RNA Oligomer
caauggcccaaaugagaaggu

SEQ ID NO: 24057 - RNA, 21 nt, Artificial Sequence
  RNA Oligomer
auggcccaaaugagaagguca

SEQ ID NO: 24058 - RNA, 21 nt, Artificial Sequence
  RNA Oligomer
agagcuucacaaacucaggcu

SEQ ID NO: 24059 - RNA, 21 nt, Artificial Sequence
  RNA Oligomer
aucugaaggcuuccacugcca

SEQ ID NO: 24060 - RNA, 21 nt, Artificial Sequence
  RNA Oligomer
gaagugagagugguugcuguc

SEQ ID NO: 24061 - RNA, 21 nt, Artificial Sequence
  RNA Oligomer
caugaggugguagaucacgcu

SEQ ID NO: 24062 - RNA, 21 nt, Artificial Sequence
  RNA Oligomer
uacuuuuucaccuucuggcuc

SEQ ID NO: 24063 - RNA, 21 nt, Artificial Sequence
  RNA Oligomer
uguggaaagcacagaagagcc

SEQ ID NO: 24064 - RNA, 21 nt, Artificial Sequence
  RNA Oligomer
aagugcugcucaugcguguag

SEQ ID NO: 24065 - RNA, 21 nt, Artificial Sequence
  RNA Oligomer
gcaucuucuuuaugcucuucc

SEQ ID NO: 24066 - RNA, 21 nt, Artificial Sequence
  RNA Oligomer
agaagacguccuucaucaucc

SEQ ID NO: 24067 - RNA, 21 nt, Artificial Sequence
  RNA Oligomer
cugaaguacaaggcugccuuc

SEQ ID NO: 24068 - RNA, 21 nt, Artificial Sequence
  RNA Oligomer
auggugaaggucacauggccu

SEQ ID NO: 24069 - RNA, 21 nt, Artificial Sequence
  RNA Oligomer
uucuccaggaagagcuucaca

SEQ ID NO: 24070 - RNA, 21 nt, Artificial Sequence
  RNA Oligomer
gaagagcuucacaaacucagg

SEQ ID NO: 24071 - RNA, 21 nt, Artificial Sequence
  RNA Oligomer
uagugauguccgagacaggca

SEQ ID NO: 24072 - RNA, 21 nt, Artificial Sequence
  RNA Oligomer
ucugcggaaaaugcucuucag

SEQ ID NO: 24073 - RNA, 21 nt, Artificial Sequence
  RNA Oligomer
cugcggaaaaugcucuucagc

SEQ ID NO: 24074 - RNA, 21 nt, Artificial Sequence
  RNA Oligomer
ucaccgagaucaagagauugg

SEQ ID NO: 24075 - RNA, 21 nt, Artificial Sequence
  RNA Oligomer
augucgccaaaggcaucgguu

SEQ ID NO: 24076 - RNA, 21 nt, Artificial Sequence
  RNA Oligomer
auuuguggaaagcacagaaga

SEQ ID NO: 24077 - RNA, 21 nt, Artificial Sequence
  RNA Oligomer
uggacauguuucuuugggucc

SEQ ID NO: 24078 - RNA, 21 nt, Artificial Sequence
  RNA Oligomer
gaguuuauccugacagucagg

SEQ ID NO: 24079 - RNA, 21 nt, Artificial Sequence
  RNA Oligomer
guuuauccugacagucaggag

SEQ ID NO: 24080 - RNA, 21 nt, Artificial Sequence
  RNA Oligomer
ugugguucgcauagaguggga

SEQ ID NO: 24081 - RNA, 21 nt, Artificial Sequence
  RNA Oligomer
accacccucuugaugaagagc

SEQ ID NO: 24082 - RNA, 21 nt, Artificial Sequence
  RNA Oligomer
uuggaacuuuccacaaaauac

SEQ ID NO: 24083 - RNA, 21 nt, Artificial Sequence
  RNA Oligomer
gaugguaaaaaugugcaugag

SEQ ID NO: 24084 - RNA, 21 nt, Artificial Sequence
  RNA Oligomer
ugaggaacgcuuguagaggga

SEQ ID NO: 24085 - RNA, 21 nt, Artificial Sequence
  RNA Oligomer
auaucuuggaucuuuuugguc

SEQ ID NO: 24086 - RNA, 21 nt, Artificial Sequence
  RNA Oligomer
augaacuucuccagccugguc

SEQ ID NO: 24087 - RNA, 21 nt, Artificial Sequence
  RNA Oligomer
cuucauguugaaguucuuggc

SEQ ID NO: 24088 - RNA, 21 nt, Artificial Sequence
  RNA Oligomer
aagacgaugucgccaaaggca

SEQ ID NO: 24089 - RNA, 21 nt, Artificial Sequence
  RNA Oligomer
uuauuuguggaaagcacagaa

SEQ ID NO: 24090 - RNA, 21 nt, Artificial Sequence
  RNA Oligomer
uuuguggaaagcacagaagag

SEQ ID NO: 24091 - RNA, 21 nt, Artificial Sequence
  RNA Oligomer
uuuaaugucuuggguuuuacc

SEQ ID NO: 24092 - RNA, 21 nt, Artificial Sequence
  RNA Oligomer
uagaguucagccuguucagcu

SEQ ID NO: 24093 - RNA, 21 nt, Artificial Sequence
  RNA Oligomer
uucuccagcuuguucuugagc

SEQ ID NO: 24094 - RNA, 21 nt, Artificial Sequence
  RNA Oligomer
acugaugguaaaaaugugcau

SEQ ID NO: 24095 - RNA, 21 nt, Artificial Sequence
  RNA Oligomer
cugaugguaaaaaugugcaug

SEQ ID NO: 24096 - RNA, 21 nt, Artificial Sequence
  RNA Oligomer
cucgucagggucauagaagag

SEQ ID NO: 24097 - RNA, 21 nt, Artificial Sequence
  RNA Oligomer
gauggcucugugcucauacuc

SEQ ID NO: 24098 - RNA, 21 nt, Artificial Sequence
  RNA Oligomer
aggcuuguuggagaugagugc

SEQ ID NO: 24099 - RNA, 21 nt, Artificial Sequence
  RNA Oligomer
ccucauccaguauguacucgg

SEQ ID NO: 24100 - RNA, 21 nt, Artificial Sequence
  RNA Oligomer
aacuuuauuuguggaaagcac

SEQ ID NO: 24101 - RNA, 21 nt, Artificial Sequence
  RNA Oligomer
uuguggaaagcacagaagagc

SEQ ID NO: 24102 - RNA, 21 nt, Artificial Sequence
  RNA Oligomer
uccuggacauguuucuuuggg

SEQ ID NO: 24103 - RNA, 21 nt, Artificial Sequence
  RNA Oligomer
cucucugccguguaaaagggu

SEQ ID NO: 24104 - RNA, 21 nt, Artificial Sequence
  RNA Oligomer
uccuucagguagaucucccag

SEQ ID NO: 24105 - RNA, 21 nt, Artificial Sequence
  RNA Oligomer
cuucagguagaucucccagga

SEQ ID NO: 24106 - RNA, 21 nt, Artificial Sequence
  RNA Oligomer
ggaacuuuccacaaaauacac

SEQ ID NO: 24107 - RNA, 21 nt, Artificial Sequence
  RNA Oligomer
aggcagaacaggaugaagucc

SEQ ID NO: 24108 - RNA, 21 nt, Artificial Sequence
  RNA Oligomer
gacaguuccuucaggaucuug

SEQ ID NO: 24109 - RNA, 21 nt, Artificial Sequence
  RNA Oligomer
guuccuucaggaucuugcugc

SEQ ID NO: 24110 - RNA, 21 nt, Artificial Sequence
  RNA Oligomer
caggaagagcuucacaaacuc

SEQ ID NO: 24111 - RNA, 21 nt, Artificial Sequence
  RNA Oligomer
uaucuuggaucuuuuuggucc

SEQ ID NO: 24112 - RNA, 21 nt, Artificial Sequence
  RNA Oligomer
uaugaacuucuccagccuggu

SEQ ID NO: 24113 - RNA, 21 nt, Artificial Sequence
  RNA Oligomer
uccacgaggaugaagugagag

SEQ ID NO: 24114 - RNA, 21 nt, Artificial Sequence
  RNA Oligomer
cacgaggaugaagugagagug

SEQ ID NO: 24115 - RNA, 21 nt, Artificial Sequence
  RNA Oligomer
gucaggaacuuuauuugugga

SEQ ID NO: 24116 - RNA, 21 nt, Artificial Sequence
  RNA Oligomer
ucgguucuggagguaguucuc

SEQ ID NO: 24117 - RNA, 21 nt, Artificial Sequence
  RNA Oligomer
aaguccaccaugagcacguag

SEQ ID NO: 24118 - RNA, 21 nt, Artificial Sequence
  RNA Oligomer
uuucuucuugauguuuucagg

SEQ ID NO: 24119 - RNA, 21 nt, Artificial Sequence
  RNA Oligomer
uucuucuugauguuuucagga

SEQ ID NO: 24120 - RNA, 21 nt, Artificial Sequence
  RNA Oligomer
acaguuccuucaggaucuugc

SEQ ID NO: 24121 - RNA, 21 nt, Artificial Sequence
  RNA Oligomer
aggaagagcuucacaaacuca

SEQ ID NO: 24122 - RNA, 21 nt, Artificial Sequence
  RNA Oligomer
ugguccucagaggaaucucca

SEQ ID NO: 24123 - RNA, 21 nt, Artificial Sequence
  RNA Oligomer
cuggacauguuucuuuggguc

SEQ ID NO: 24124 - RNA, 21 nt, Artificial Sequence
  RNA Oligomer
agcuuguucuugagcugcuug

SEQ ID NO: 24125 - RNA, 21 nt, Artificial Sequence
  RNA Oligomer
aaggagaagagccagagguag

SEQ ID NO: 24126 - RNA, 21 nt, Artificial Sequence
  RNA Oligomer
uucucccugaaggagaugagg

SEQ ID NO: 24127 - RNA, 21 nt, Artificial Sequence
  RNA Oligomer
uccuccuuggacaguuccuuc

SEQ ID NO: 24128 - RNA, 21 nt, Artificial Sequence
  RNA Oligomer
uucugcagcuugcuguggaac

SEQ ID NO: 24129 - RNA, 21 nt, Artificial Sequence
  RNA Oligomer
cuuguuggagaugagugcagc

SEQ ID NO: 24130 - RNA, 21 nt, Artificial Sequence
  RNA Oligomer
uuaaugucuuggguuuuacca

SEQ ID NO: 24131 - RNA, 21 nt, Artificial Sequence
  RNA Oligomer
gacauguuucuuuggguccca

SEQ ID NO: 24132 - RNA, 21 nt, Artificial Sequence
  RNA Oligomer
uuccagcaucuucuuuaugcu

SEQ ID NO: 24133 - RNA, 21 nt, Artificial Sequence
  RNA Oligomer
cuucucccugaaggagaugag

SEQ ID NO: 24134 - RNA, 21 nt, Artificial Sequence
  RNA Oligomer
aacugaggcuuucuugcuugu

SEQ ID NO: 24135 - RNA, 21 nt, Artificial Sequence
  RNA Oligomer
cuucuccagcuuguucuugag

SEQ ID NO: 24136 - RNA, 21 nt, Artificial Sequence
  RNA Oligomer
caaggcugccuucuucaucag

SEQ ID NO: 24137 - RNA, 21 nt, Artificial Sequence
  RNA Oligomer
uuccuucaggaucuugcugca

SEQ ID NO: 24138 - RNA, 21 nt, Artificial Sequence
  RNA Oligomer
guucuccaggaagagcuucac

SEQ ID NO: 24139 - RNA, 21 nt, Artificial Sequence
  RNA Oligomer
uaaugucuuggguuuuaccac

SEQ ID NO: 24140 - RNA, 21 nt, Artificial Sequence
  RNA Oligomer
cuuccagcaucuucuuuaugc

SEQ ID NO: 24141 - RNA, 21 nt, Artificial Sequence
  RNA Oligomer
caguuccuucaggaucuugcu

SEQ ID NO: 24142 - RNA, 21 nt, Artificial Sequence
  RNA Oligomer
uccagcaucuucuuuaugcuc

SEQ ID NO: 24143 - RNA, 21 nt, Artificial Sequence
  RNA Oligomer
ucuccuucagguagaucuccc

SEQ ID NO: 24144 - RNA, 21 nt, Artificial Sequence
  RNA Oligomer
cucugagcccagaugauuccu

SEQ ID NO: 24145 - RNA, 21 nt, Artificial Sequence
  RNA Oligomer
acugaggcuuucuugcuuguc

SEQ ID NO: 24146 - RNA, 21 nt, Artificial Sequence
  RNA Oligomer
uuggccauccucauccaguau

SEQ ID NO: 24147 - RNA, 21 nt, Artificial Sequence
  RNA Oligomer
gucaccgagaucaagagauug

SEQ ID NO: 24148 - RNA, 21 nt, Artificial Sequence
  RNA Oligomer
uuucaaaagacggccagugcu

SEQ ID NO: 24149 - RNA, 21 nt, Artificial Sequence
  RNA Oligomer
uucaaaagacggccagugcuc

SEQ ID NO: 24150 - RNA, 21 nt, Artificial Sequence
  RNA Oligomer
gaacugaggcuuucuugcuug

SEQ ID NO: 24151 - RNA, 21 nt, Artificial Sequence
  RNA Oligomer
ccauauauuauaccaguugcu

SEQ ID NO: 24152 - RNA, 21 nt, Artificial Sequence
  RNA Oligomer
gcacuucucaacaaauuuaca

SEQ ID NO: 24153 - RNA, 21 nt, Artificial Sequence
  RNA Oligomer
ccaugaugaguucuguacaaa

SEQ ID NO: 24154 - RNA, 21 nt, Artificial Sequence
  RNA Oligomer
ggcggugaaguuagauuacau

SEQ ID NO: 24155 - RNA, 21 nt, Artificial Sequence
  RNA Oligomer
ggcucugaggauguugguacu

SEQ ID NO: 24156 - RNA, 21 nt, Artificial Sequence
  RNA Oligomer
ccagacauuaacuucaaucga

SEQ ID NO: 24157 - RNA, 21 nt, Artificial Sequence
  RNA Oligomer
cugaauguagaaugcagaaau

SEQ ID NO: 24158 - RNA, 21 nt, Artificial Sequence
  RNA Oligomer
ggaaauauuucuagccugaau

SEQ ID NO: 24159 - RNA, 21 nt, Artificial Sequence
  RNA Oligomer
ccagguuuugaugaacaagaa

SEQ ID NO: 24160 - RNA, 21 nt, Artificial Sequence
  RNA Oligomer
cacucaacucuuaauaugcuu

SEQ ID NO: 24161 - RNA, 21 nt, Artificial Sequence
  RNA Oligomer
gcaauguguaaguggcaaaau

SEQ ID NO: 24162 - RNA, 21 nt, Artificial Sequence
  RNA Oligomer
guacaucuaaacucccuccau

SEQ ID NO: 24163 - RNA, 21 nt, Artificial Sequence
  RNA Oligomer
ccauucauauaccaugcuguc

SEQ ID NO: 24164 - RNA, 21 nt, Artificial Sequence
  RNA Oligomer
ggcaugcuacagguggauuuu

SEQ ID NO: 24165 - RNA, 21 nt, Artificial Sequence
  RNA Oligomer
ccacgacgaaaugcuaagaug

SEQ ID NO: 24166 - RNA, 21 nt, Artificial Sequence
  RNA Oligomer
ggauggacacuaaaggaauca

SEQ ID NO: 24167 - RNA, 21 nt, Artificial Sequence
  RNA Oligomer
acaguaacuauucggguagau

SEQ ID NO: 24168 - RNA, 21 nt, Artificial Sequence
  RNA Oligomer
gcggugaaguuagauuacauu

SEQ ID NO: 24169 - RNA, 21 nt, Artificial Sequence
  RNA Oligomer
ucacguggacuuagauauguu

SEQ ID NO: 24170 - RNA, 21 nt, Artificial Sequence
  RNA Oligomer
ucagaauugaugagagacauu

SEQ ID NO: 24171 - RNA, 21 nt, Artificial Sequence
  RNA Oligomer
gcggaaucagaaaguuuggau

SEQ ID NO: 24172 - RNA, 21 nt, Artificial Sequence
  RNA Oligomer
cuaaaccuuuuccaacacauu

SEQ ID NO: 24173 - RNA, 21 nt, Artificial Sequence
  RNA Oligomer
ccuaaaccuuuuccaacacau

SEQ ID NO: 24174 - RNA, 21 nt, Artificial Sequence
  RNA Oligomer
uggcaaaaugaagggaaacac

SEQ ID NO: 24175 - RNA, 21 nt, Artificial Sequence
  RNA Oligomer
caggaaucucuuuaacugauu

SEQ ID NO: 24176 - RNA, 21 nt, Artificial Sequence
  RNA Oligomer
gacauuaacuucaaucgauug

SEQ ID NO: 24177 - RNA, 21 nt, Artificial Sequence
  RNA Oligomer
cuaagaugaaaucggaguauu

SEQ ID NO: 24178 - RNA, 21 nt, Artificial Sequence
  RNA Oligomer
ccaaaacuugaaggaugcuau

SEQ ID NO: 24179 - RNA, 21 nt, Artificial Sequence
  RNA Oligomer
gaagaaaagaacagugggaaa

SEQ ID NO: 24180 - RNA, 21 nt, Artificial Sequence
  RNA Oligomer
gcuaaacuaccuggaaauauu

SEQ ID NO: 24181 - RNA, 21 nt, Artificial Sequence
  RNA Oligomer
cggugaaguuagauuacauuu

SEQ ID NO: 24182 - RNA, 21 nt, Artificial Sequence
  RNA Oligomer
gguuuugaugaacaagaagau

SEQ ID NO: 24183 - RNA, 21 nt, Artificial Sequence
  RNA Oligomer
gcucugaggauguugguacug

SEQ ID NO: 24184 - RNA, 21 nt, Artificial Sequence
  RNA Oligomer
gaauagagacaaucaacaguu

SEQ ID NO: 24185 - RNA, 21 nt, Artificial Sequence
  RNA Oligomer
gcuugaggcauauucauauaa

SEQ ID NO: 24186 - RNA, 21 nt, Artificial Sequence
  RNA Oligomer
gucugucuuuuuuccucugau

SEQ ID NO: 24187 - RNA, 21 nt, Artificial Sequence
  RNA Oligomer
ccuuccacucaacucuuaaua

SEQ ID NO: 24188 - RNA, 21 nt, Artificial Sequence
  RNA Oligomer
aaguggcaaaaugaagggaaa

SEQ ID NO: 24189 - RNA, 21 nt, Artificial Sequence
  RNA Oligomer
gccaggaaacaaguugaaauc

SEQ ID NO: 24190 - RNA, 21 nt, Artificial Sequence
  RNA Oligomer
cacguggacuuagauauguuu

SEQ ID NO: 24191 - RNA, 21 nt, Artificial Sequence
  RNA Oligomer
gcaggacuugugcaagaagaa

SEQ ID NO: 24192 - RNA, 21 nt, Artificial Sequence
  RNA Oligomer
cgauugcaugucacuuacgaa

SEQ ID NO: 24193 - RNA, 21 nt, Artificial Sequence
  RNA Oligomer
cagacauuaacuucaaucgau

SEQ ID NO: 24194 - RNA, 21 nt, Artificial Sequence
  RNA Oligomer
gcuaagaugaaaucggaguau

SEQ ID NO: 24195 - RNA, 21 nt, Artificial Sequence
  RNA Oligomer
ugcuaagaugaaaucggagua

SEQ ID NO: 24196 - RNA, 21 nt, Artificial Sequence
  RNA Oligomer
cacgacgaaaugcuaagauga

SEQ ID NO: 24197 - RNA, 21 nt, Artificial Sequence
  RNA Oligomer
cggaaucagaaaguuuggaua

SEQ ID NO: 24198 - RNA, 21 nt, Artificial Sequence
  RNA Oligomer
gcagaagcucaacauuuauau

SEQ ID NO: 24199 - RNA, 21 nt, Artificial Sequence
  RNA Oligomer
ggaugcuauucugaaauacaa

SEQ ID NO: 24200 - RNA, 21 nt, Artificial Sequence
  RNA Oligomer
gaaauauuucuagccugaaug

SEQ ID NO: 24201 - RNA, 21 nt, Artificial Sequence
  RNA Oligomer
cuaagggcggugaaguuagau

SEQ ID NO: 24202 - RNA, 21 nt, Artificial Sequence
  RNA Oligomer
gaagagaauagagacaaucaa

SEQ ID NO: 24203 - RNA, 21 nt, Artificial Sequence
  RNA Oligomer
ccacucaacucuuaauaugcu

SEQ ID NO: 24204 - RNA, 21 nt, Artificial Sequence
  RNA Oligomer
acguggacuuagauauguuuu

SEQ ID NO: 24205 - RNA, 21 nt, Artificial Sequence
  RNA Oligomer
gcuuuauccauucauauacca

SEQ ID NO: 24206 - RNA, 21 nt, Artificial Sequence
  RNA Oligomer
cgauuguuugagggacguuca

SEQ ID NO: 24207 - RNA, 21 nt, Artificial Sequence
  RNA Oligomer
acgacgaaaugcuaagaugaa

SEQ ID NO: 24208 - RNA, 21 nt, Artificial Sequence
  RNA Oligomer
uccacgacgaaaugcuaagau

SEQ ID NO: 24209 - RNA, 21 nt, Artificial Sequence
  RNA Oligomer
caagaauagaauccaugauga

SEQ ID NO: 24210 - RNA, 21 nt, Artificial Sequence
  RNA Oligomer
gaaacagaagaugaaucauuc

SEQ ID NO: 24211 - RNA, 21 nt, Artificial Sequence
  RNA Oligomer
gcuuugaucgauuucugggau

SEQ ID NO: 24212 - RNA, 21 nt, Artificial Sequence
  RNA Oligomer
gaaggaugcuauucugaaaua

SEQ ID NO: 24213 - RNA, 21 nt, Artificial Sequence
  RNA Oligomer
uuggauggacacuaaaggaau

SEQ ID NO: 24214 - RNA, 21 nt, Artificial Sequence
  RNA Oligomer
acacaguaacuauucggguag

SEQ ID NO: 24215 - RNA, 21 nt, Artificial Sequence
  RNA Oligomer
ccauugaggagaugagaagaa

SEQ ID NO: 24216 - RNA, 21 nt, Artificial Sequence
  RNA Oligomer
ccagauaagaaguggcuugga

SEQ ID NO: 24217 - RNA, 21 nt, Artificial Sequence
  RNA Oligomer
caaacaaaagacuauuaccag

SEQ ID NO: 24218 - RNA, 21 nt, Artificial Sequence
  RNA Oligomer
acaaguccagguuuugaugaa

SEQ ID NO: 24219 - RNA, 21 nt, Artificial Sequence
  RNA Oligomer
ccauuugagaaggaaagugaa

SEQ ID NO: 24220 - RNA, 21 nt, Artificial Sequence
  RNA Oligomer
gacaacaaauugacuagacaa

SEQ ID NO: 24221 - RNA, 21 nt, Artificial Sequence
  RNA Oligomer
agauguuggcucugaggaugu

SEQ ID NO: 24222 - RNA, 21 nt, Artificial Sequence
  RNA Oligomer
gagaauagagacaaucaacag

SEQ ID NO: 24223 - RNA, 21 nt, Artificial Sequence
  RNA Oligomer
ugaagagaauagagacaauca

SEQ ID NO: 24224 - RNA, 21 nt, Artificial Sequence
  RNA Oligomer
ucuuuuuuccucugaucagua

SEQ ID NO: 24225 - RNA, 21 nt, Artificial Sequence
  RNA Oligomer
gccuuccacucaacucuuaau

SEQ ID NO: 24226 - RNA, 21 nt, Artificial Sequence
  RNA Oligomer
acaucuaaacucccuccaucc

SEQ ID NO: 24227 - RNA, 21 nt, Artificial Sequence
  RNA Oligomer
cagcaauguguaaguggcaaa

SEQ ID NO: 24228 - RNA, 21 nt, Artificial Sequence
  RNA Oligomer
cugucagguguaauauaugaa

SEQ ID NO: 24229 - RNA, 21 nt, Artificial Sequence
  RNA Oligomer
uccauucauauaccaugcugu

SEQ ID NO: 24230 - RNA, 21 nt, Artificial Sequence
  RNA Oligomer
cuacgauacuacaaugaagaa

SEQ ID NO: 24231 - RNA, 21 nt, Artificial Sequence
  RNA Oligomer
ccgcuuuuuaaucaauccuga

SEQ ID NO: 24232 - RNA, 21 nt, Artificial Sequence
  RNA Oligomer
caaggcaugcuacagguggau

SEQ ID NO: 24233 - RNA, 21 nt, Artificial Sequence
  RNA Oligomer
caugaugaguucuguacaaaa

SEQ ID NO: 24234 - RNA, 21 nt, Artificial Sequence
  RNA Oligomer
cccagacauuaacuucaaucg

SEQ ID NO: 24235 - RNA, 21 nt, Artificial Sequence
  RNA Oligomer
acccagacauuaacuucaauc

SEQ ID NO: 24236 - RNA, 21 nt, Artificial Sequence
  RNA Oligomer
uacccagacauuaacuucaau

SEQ ID NO: 24237 - RNA, 21 nt, Artificial Sequence
  RNA Oligomer
ggaacagauugccagucuuuu

SEQ ID NO: 24238 - RNA, 21 nt, Artificial Sequence
  RNA Oligomer
aggaacagauugccagucuuu

SEQ ID NO: 24239 - RNA, 21 nt, Artificial Sequence
  RNA Oligomer
gcaggaacagauugccagucu

SEQ ID NO: 24240 - RNA, 21 nt, Artificial Sequence
  RNA Oligomer
acaagaauagaauccaugaug

SEQ ID NO: 24241 - RNA, 21 nt, Artificial Sequence
  RNA Oligomer
ggaaucagaaaguuuggauag

SEQ ID NO: 24242 - RNA, 21 nt, Artificial Sequence
  RNA Oligomer
cugaaauacaauguggcauau

SEQ ID NO: 24243 - RNA, 21 nt, Artificial Sequence
  RNA Oligomer
caaaauuuguacccaguggaa

SEQ ID NO: 24244 - RNA, 21 nt, Artificial Sequence
  RNA Oligomer
uccuaaaccuuuuccaacaca

SEQ ID NO: 24245 - RNA, 21 nt, Artificial Sequence
  RNA Oligomer
guaacuauucggguagaucuu

SEQ ID NO: 24246 - RNA, 21 nt, Artificial Sequence
  RNA Oligomer
agaagaaaagaacagugggaa

SEQ ID NO: 24247 - RNA, 21 nt, Artificial Sequence
  RNA Oligomer
gcagaaauucuaagcaacaug

SEQ ID NO: 24248 - RNA, 21 nt, Artificial Sequence
  RNA Oligomer
ugcuaaacuaccuggaaauau

SEQ ID NO: 24249 - RNA, 21 nt, Artificial Sequence
  RNA Oligomer
augcuaaacuaccuggaaaua

SEQ ID NO: 24250 - RNA, 21 nt, Artificial Sequence
  RNA Oligomer
gucgcacuggaaugaaugauu

SEQ ID NO: 24251 - RNA, 21 nt, Artificial Sequence
  RNA Oligomer
gccaccucgcuuguuuucaaa

SEQ ID NO: 24252 - RNA, 21 nt, Artificial Sequence
  RNA Oligomer
ccgauggauguggauaauucu

SEQ ID NO: 24253 - RNA, 21 nt, Artificial Sequence
  RNA Oligomer
caaauugacuagacaagaaag

SEQ ID NO: 24254 - RNA, 21 nt, Artificial Sequence
  RNA Oligomer
ccagaagugcagcaagucuug

SEQ ID NO: 24255 - RNA, 21 nt, Artificial Sequence
  RNA Oligomer
cugucuuuuuuccucugauca

SEQ ID NO: 24256 - RNA, 21 nt, Artificial Sequence
  RNA Oligomer
ucaacucuuaauaugcuugca

SEQ ID NO: 24257 - RNA, 21 nt, Artificial Sequence
  RNA Oligomer
uccugcccauauauuauacca

SEQ ID NO: 24258 - RNA, 21 nt, Artificial Sequence
  RNA Oligomer
cuaaacucccuccauccugac

SEQ ID NO: 24259 - RNA, 21 nt, Artificial Sequence
  RNA Oligomer
agcaauguguaaguggcaaaa

SEQ ID NO: 24260 - RNA, 21 nt, Artificial Sequence
  RNA Oligomer
gguacaucuaaacucccucca

SEQ ID NO: 24261 - RNA, 21 nt, Artificial Sequence
  RNA Oligomer
ggaccagacaucaagcuuuau

SEQ ID NO: 24262 - RNA, 21 nt, Artificial Sequence
  RNA Oligomer
gguuaaaagccuuaauacaga

SEQ ID NO: 24263 - RNA, 21 nt, Artificial Sequence
  RNA Oligomer
cgaagaugggagugaaaggga

SEQ ID NO: 24264 - RNA, 21 nt, Artificial Sequence
  RNA Oligomer
cgcuuuuuaaucaauccugag

SEQ ID NO: 24265 - RNA, 21 nt, Artificial Sequence
  RNA Oligomer
gcaaaucguuuuguuggaggu

SEQ ID NO: 24266 - RNA, 21 nt, Artificial Sequence
  RNA Oligomer
uccaugaugaguucuguacaa

SEQ ID NO: 24267 - RNA, 21 nt, Artificial Sequence
  RNA Oligomer
uuacccagacauuaacuucaa

SEQ ID NO: 24268 - RNA, 21 nt, Artificial Sequence
  RNA Oligomer
gaaaucggaguauucuaguua

SEQ ID NO: 24269 - RNA, 21 nt, Artificial Sequence
  RNA Oligomer
gaacagauugccagucuuuua

SEQ ID NO: 24270 - RNA, 21 nt, Artificial Sequence
  RNA Oligomer
caggaacagauugccagucuu

SEQ ID NO: 24271 - RNA, 21 nt, Artificial Sequence
  RNA Oligomer
ccaauaccacuccugaaacag

SEQ ID NO: 24272 - RNA, 21 nt, Artificial Sequence
  RNA Oligomer
ugaaggaugcuauucugaaau

SEQ ID NO: 24273 - RNA, 21 nt, Artificial Sequence
  RNA Oligomer
caaaacuugaaggaugcuauu

SEQ ID NO: 24274 - RNA, 21 nt, Artificial Sequence
  RNA Oligomer
agaacaaaauuuguacccagu

SEQ ID NO: 24275 - RNA, 21 nt, Artificial Sequence
  RNA Oligomer
ggacacuaaaggaaucaagac

SEQ ID NO: 24276 - RNA, 21 nt, Artificial Sequence
  RNA Oligomer
caguaacuauucggguagauc

SEQ ID NO: 24277 - RNA, 21 nt, Artificial Sequence
  RNA Oligomer
guggugggaaagugaacgaau

SEQ ID NO: 24278 - RNA, 21 nt, Artificial Sequence
  RNA Oligomer
ccuaaauacguuccaccucac

SEQ ID NO: 24279 - RNA, 21 nt, Artificial Sequence
  RNA Oligomer
ggaagaucccuaaauacguuc

SEQ ID NO: 24280 - RNA, 21 nt, Artificial Sequence
  RNA Oligomer
cuagccugaauguagaaugca

SEQ ID NO: 24281 - RNA, 21 nt, Artificial Sequence
  RNA Oligomer
uaaaugcuaaacuaccuggaa

SEQ ID NO: 24282 - RNA, 21 nt, Artificial Sequence
  RNA Oligomer
caagagacgcugacauugaau

SEQ ID NO: 24283 - RNA, 21 nt, Artificial Sequence
  RNA Oligomer
guuccucccaaacagcaaaua

SEQ ID NO: 24284 - RNA, 21 nt, Artificial Sequence
  RNA Oligomer
agguuagugaaaugaggcucu

SEQ ID NO: 24285 - RNA, 21 nt, Artificial Sequence
  RNA Oligomer
ccauugucagauguuggcucu

SEQ ID NO: 24286 - RNA, 21 nt, Artificial Sequence
  RNA Oligomer
gcaagaugagauagauguggu

SEQ ID NO: 24287 - RNA, 21 nt, Artificial Sequence
  RNA Oligomer
aaagugaaccucaaacaguaa

SEQ ID NO: 24288 - RNA, 21 nt, Artificial Sequence
  RNA Oligomer
ugcucuuuaagugugucuaua

SEQ ID NO: 24289 - RNA, 21 nt, Artificial Sequence
  RNA Oligomer
acguaugcucuuuaagugugu

SEQ ID NO: 24290 - RNA, 21 nt, Artificial Sequence
  RNA Oligomer
agaaacucccauaucaucuau

SEQ ID NO: 24291 - RNA, 21 nt, Artificial Sequence
  RNA Oligomer
ggagcagcuuuuggaaaguga

SEQ ID NO: 24292 - RNA, 21 nt, Artificial Sequence
  RNA Oligomer
cuuccacucaacucuuaauau

SEQ ID NO: 24293 - RNA, 21 nt, Artificial Sequence
  RNA Oligomer
ucuuucuuccugcccauauau

SEQ ID NO: 24294 - RNA, 21 nt, Artificial Sequence
  RNA Oligomer
guggacuuagauauguuuugu

SEQ ID NO: 24295 - RNA, 21 nt, Artificial Sequence
  RNA Oligomer
ucauauaccaugcugucgagu

SEQ ID NO: 24296 - RNA, 21 nt, Artificial Sequence
  RNA Oligomer
acaaugaagaaugcagaaacu

SEQ ID NO: 24297 - RNA, 21 nt, Artificial Sequence
  RNA Oligomer
cagaauugaugagagacauuu

SEQ ID NO: 24298 - RNA, 21 nt, Artificial Sequence
  RNA Oligomer
ugaacaaggcuuacuguggau

SEQ ID NO: 24299 - RNA, 21 nt, Artificial Sequence
  RNA Oligomer
agaugaaaucggaguauucua

SEQ ID NO: 24300 - RNA, 21 nt, Artificial Sequence
  RNA Oligomer
uaagaugaaaucggaguauuc

SEQ ID NO: 24301 - RNA, 21 nt, Artificial Sequence
  RNA Oligomer
gacagcggaaucagaaaguuu

SEQ ID NO: 24302 - RNA, 21 nt, Artificial Sequence
  RNA Oligomer
cuuugaucgauuucugggaua

SEQ ID NO: 24303 - RNA, 21 nt, Artificial Sequence
  RNA Oligomer
cuuuacagcuuugaucgauuu

SEQ ID NO: 24304 - RNA, 21 nt, Artificial Sequence
  RNA Oligomer
ucugaaauacaauguggcaua

SEQ ID NO: 24305 - RNA, 21 nt, Artificial Sequence
  RNA Oligomer
ucauucagacugcacuucuca

SEQ ID NO: 24306 - RNA, 21 nt, Artificial Sequence
  RNA Oligomer
acaaaauuuguacccagugga

SEQ ID NO: 24307 - RNA, 21 nt, Artificial Sequence
  RNA Oligomer
gaacaaaauuuguacccagug

SEQ ID NO: 24308 - RNA, 21 nt, Artificial Sequence
  RNA Oligomer
gauggacacuaaaggaaucaa

SEQ ID NO: 24309 - RNA, 21 nt, Artificial Sequence
  RNA Oligomer
cggguagaucuuuugcgagca

SEQ ID NO: 24310 - RNA, 21 nt, Artificial Sequence
  RNA Oligomer
cacaguaacuauucggguaga

SEQ ID NO: 24311 - RNA, 21 nt, Artificial Sequence
  RNA Oligomer
gguggugggaaagugaacgaa

SEQ ID NO: 24312 - RNA, 21 nt, Artificial Sequence
  RNA Oligomer
cacacaguaacuauucgggua

SEQ ID NO: 24313 - RNA, 21 nt, Artificial Sequence
  RNA Oligomer
ucacacaguaacuauucgggu

SEQ ID NO: 24314 - RNA, 21 nt, Artificial Sequence
  RNA Oligomer
cccuaaauacguuccaccuca

SEQ ID NO: 24315 - RNA, 21 nt, Artificial Sequence
  RNA Oligomer
ccaaacaucaaagaacagaaa

SEQ ID NO: 24316 - RNA, 21 nt, Artificial Sequence
  RNA Oligomer
ggacagaagaaaagaacagug

SEQ ID NO: 24317 - RNA, 21 nt, Artificial Sequence
  RNA Oligomer
aaugcuaaacuaccuggaaau

SEQ ID NO: 24318 - RNA, 21 nt, Artificial Sequence
  RNA Oligomer
agagagucgcacuggaaugaa

SEQ ID NO: 24319 - RNA, 21 nt, Artificial Sequence
  RNA Oligomer
gggcggugaaguuagauuaca

SEQ ID NO: 24320 - RNA, 21 nt, Artificial Sequence
  RNA Oligomer
cuacuaagggcggugaaguua

SEQ ID NO: 24321 - RNA, 21 nt, Artificial Sequence
  RNA Oligomer
gcugacauugaauuuaggaaa

SEQ ID NO: 24322 - RNA, 21 nt, Artificial Sequence
  RNA Oligomer
agagacgcugacauugaauuu

SEQ ID NO: 24323 - RNA, 21 nt, Artificial Sequence
  RNA Oligomer
cagguuuugaugaacaagaag

SEQ ID NO: 24324 - RNA, 21 nt, Artificial Sequence
  RNA Oligomer
gucaagacucagaagcagaug

SEQ ID NO: 24325 - RNA, 21 nt, Artificial Sequence
  RNA Oligomer
cgauggauguggauaauucua

SEQ ID NO: 24326 - RNA, 21 nt, Artificial Sequence
  RNA Oligomer
caacaaauugacuagacaaga

SEQ ID NO: 24327 - RNA, 21 nt, Artificial Sequence
  RNA Oligomer
ugucagcaagaugagauagau

SEQ ID NO: 24328 - RNA, 21 nt, Artificial Sequence
  RNA Oligomer
gaagaugaacaggccagagaa

SEQ ID NO: 24329 - RNA, 21 nt, Artificial Sequence
  RNA Oligomer
gugaagagaauagagacaauc

SEQ ID NO: 24330 - RNA, 21 nt, Artificial Sequence
  RNA Oligomer
cuaaauaaaauuggacuggug

SEQ ID NO: 24331 - RNA, 21 nt, Artificial Sequence
  RNA Oligomer
gcucuuuaagugugucuauau

SEQ ID NO: 24332 - RNA, 21 nt, Artificial Sequence
  RNA Oligomer
augcucuuuaagugugucuau

SEQ ID NO: 24333 - RNA, 21 nt, Artificial Sequence
  RNA Oligomer
gaaacucccauaucaucuaua

SEQ ID NO: 24334 - RNA, 21 nt, Artificial Sequence
  RNA Oligomer
agaugaaaggaaauguggaau

SEQ ID NO: 24335 - RNA, 21 nt, Artificial Sequence
  RNA Oligomer
ccuccuagguuaaaauaguuu

SEQ ID NO: 24336 - RNA, 21 nt, Artificial Sequence
  RNA Oligomer
ggcaaaaugaagggaaacaca

SEQ ID NO: 24337 - RNA, 21 nt, Artificial Sequence
  RNA Oligomer
caaguugaaauccaggaaucu

SEQ ID NO: 24338 - RNA, 21 nt, Artificial Sequence
  RNA Oligomer
acaaguugaaauccaggaauc

SEQ ID NO: 24339 - RNA, 21 nt, Artificial Sequence
  RNA Oligomer
aaacaaguugaaauccaggaa

SEQ ID NO: 24340 - RNA, 21 nt, Artificial Sequence
  RNA Oligomer
gucaguugguacaucuaaacu

SEQ ID NO: 24341 - RNA, 21 nt, Artificial Sequence
  RNA Oligomer
gcagcaauguguaaguggcaa

SEQ ID NO: 24342 - RNA, 21 nt, Artificial Sequence
  RNA Oligomer
gaaaggaaacucacuguugga

SEQ ID NO: 24343 - RNA, 21 nt, Artificial Sequence
  RNA Oligomer
gcaugcuacagguggauuuug

SEQ ID NO: 24344 - RNA, 21 nt, Artificial Sequence
  RNA Oligomer
aggcaugcuacagguggauuu

SEQ ID NO: 24345 - RNA, 21 nt, Artificial Sequence
  RNA Oligomer
ccuacuggguuggugacauuu

SEQ ID NO: 24346 - RNA, 21 nt, Artificial Sequence
  RNA Oligomer
aucgauuguuugagggacguu

SEQ ID NO: 24347 - RNA, 21 nt, Artificial Sequence
  RNA Oligomer
cgacgaaaugcuaagaugaaa

SEQ ID NO: 24348 - RNA, 21 nt, Artificial Sequence
  RNA Oligomer
gaauagaauccaugaugaguu

SEQ ID NO: 24349 - RNA, 21 nt, Artificial Sequence
  RNA Oligomer
caacauuuauaucaguccauc

SEQ ID NO: 24350 - RNA, 21 nt, Artificial Sequence
  RNA Oligomer
ugggauaagguacuugaagaa

SEQ ID NO: 24351 - RNA, 21 nt, Artificial Sequence
  RNA Oligomer
aggaugcuauucugaaauaca

SEQ ID NO: 24352 - RNA, 21 nt, Artificial Sequence
  RNA Oligomer
gcucauucagacugcacuucu

SEQ ID NO: 24353 - RNA, 21 nt, Artificial Sequence
  RNA Oligomer
uggacacuaaaggaaucaaga

SEQ ID NO: 24354 - RNA, 21 nt, Artificial Sequence
  RNA Oligomer
uuccuaaaccuuuuccaacac

SEQ ID NO: 24355 - RNA, 21 nt, Artificial Sequence
  RNA Oligomer
ggguagaucuuuugcgagcag

SEQ ID NO: 24356 - RNA, 21 nt, Artificial Sequence
  RNA Oligomer
cacagaucauuucaugagacu

SEQ ID NO: 24357 - RNA, 21 nt, Artificial Sequence
  RNA Oligomer
gaaagugaacgaaucccgaau

SEQ ID NO: 24358 - RNA, 21 nt, Artificial Sequence
  RNA Oligomer
agggcggugaaguuagauuac

SEQ ID NO: 24359 - RNA, 21 nt, Artificial Sequence
  RNA Oligomer
uaggaaacgguacucuacuaa

SEQ ID NO: 24360 - RNA, 21 nt, Artificial Sequence
  RNA Oligomer
augaacaagaagaugguaguu

SEQ ID NO: 24361 - RNA, 21 nt, Artificial Sequence
  RNA Oligomer
ccaucucucucagguuaguga

SEQ ID NO: 24362 - RNA, 21 nt, Artificial Sequence
  RNA Oligomer
cagcaagaugagauagaugug

SEQ ID NO: 24363 - RNA, 21 nt, Artificial Sequence
  RNA Oligomer
gucagcaagaugagauagaug

SEQ ID NO: 24364 - RNA, 21 nt, Artificial Sequence
  RNA Oligomer
gacaaucaacaguuucucaca

SEQ ID NO: 24365 - RNA, 21 nt, Artificial Sequence
  RNA Oligomer
guaugcucuuuaagugugucu

SEQ ID NO: 24366 - RNA, 21 nt, Artificial Sequence
  RNA Oligomer
cguaugcucuuuaaguguguc

SEQ ID NO: 24367 - RNA, 21 nt, Artificial Sequence
  RNA Oligomer
ugucagaaacucccauaucau

SEQ ID NO: 24368 - RNA, 21 nt, Artificial Sequence
  RNA Oligomer
gagcagcuuuuggaaagugaa

SEQ ID NO: 24369 - RNA, 21 nt, Artificial Sequence
  RNA Oligomer
gcugauuuguacauauugaag

SEQ ID NO: 24370 - RNA, 21 nt, Artificial Sequence
  RNA Oligomer
ucugucuuuuuuccucugauc

SEQ ID NO: 24371 - RNA, 21 nt, Artificial Sequence
  RNA Oligomer
gcauaaugcaaaccuccuagg

SEQ ID NO: 24372 - RNA, 21 nt, Artificial Sequence
  RNA Oligomer
uugcuaaaaaucucccuguga

SEQ ID NO: 24373 - RNA, 21 nt, Artificial Sequence
  RNA Oligomer
ugccaggaaacaaguugaaau

SEQ ID NO: 24374 - RNA, 21 nt, Artificial Sequence
  RNA Oligomer
ugcaguugucaguugguacau

SEQ ID NO: 24375 - RNA, 21 nt, Artificial Sequence
  RNA Oligomer
cgcaaucucuuccacacaugu

SEQ ID NO: 24376 - RNA, 21 nt, Artificial Sequence
  RNA Oligomer
agcuuuauccauucauauacc

SEQ ID NO: 24377 - RNA, 21 nt, Artificial Sequence
  RNA Oligomer
acgauacuacaaugaagaaug

SEQ ID NO: 24378 - RNA, 21 nt, Artificial Sequence
  RNA Oligomer
gcuacgauacuacaaugaaga

SEQ ID NO: 24379 - RNA, 21 nt, Artificial Sequence
  RNA Oligomer
caaggcuuacuguggauuucu

SEQ ID NO: 24380 - RNA, 21 nt, Artificial Sequence
  RNA Oligomer
gaacaaggcuuacuguggauu

SEQ ID NO: 24381 - RNA, 21 nt, Artificial Sequence
  RNA Oligomer
ccugagaaaaugagacgcgag

SEQ ID NO: 24382 - RNA, 21 nt, Artificial Sequence
  RNA Oligomer
gugaaaaacccuugacacgau

SEQ ID NO: 24383 - RNA, 21 nt, Artificial Sequence
  RNA Oligomer
cuacuggguuggugacauuua

SEQ ID NO: 24384 - RNA, 21 nt, Artificial Sequence
  RNA Oligomer
gacgaaaugcuaagaugaaau

SEQ ID NO: 24385 - RNA, 21 nt, Artificial Sequence
  RNA Oligomer
cagccaauaccacuccugaaa

SEQ ID NO: 24386 - RNA, 21 nt, Artificial Sequence
  RNA Oligomer
ccugauauggugaaaauugca

SEQ ID NO: 24387 - RNA, 21 nt, Artificial Sequence
  RNA Oligomer
cgauuucugggauaagguacu

SEQ ID NO: 24388 - RNA, 21 nt, Artificial Sequence
  RNA Oligomer
gcauauucuaagaaaugggac

SEQ ID NO: 24389 - RNA, 21 nt, Artificial Sequence
  RNA Oligomer
ggcauauucuaagaaauggga

SEQ ID NO: 24390 - RNA, 21 nt, Artificial Sequence
  RNA Oligomer
caauguggcauauucuaagaa

SEQ ID NO: 24391 - RNA, 21 nt, Artificial Sequence
  RNA Oligomer
gcuauucugaaauacaaugug

SEQ ID NO: 24392 - RNA, 21 nt, Artificial Sequence
  RNA Oligomer
cauugaggagaugagaagaau

SEQ ID NO: 24393 - RNA, 21 nt, Artificial Sequence
  RNA Oligomer
agauaagaaguggcuuggaac

SEQ ID NO: 24394 - RNA, 21 nt, Artificial Sequence
  RNA Oligomer
cagauaagaaguggcuuggaa

SEQ ID NO: 24395 - RNA, 21 nt, Artificial Sequence
  RNA Oligomer
cgcacuggaaugaaugauuua

SEQ ID NO: 24396 - RNA, 21 nt, Artificial Sequence
  RNA Oligomer
agagucgcacuggaaugaaug

SEQ ID NO: 24397 - RNA, 21 nt, Artificial Sequence
  RNA Oligomer
aggaaacgguacucuacuaag

SEQ ID NO: 24398 - RNA, 21 nt, Artificial Sequence
  RNA Oligomer
ugaauuuaggaaacgguacuc

SEQ ID NO: 24399 - RNA, 21 nt, Artificial Sequence
  RNA Oligomer
acauugaauuuaggaaacggu

SEQ ID NO: 24400 - RNA, 21 nt, Artificial Sequence
  RNA Oligomer
acaagaaaguugccuaggaaa

SEQ ID NO: 24401 - RNA, 21 nt, Artificial Sequence
  RNA Oligomer
acaaucaacaguuucucacaa

SEQ ID NO: 24402 - RNA, 21 nt, Artificial Sequence
  RNA Oligomer
acagauagugaagagaauaga

SEQ ID NO: 24403 - RNA, 21 nt, Artificial Sequence
  RNA Oligomer
agagaaagcaggcgaguguuu

SEQ ID NO: 24404 - RNA, 21 nt, Artificial Sequence
  RNA Oligomer
cggagcagcuuuuggaaagug

SEQ ID NO: 24405 - RNA, 21 nt, Artificial Sequence
  RNA Oligomer
gaugaaaggaaauguggaaua

SEQ ID NO: 24406 - RNA, 21 nt, Artificial Sequence
  RNA Oligomer
aacaaguugaaauccaggaau

SEQ ID NO: 24407 - RNA, 21 nt, Artificial Sequence
  RNA Oligomer
cuuuuguccaucagaucucuu

SEQ ID NO: 24408 - RNA, 21 nt, Artificial Sequence
  RNA Oligomer
caauguguaaguggcaaaaug

SEQ ID NO: 24409 - RNA, 21 nt, Artificial Sequence
  RNA Oligomer
ugucaguugguacaucuaaac

SEQ ID NO: 24410 - RNA, 21 nt, Artificial Sequence
  RNA Oligomer
aguugucaguugguacaucua

SEQ ID NO: 24411 - RNA, 21 nt, Artificial Sequence
  RNA Oligomer
ugagcugucagguguaauaua

SEQ ID NO: 24412 - RNA, 21 nt, Artificial Sequence
  RNA Oligomer
caaugaagaaugcagaaacug

SEQ ID NO: 24413 - RNA, 21 nt, Artificial Sequence
  RNA Oligomer
gcaugcacauuuuccuuacug

SEQ ID NO: 24414 - RNA, 21 nt, Artificial Sequence
  RNA Oligomer
gcugagcgagaugugguuuau

SEQ ID NO: 24415 - RNA, 21 nt, Artificial Sequence
  RNA Oligomer
ugagaaaaugagacgcgagcu

SEQ ID NO: 24416 - RNA, 21 nt, Artificial Sequence
  RNA Oligomer
gaaugucuaauuaucacaggu

SEQ ID NO: 24417 - RNA, 21 nt, Artificial Sequence
  RNA Oligomer
uggugacauuuacaagacaga

SEQ ID NO: 24418 - RNA, 21 nt, Artificial Sequence
  RNA Oligomer
uaaaacgcucuucugcuacuu

SEQ ID NO: 24419 - RNA, 21 nt, Artificial Sequence
  RNA Oligomer
ugaaaucggaguauucuaguu

SEQ ID NO: 24420 - RNA, 21 nt, Artificial Sequence
  RNA Oligomer
gccaauaccacuccugaaaca

SEQ ID NO: 24421 - RNA, 21 nt, Artificial Sequence
  RNA Oligomer
agccaauaccacuccugaaac

SEQ ID NO: 24422 - RNA, 21 nt, Artificial Sequence
  RNA Oligomer
cauguuaaaaugccuuguuca

SEQ ID NO: 24423 - RNA, 21 nt, Artificial Sequence
  RNA Oligomer
agaucccuaaauacguuccac

SEQ ID NO: 24424 - RNA, 21 nt, Artificial Sequence
  RNA Oligomer
gaacagugggaaaccaaacau

SEQ ID NO: 24425 - RNA, 21 nt, Artificial Sequence
  RNA Oligomer
gaauuuaggaaacgguacucu

SEQ ID NO: 24426 - RNA, 21 nt, Artificial Sequence
  RNA Oligomer
cgcugacauugaauuuaggaa

SEQ ID NO: 24427 - RNA, 21 nt, Artificial Sequence
  RNA Oligomer
caagaugagauagauguggug

SEQ ID NO: 24428 - RNA, 21 nt, Artificial Sequence
  RNA Oligomer
cagauagugaagagaauagag

SEQ ID NO: 24429 - RNA, 21 nt, Artificial Sequence
  RNA Oligomer
ugaaguuucucugguauucaa

SEQ ID NO: 24430 - RNA, 21 nt, Artificial Sequence
  RNA Oligomer
cauauugaaguuucucuggua

SEQ ID NO: 24431 - RNA, 21 nt, Artificial Sequence
  RNA Oligomer
cugggaacuucaugcugauuu

SEQ ID NO: 24432 - RNA, 21 nt, Artificial Sequence
  RNA Oligomer
acugggaacuucaugcugauu

SEQ ID NO: 24433 - RNA, 21 nt, Artificial Sequence
  RNA Oligomer
aacugggaacuucaugcugau

SEQ ID NO: 24434 - RNA, 21 nt, Artificial Sequence
  RNA Oligomer
cacacggagcagcuuuuggaa

SEQ ID NO: 24435 - RNA, 21 nt, Artificial Sequence
  RNA Oligomer
ggacuaauguuucuuuugugg

SEQ ID NO: 24436 - RNA, 21 nt, Artificial Sequence
  RNA Oligomer
gcaguugucaguugguacauc

SEQ ID NO: 24437 - RNA, 21 nt, Artificial Sequence
  RNA Oligomer
acgcaaucucuuccacacaug

SEQ ID NO: 24438 - RNA, 21 nt, Artificial Sequence
  RNA Oligomer
agacugcagcaauguguaagu

SEQ ID NO: 24439 - RNA, 21 nt, Artificial Sequence
  RNA Oligomer
guuugagcugucagguguaau

SEQ ID NO: 24440 - RNA, 21 nt, Artificial Sequence
  RNA Oligomer
agagacguccuguuugagcug

SEQ ID NO: 24441 - RNA, 21 nt, Artificial Sequence
  RNA Oligomer
uggaccagacaucaagcuuua

SEQ ID NO: 24442 - RNA, 21 nt, Artificial Sequence
  RNA Oligomer
ggagauguguauaagcuguug

SEQ ID NO: 24443 - RNA, 21 nt, Artificial Sequence
  RNA Oligomer
uggagauguguauaagcuguu

SEQ ID NO: 24444 - RNA, 21 nt, Artificial Sequence
  RNA Oligomer
ugaguugauuauuucacggcu

SEQ ID NO: 24445 - RNA, 21 nt, Artificial Sequence
  RNA Oligomer
uccgcuuuuuaaucaauccug

SEQ ID NO: 24446 - RNA, 21 nt, Artificial Sequence
  RNA Oligomer
cagcuaagucuugauaaguca

SEQ ID NO: 24447 - RNA, 21 nt, Artificial Sequence
  RNA Oligomer
gcaugucacuuacgaagguac

SEQ ID NO: 24448 - RNA, 21 nt, Artificial Sequence
  RNA Oligomer
ugcaugucacuuacgaaggua

SEQ ID NO: 24449 - RNA, 21 nt, Artificial Sequence
  RNA Oligomer
ggugacauuuacaagacagag

SEQ ID NO: 24450 - RNA, 21 nt, Artificial Sequence
  RNA Oligomer
ccaucacaaugucgcaggaac

SEQ ID NO: 24451 - RNA, 21 nt, Artificial Sequence
  RNA Oligomer
cucaacauuuauaucagucca

SEQ ID NO: 24452 - RNA, 21 nt, Artificial Sequence
  RNA Oligomer
gaagcucaacauuuauaucag

SEQ ID NO: 24453 - RNA, 21 nt, Artificial Sequence
  RNA Oligomer
gauuucugggauaagguacuu

SEQ ID NO: 24454 - RNA, 21 nt, Artificial Sequence
  RNA Oligomer
gaucgauuucugggauaaggu

SEQ ID NO: 24455 - RNA, 21 nt, Artificial Sequence
  RNA Oligomer
acaauguggcauauucuaaga

SEQ ID NO: 24456 - RNA, 21 nt, Artificial Sequence
  RNA Oligomer
guagaucuuuugcgagcagga

SEQ ID NO: 24457 - RNA, 21 nt, Artificial Sequence
  RNA Oligomer
acguuccaccucaccuuucuc

SEQ ID NO: 24458 - RNA, 21 nt, Artificial Sequence
  RNA Oligomer
accaaacaucaaagaacagaa

SEQ ID NO: 24459 - RNA, 21 nt, Artificial Sequence
  RNA Oligomer
gagagucgcacuggaaugaau

SEQ ID NO: 24460 - RNA, 21 nt, Artificial Sequence
  RNA Oligomer
gugaaguuagauuacauuucc

SEQ ID NO: 24461 - RNA, 21 nt, Artificial Sequence
  RNA Oligomer
ggugaaguuagauuacauuuc

SEQ ID NO: 24462 - RNA, 21 nt, Artificial Sequence
  RNA Oligomer
uacucuacuaagggcggugaa

SEQ ID NO: 24463 - RNA, 21 nt, Artificial Sequence
  RNA Oligomer
guacucuacuaagggcgguga

SEQ ID NO: 24464 - RNA, 21 nt, Artificial Sequence
  RNA Oligomer
cauugaauuuaggaaacggua

SEQ ID NO: 24465 - RNA, 21 nt, Artificial Sequence
  RNA Oligomer
cugacauugaauuuaggaaac

SEQ ID NO: 24466 - RNA, 21 nt, Artificial Sequence
  RNA Oligomer
agacgcugacauugaauuuag

SEQ ID NO: 24467 - RNA, 21 nt, Artificial Sequence
  RNA Oligomer
gccagagaguccauugucaga

SEQ ID NO: 24468 - RNA, 21 nt, Artificial Sequence
  RNA Oligomer
ugccagagaguccauugucag

SEQ ID NO: 24469 - RNA, 21 nt, Artificial Sequence
  RNA Oligomer
accagaagugcagcaagucuu

SEQ ID NO: 24470 - RNA, 21 nt, Artificial Sequence
  RNA Oligomer
ggaagaugaacaggccagaga

SEQ ID NO: 24471 - RNA, 21 nt, Artificial Sequence
  RNA Oligomer
gagaaagcaggcgaguguuua

SEQ ID NO: 24472 - RNA, 21 nt, Artificial Sequence
  RNA Oligomer
acggagcagcuuuuggaaagu

SEQ ID NO: 24473 - RNA, 21 nt, Artificial Sequence
  RNA Oligomer
aggacuaauguuucuuuugug

SEQ ID NO: 24474 - RNA, 21 nt, Artificial Sequence
  RNA Oligomer
gagaugaaaggaaauguggaa

SEQ ID NO: 24475 - RNA, 21 nt, Artificial Sequence
  RNA Oligomer
gcaaaaugaagggaaacacac

SEQ ID NO: 24476 - RNA, 21 nt, Artificial Sequence
  RNA Oligomer
ugcccauauauuauaccaguu

SEQ ID NO: 24477 - RNA, 21 nt, Artificial Sequence
  RNA Oligomer
ugcagcaauguguaaguggca

SEQ ID NO: 24478 - RNA, 21 nt, Artificial Sequence
  RNA Oligomer
uugagcugucagguguaauau

SEQ ID NO: 24479 - RNA, 21 nt, Artificial Sequence
  RNA Oligomer
ugaagaaugcagaaacuguuc

SEQ ID NO: 24480 - RNA, 21 nt, Artificial Sequence
  RNA Oligomer
uugcuacgauacuacaaugaa

SEQ ID NO: 24481 - RNA, 21 nt, Artificial Sequence
  RNA Oligomer
cugagcgagaugugguuuauu

SEQ ID NO: 24482 - RNA, 21 nt, Artificial Sequence
  RNA Oligomer
gaaaaugagacgcgagcugaa

SEQ ID NO: 24483 - RNA, 21 nt, Artificial Sequence
  RNA Oligomer
agaaaaugagacgcgagcuga

SEQ ID NO: 24484 - RNA, 21 nt, Artificial Sequence
  RNA Oligomer
ugucuaauuaucacagguacu

SEQ ID NO: 24485 - RNA, 21 nt, Artificial Sequence
  RNA Oligomer
ugauuauuucacggcucuuca

SEQ ID NO: 24486 - RNA, 21 nt, Artificial Sequence
  RNA Oligomer
aggacuugugcaagaagaaau

SEQ ID NO: 24487 - RNA, 21 nt, Artificial Sequence
  RNA Oligomer
agaugugaaaaacccuugaca

SEQ ID NO: 24488 - RNA, 21 nt, Artificial Sequence
  RNA Oligomer
gacagagucuugaagauuuuc

SEQ ID NO: 24489 - RNA, 21 nt, Artificial Sequence
  RNA Oligomer
gaaaauguuucucagcuaagu

SEQ ID NO: 24490 - RNA, 21 nt, Artificial Sequence
  RNA Oligomer
aaaacgcucuucugcuacuuu

SEQ ID NO: 24491 - RNA, 21 nt, Artificial Sequence
  RNA Oligomer
ggaaaccggagaaacuuaaaa

SEQ ID NO: 24492 - RNA, 21 nt, Artificial Sequence
  RNA Oligomer
ugauauggugaaaauugcacu

SEQ ID NO: 24493 - RNA, 21 nt, Artificial Sequence
  RNA Oligomer
cauuuauaucaguccaucuug

SEQ ID NO: 24494 - RNA, 21 nt, Artificial Sequence
  RNA Oligomer
gggauaagguacuugaagaag

SEQ ID NO: 24495 - RNA, 21 nt, Artificial Sequence
  RNA Oligomer
uuaaaaugccuuguucagaac

SEQ ID NO: 24496 - RNA, 21 nt, Artificial Sequence
  RNA Oligomer
agaaauucuaagcaacaugga

SEQ ID NO: 24497 - RNA, 21 nt, Artificial Sequence
  RNA Oligomer
ccaauuugaaggaggagagag

SEQ ID NO: 24498 - RNA, 21 nt, Artificial Sequence
  RNA Oligomer
ugacauugaauuuaggaaacg

SEQ ID NO: 24499 - RNA, 21 nt, Artificial Sequence
  RNA Oligomer
acgcugacauugaauuuagga

SEQ ID NO: 24500 - RNA, 21 nt, Artificial Sequence
  RNA Oligomer
cagaagcagaugaggagacaa

SEQ ID NO: 24501 - RNA, 21 nt, Artificial Sequence
  RNA Oligomer
gagauagauguggugccagag

SEQ ID NO: 24502 - RNA, 21 nt, Artificial Sequence
  RNA Oligomer
gcaaguugucagcaagaugag

SEQ ID NO: 24503 - RNA, 21 nt, Artificial Sequence
  RNA Oligomer
cagaaacucccauaucaucua

SEQ ID NO: 24504 - RNA, 21 nt, Artificial Sequence
  RNA Oligomer
gagcgagaugugguuuauuuc

SEQ ID NO: 24505 - RNA, 21 nt, Artificial Sequence
  RNA Oligomer
ugagcgagaugugguuuauuu

SEQ ID NO: 24506 - RNA, 21 nt, Artificial Sequence
  RNA Oligomer
gccagguuaaaagccuuaaua

SEQ ID NO: 24507 - RNA, 21 nt, Artificial Sequence
  RNA Oligomer
aacaaggcuuacuguggauuu

SEQ ID NO: 24508 - RNA, 21 nt, Artificial Sequence
  RNA Oligomer
guugauuauuucacggcucuu

SEQ ID NO: 24509 - RNA, 21 nt, Artificial Sequence
  RNA Oligomer
gaagaaauccgcuuuuuaauc

SEQ ID NO: 24510 - RNA, 21 nt, Artificial Sequence
  RNA Oligomer
caggacuugugcaagaagaaa

SEQ ID NO: 24511 - RNA, 21 nt, Artificial Sequence
  RNA Oligomer
caaaucguuuuguuggaggug

SEQ ID NO: 24512 - RNA, 21 nt, Artificial Sequence
  RNA Oligomer
cgaagguaccauagaagaaaa

SEQ ID NO: 24513 - RNA, 21 nt, Artificial Sequence
  RNA Oligomer
gguuggugacauuuacaagac

SEQ ID NO: 24514 - RNA, 21 nt, Artificial Sequence
  RNA Oligomer
uggguuggugacauuuacaag

SEQ ID NO: 24515 - RNA, 21 nt, Artificial Sequence
  RNA Oligomer
cuggguuggugacauuuacaa

SEQ ID NO: 24516 - RNA, 21 nt, Artificial Sequence
  RNA Oligomer
aaaauguuucucagcuaaguc

SEQ ID NO: 24517 - RNA, 21 nt, Artificial Sequence
  RNA Oligomer
ugaugaguucuguacaaaaag

SEQ ID NO: 24518 - RNA, 21 nt, Artificial Sequence
  RNA Oligomer
aggaaaccggagaaacuuaaa

SEQ ID NO: 24519 - RNA, 21 nt, Artificial Sequence
  RNA Oligomer
agcucaacauuuauaucaguc

SEQ ID NO: 24520 - RNA, 21 nt, Artificial Sequence
  RNA Oligomer
cagaagcucaacauuuauauc

SEQ ID NO: 24521 - RNA, 21 nt, Artificial Sequence
  RNA Oligomer
uguggcauauucuaagaaaug

SEQ ID NO: 24522 - RNA, 21 nt, Artificial Sequence
  RNA Oligomer
gcaacauggaaaaaaggauuc

SEQ ID NO: 24523 - RNA, 21 nt, Artificial Sequence
  RNA Oligomer
agcaacauggaaaaaaggauu

SEQ ID NO: 24524 - RNA, 21 nt, Artificial Sequence
  RNA Oligomer
gaaauucuaagcaacauggaa

SEQ ID NO: 24525 - RNA, 21 nt, Artificial Sequence
  RNA Oligomer
gcacuggaaugaaugauuuaa

SEQ ID NO: 24526 - RNA, 21 nt, Artificial Sequence
  RNA Oligomer
cccaaacagcaaauaaaccuu

SEQ ID NO: 24527 - RNA, 21 nt, Artificial Sequence
  RNA Oligomer
gaagcagaugaggagacaagu

SEQ ID NO: 24528 - RNA, 21 nt, Artificial Sequence
  RNA Oligomer
caagaaaguugccuaggaaau

SEQ ID NO: 24529 - RNA, 21 nt, Artificial Sequence
  RNA Oligomer
gcagacuacggaagaugaaca

SEQ ID NO: 24530 - RNA, 21 nt, Artificial Sequence
  RNA Oligomer
caaagcagacuacggaagaug

SEQ ID NO: 24531 - RNA, 21 nt, Artificial Sequence
  RNA Oligomer
cuuugucagaaacucccauau

SEQ ID NO: 24532 - RNA, 21 nt, Artificial Sequence
  RNA Oligomer
gacuaauguuucuuuuguggu

SEQ ID NO: 24533 - RNA, 21 nt, Artificial Sequence
  RNA Oligomer
cuccuagguuaaaauaguuuc

SEQ ID NO: 24534 - RNA, 21 nt, Artificial Sequence
  RNA Oligomer
gacgcaaucucuuccacacau

SEQ ID NO: 24535 - RNA, 21 nt, Artificial Sequence
  RNA Oligomer
cacuguuggagauguguauaa

SEQ ID NO: 24536 - RNA, 21 nt, Artificial Sequence
  RNA Oligomer
augcacauuuuccuuacugaa

SEQ ID NO: 24537 - RNA, 21 nt, Artificial Sequence
  RNA Oligomer
agcaugcacauuuuccuuacu

SEQ ID NO: 24538 - RNA, 21 nt, Artificial Sequence
  RNA Oligomer
gcuuuuuaaucaauccugagu

SEQ ID NO: 24539 - RNA, 21 nt, Artificial Sequence
  RNA Oligomer
cguuuuguuggagguggugua

SEQ ID NO: 24540 - RNA, 21 nt, Artificial Sequence
  RNA Oligomer
agcuaagucuugauaagucac

SEQ ID NO: 24541 - RNA, 21 nt, Artificial Sequence
  RNA Oligomer
cucagcuaagucuugauaagu

SEQ ID NO: 24542 - RNA, 21 nt, Artificial Sequence
  RNA Oligomer
ccagaaugggaaagaugugaa

SEQ ID NO: 24543 - RNA, 21 nt, Artificial Sequence
  RNA Oligomer
gcucaacauuuauaucagucc

SEQ ID NO: 24544 - RNA, 21 nt, Artificial Sequence
  RNA Oligomer
uucugggauaagguacuugaa

SEQ ID NO: 24545 - RNA, 21 nt, Artificial Sequence
  RNA Oligomer
uucuaagaaaugggacuuuac

SEQ ID NO: 24546 - RNA, 21 nt, Artificial Sequence
  RNA Oligomer
uggcauauucuaagaaauggg

SEQ ID NO: 24547 - RNA, 21 nt, Artificial Sequence
  RNA Oligomer
ucgcacuggaaugaaugauuu

SEQ ID NO: 24548 - RNA, 21 nt, Artificial Sequence
  RNA Oligomer
ccucccaaacagcaaauaaac

SEQ ID NO: 24549 - RNA, 21 nt, Artificial Sequence
  RNA Oligomer
ucagaagcagaugaggagaca

SEQ ID NO: 24550 - RNA, 21 nt, Artificial Sequence
  RNA Oligomer
acggaagaugaacaggccaga

SEQ ID NO: 24551 - RNA, 21 nt, Artificial Sequence
  RNA Oligomer
cuacggaagaugaacaggcca

SEQ ID NO: 24552 - RNA, 21 nt, Artificial Sequence
  RNA Oligomer
cagacuacggaagaugaacag

SEQ ID NO: 24553 - RNA, 21 nt, Artificial Sequence
  RNA Oligomer
agugaagagaauagagacaau

SEQ ID NO: 24554 - RNA, 21 nt, Artificial Sequence
  RNA Oligomer
acuuugucagaaacucccaua

SEQ ID NO: 24555 - RNA, 21 nt, Artificial Sequence
  RNA Oligomer
ucacuuugucagaaacuccca

SEQ ID NO: 24556 - RNA, 21 nt, Artificial Sequence
  RNA Oligomer
ggaaauguggaauaaaaggag

SEQ ID NO: 24557 - RNA, 21 nt, Artificial Sequence
  RNA Oligomer
guauaagcuguugcuacgaua

SEQ ID NO: 24558 - RNA, 21 nt, Artificial Sequence
  RNA Oligomer
cagcaugcacauuuuccuuac

SEQ ID NO: 24559 - RNA, 21 nt, Artificial Sequence
  RNA Oligomer
cagcugagcgagaugugguuu

SEQ ID NO: 24560 - RNA, 21 nt, Artificial Sequence
  RNA Oligomer
ccagguuaaaagccuuaauac

SEQ ID NO: 24561 - RNA, 21 nt, Artificial Sequence
  RNA Oligomer
aguugauuauuucacggcucu

SEQ ID NO: 24562 - RNA, 21 nt, Artificial Sequence
  RNA Oligomer
guuuuguuggaggugguguaa

SEQ ID NO: 24563 - RNA, 21 nt, Artificial Sequence
  RNA Oligomer
guuucucagcuaagucuugau

SEQ ID NO: 24564 - RNA, 21 nt, Artificial Sequence
  RNA Oligomer
ggguuggugacauuuacaaga

SEQ ID NO: 24565 - RNA, 21 nt, Artificial Sequence
  RNA Oligomer
ggagaaacuuaaaacgcucuu

SEQ ID NO: 24566 - RNA, 21 nt, Artificial Sequence
  RNA Oligomer
ugagggacguucaucaaggaa

SEQ ID NO: 24567 - RNA, 21 nt, Artificial Sequence
  RNA Oligomer
acgaaaugcuaagaugaaauc

SEQ ID NO: 24568 - RNA, 21 nt, Artificial Sequence
  RNA Oligomer
ucuugccugauauggugaaaa

SEQ ID NO: 24569 - RNA, 21 nt, Artificial Sequence
  RNA Oligomer
aucuugccugauauggugaaa

SEQ ID NO: 24570 - RNA, 21 nt, Artificial Sequence
  RNA Oligomer
gaagaugagaauggugagcga

SEQ ID NO: 24571 - RNA, 21 nt, Artificial Sequence
  RNA Oligomer
acacuaaaggaaucaagacag

SEQ ID NO: 24572 - RNA, 21 nt, Artificial Sequence
  RNA Oligomer
caaacaucaaagaacagaaag

SEQ ID NO: 24573 - RNA, 21 nt, Artificial Sequence
  RNA Oligomer
ggauucuaaaaucacagauca

SEQ ID NO: 24574 - RNA, 21 nt, Artificial Sequence
  RNA Oligomer
caacauggaaaaaaggauucu

SEQ ID NO: 24575 - RNA, 21 nt, Artificial Sequence
  RNA Oligomer
gcaguuuaguaaugcuaacau

SEQ ID NO: 24576 - RNA, 21 nt, Artificial Sequence
  RNA Oligomer
auaaaauuggacuggugggaa

SEQ ID NO: 24577 - RNA, 21 nt, Artificial Sequence
  RNA Oligomer
gcaaaccuccuagguuaaaau

SEQ ID NO: 24578 - RNA, 21 nt, Artificial Sequence
  RNA Oligomer
ggguuuuuuucauauguguug

SEQ ID NO: 24579 - RNA, 21 nt, Artificial Sequence
  RNA Oligomer
cacuucagacgcuaccucgau

SEQ ID NO: 24580 - RNA, 21 nt, Artificial Sequence
  RNA Oligomer
gaagguaccauagaagaaaau

SEQ ID NO: 24581 - RNA, 21 nt, Artificial Sequence
  RNA Oligomer
uucucagcuaagucuugauaa

SEQ ID NO: 24582 - RNA, 21 nt, Artificial Sequence
  RNA Oligomer
gaaaccggagaaacuuaaaac

SEQ ID NO: 24583 - RNA, 21 nt, Artificial Sequence
  RNA Oligomer
cgaaaugcuaagaugaaaucg

SEQ ID NO: 24584 - RNA, 21 nt, Artificial Sequence
  RNA Oligomer
gggaaaccaaacaucaaagaa

SEQ ID NO: 24585 - RNA, 21 nt, Artificial Sequence
  RNA Oligomer
uccucccaaacagcaaauaaa

SEQ ID NO: 24586 - RNA, 21 nt, Artificial Sequence
  RNA Oligomer
uuccucccaaacagcaaauaa

SEQ ID NO: 24587 - RNA, 21 nt, Artificial Sequence
  RNA Oligomer
gggccaaaaaaugacaacaaa

SEQ ID NO: 24588 - RNA, 21 nt, Artificial Sequence
  RNA Oligomer
cucuuuaagugugucuauaug

SEQ ID NO: 24589 - RNA, 21 nt, Artificial Sequence
  RNA Oligomer
gcccauauauuauaccaguug

SEQ ID NO: 24590 - RNA, 21 nt, Artificial Sequence
  RNA Oligomer
caugcacauuuuccuuacuga

SEQ ID NO: 24591 - RNA, 21 nt, Artificial Sequence
  RNA Oligomer
ggacucagaauugaugagaga

SEQ ID NO: 24592 - RNA, 21 nt, Artificial Sequence
  RNA Oligomer
guggaagaugagaauggugag

SEQ ID NO: 24593 - RNA, 21 nt, Artificial Sequence
  RNA Oligomer
gccugaauguagaaugcagaa

SEQ ID NO: 24594 - RNA, 21 nt, Artificial Sequence
  RNA Oligomer
aguugucagcaagaugagaua

SEQ ID NO: 24595 - RNA, 21 nt, Artificial Sequence
  RNA Oligomer
acaacuguaaagcuugcaaau

SEQ ID NO: 24596 - RNA, 21 nt, Artificial Sequence
  RNA Oligomer
ccucaaacaguaacccuggua

SEQ ID NO: 24597 - RNA, 21 nt, Artificial Sequence
  RNA Oligomer
ccugaugugguguaaagaaaa

SEQ ID NO: 24598 - RNA, 21 nt, Artificial Sequence
  RNA Oligomer
cucuuucuuccugcccauaua

SEQ ID NO: 24599 - RNA, 21 nt, Artificial Sequence
  RNA Oligomer
ggucucuuucuuccugcccau

SEQ ID NO: 24600 - RNA, 21 nt, Artificial Sequence
  RNA Oligomer
acaucaagcuuuauccauuca

SEQ ID NO: 24601 - RNA, 21 nt, Artificial Sequence
  RNA Oligomer
acagcaugcacauuuuccuua

SEQ ID NO: 24602 - RNA, 21 nt, Artificial Sequence
  RNA Oligomer
gaaaauggccaaggcaugcua

SEQ ID NO: 24603 - RNA, 21 nt, Artificial Sequence
  RNA Oligomer
agaaugggaaagaugugaaaa

SEQ ID NO: 24604 - RNA, 21 nt, Artificial Sequence
  RNA Oligomer
cagaaugggaaagaugugaaa

SEQ ID NO: 24605 - RNA, 21 nt, Artificial Sequence
  RNA Oligomer
caaggaaaccggagaaacuua

SEQ ID NO: 24606 - RNA, 21 nt, Artificial Sequence
  RNA Oligomer
augggacuuuacagcuuugau

SEQ ID NO: 24607 - RNA, 21 nt, Artificial Sequence
  RNA Oligomer
ggaagaugagaauggugagcg

SEQ ID NO: 24608 - RNA, 21 nt, Artificial Sequence
  RNA Oligomer
gccaaucacacaguaacuauu

SEQ ID NO: 24609 - RNA, 21 nt, Artificial Sequence
  RNA Oligomer
uaccaguuggauggacacuaa

SEQ ID NO: 24610 - RNA, 21 nt, Artificial Sequence
  RNA Oligomer
ccaaagcagaggacagaagaa

SEQ ID NO: 24611 - RNA, 21 nt, Artificial Sequence
  RNA Oligomer
auguugguacugggccaaaaa

SEQ ID NO: 24612 - RNA, 21 nt, Artificial Sequence
  RNA Oligomer
ugucugucuuuuuuccucuga

SEQ ID NO: 24613 - RNA, 21 nt, Artificial Sequence
  RNA Oligomer
gguuuuuuucauauguguugc

SEQ ID NO: 24614 - RNA, 21 nt, Artificial Sequence
  RNA Oligomer
caucaagcuuuauccauucau

SEQ ID NO: 24615 - RNA, 21 nt, Artificial Sequence
  RNA Oligomer
cuauuaccaguuggauggaca

SEQ ID NO: 24616 - RNA, 21 nt, Artificial Sequence
  RNA Oligomer
agaaaggaagaucccuaaaua

SEQ ID NO: 24617 - RNA, 21 nt, Artificial Sequence
  RNA Oligomer
gcagaggacagaagaaaagaa

SEQ ID NO: 24618 - RNA, 21 nt, Artificial Sequence
  RNA Oligomer
cucucucagguuagugaaaug

SEQ ID NO: 24619 - RNA, 21 nt, Artificial Sequence
  RNA Oligomer
ggccaaaaaaugacaacaaau

SEQ ID NO: 24620 - RNA, 21 nt, Artificial Sequence
  RNA Oligomer
ggauguugguacugggccaaa

SEQ ID NO: 24621 - RNA, 21 nt, Artificial Sequence
  RNA Oligomer
gaggcauauucauauaaccaa

SEQ ID NO: 24622 - RNA, 21 nt, Artificial Sequence
  RNA Oligomer
gugguguaaagaaaacagauu

SEQ ID NO: 24623 - RNA, 21 nt, Artificial Sequence
  RNA Oligomer
augguuugucugucuuuuuuc

SEQ ID NO: 24624 - RNA, 21 nt, Artificial Sequence
  RNA Oligomer
gucucuuucuuccugcccaua

SEQ ID NO: 24625 - RNA, 21 nt, Artificial Sequence
  RNA Oligomer
gacaucaagcuuuauccauuc

SEQ ID NO: 24626 - RNA, 21 nt, Artificial Sequence
  RNA Oligomer
gaugagagacauuuacagcau

SEQ ID NO: 24627 - RNA, 21 nt, Artificial Sequence
  RNA Oligomer
gccuuaauacagauauuggca

SEQ ID NO: 24628 - RNA, 21 nt, Artificial Sequence
  RNA Oligomer
ucaaggaaaccggagaaacuu

SEQ ID NO: 24629 - RNA, 21 nt, Artificial Sequence
  RNA Oligomer
ucaucaaggaaaccggagaaa

SEQ ID NO: 24630 - RNA, 21 nt, Artificial Sequence
  RNA Oligomer
ccagucuuuuagcuaaugcuu

SEQ ID NO: 24631 - RNA, 21 nt, Artificial Sequence
  RNA Oligomer
gaaucauuccaucacaauguc

SEQ ID NO: 24632 - RNA, 21 nt, Artificial Sequence
  RNA Oligomer
ugccuuguucagaacaaaauu

SEQ ID NO: 24633 - RNA, 21 nt, Artificial Sequence
  RNA Oligomer
ccaaucacacaguaacuauuc

SEQ ID NO: 24634 - RNA, 21 nt, Artificial Sequence
  RNA Oligomer
ccaucugccaaucacacagua

SEQ ID NO: 24635 - RNA, 21 nt, Artificial Sequence
  RNA Oligomer
accaguuggauggacacuaaa

SEQ ID NO: 24636 - RNA, 21 nt, Artificial Sequence
  RNA Oligomer
ccaccucaccuuucuccagau

SEQ ID NO: 24637 - RNA, 21 nt, Artificial Sequence
  RNA Oligomer
gaaaccaaacaucaaagaaca

SEQ ID NO: 24638 - RNA, 21 nt, Artificial Sequence
  RNA Oligomer
ccucaaaaugaugaucacagu

SEQ ID NO: 24639 - RNA, 21 nt, Artificial Sequence
  RNA Oligomer
guacauauugaaguuucucug

SEQ ID NO: 24640 - RNA, 21 nt, Artificial Sequence
  RNA Oligomer
ggcauauucauauaaccaaag

SEQ ID NO: 24641 - RNA, 21 nt, Artificial Sequence
  RNA Oligomer
ugugguguaaagaaaacagau

SEQ ID NO: 24642 - RNA, 21 nt, Artificial Sequence
  RNA Oligomer
cccauauauuauaccaguugc

SEQ ID NO: 24643 - RNA, 21 nt, Artificial Sequence
  RNA Oligomer
ccaucagaucucuugugaaau

SEQ ID NO: 24644 - RNA, 21 nt, Artificial Sequence
  RNA Oligomer
cugacucacguggacuuagau

SEQ ID NO: 24645 - RNA, 21 nt, Artificial Sequence
  RNA Oligomer
agacauuuacagcaugcacau

SEQ ID NO: 24646 - RNA, 21 nt, Artificial Sequence
  RNA Oligomer
guacagugaauacacaggcua

SEQ ID NO: 24647 - RNA, 21 nt, Artificial Sequence
  RNA Oligomer
gaaugggaaagaugugaaaaa

SEQ ID NO: 24648 - RNA, 21 nt, Artificial Sequence
  RNA Oligomer
agagucacagagaaaaaaccu

SEQ ID NO: 24649 - RNA, 21 nt, Artificial Sequence
  RNA Oligomer
gaagagucacagagaaaaaac

SEQ ID NO: 24650 - RNA, 21 nt, Artificial Sequence
  RNA Oligomer
agaugaaucauuccaucacaa

SEQ ID NO: 24651 - RNA, 21 nt, Artificial Sequence
  RNA Oligomer
agcaacugguauaauauaugg

SEQ ID NO: 24652 - RNA, 21 nt, Artificial Sequence
  RNA Oligomer
uguaaauuuguugagaagugc

SEQ ID NO: 24653 - RNA, 21 nt, Artificial Sequence
  RNA Oligomer
uuuguacagaacucaucaugg

SEQ ID NO: 24654 - RNA, 21 nt, Artificial Sequence
  RNA Oligomer
auguaaucuaacuucaccgcc

SEQ ID NO: 24655 - RNA, 21 nt, Artificial Sequence
  RNA Oligomer
aguaccaacauccucagagcc

SEQ ID NO: 24656 - RNA, 21 nt, Artificial Sequence
  RNA Oligomer
ucgauugaaguuaaugucugg

SEQ ID NO: 24657 - RNA, 21 nt, Artificial Sequence
  RNA Oligomer
auuucugcauucuacauucag

SEQ ID NO: 24658 - RNA, 21 nt, Artificial Sequence
  RNA Oligomer
auucaggcuagaaauauuucc

SEQ ID NO: 24659 - RNA, 21 nt, Artificial Sequence
  RNA Oligomer
uucuuguucaucaaaaccugg

SEQ ID NO: 24660 - RNA, 21 nt, Artificial Sequence
  RNA Oligomer
aagcauauuaagaguugagug

SEQ ID NO: 24661 - RNA, 21 nt, Artificial Sequence
  RNA Oligomer
auuuugccacuuacacauugc

SEQ ID NO: 24662 - RNA, 21 nt, Artificial Sequence
  RNA Oligomer
auggagggaguuuagauguac

SEQ ID NO: 24663 - RNA, 21 nt, Artificial Sequence
  RNA Oligomer
gacagcaugguauaugaaugg

SEQ ID NO: 24664 - RNA, 21 nt, Artificial Sequence
  RNA Oligomer
aaaauccaccuguagcaugcc

SEQ ID NO: 24665 - RNA, 21 nt, Artificial Sequence
  RNA Oligomer
caucuuagcauuucgucgugg

SEQ ID NO: 24666 - RNA, 21 nt, Artificial Sequence
  RNA Oligomer
ugauuccuuuaguguccaucc

SEQ ID NO: 24667 - RNA, 21 nt, Artificial Sequence
  RNA Oligomer
aucuacccgaauaguuacugu

SEQ ID NO: 24668 - RNA, 21 nt, Artificial Sequence
  RNA Oligomer
aauguaaucuaacuucaccgc

SEQ ID NO: 24669 - RNA, 21 nt, Artificial Sequence
  RNA Oligomer
aacauaucuaaguccacguga

SEQ ID NO: 24670 - RNA, 21 nt, Artificial Sequence
  RNA Oligomer
aaugucucucaucaauucuga

SEQ ID NO: 24671 - RNA, 21 nt, Artificial Sequence
  RNA Oligomer
auccaaacuuucugauuccgc

SEQ ID NO: 24672 - RNA, 21 nt, Artificial Sequence
  RNA Oligomer
aauguguuggaaaagguuuag

SEQ ID NO: 24673 - RNA, 21 nt, Artificial Sequence
  RNA Oligomer
auguguuggaaaagguuuagg

SEQ ID NO: 24674 - RNA, 21 nt, Artificial Sequence
  RNA Oligomer
guguuucccuucauuuugcca

SEQ ID NO: 24675 - RNA, 21 nt, Artificial Sequence
  RNA Oligomer
aaucaguuaaagagauuccug

SEQ ID NO: 24676 - RNA, 21 nt, Artificial Sequence
  RNA Oligomer
caaucgauugaaguuaauguc

SEQ ID NO: 24677 - RNA, 21 nt, Artificial Sequence
  RNA Oligomer
aauacuccgauuucaucuuag

SEQ ID NO: 24678 - RNA, 21 nt, Artificial Sequence
  RNA Oligomer
auagcauccuucaaguuuugg

SEQ ID NO: 24679 - RNA, 21 nt, Artificial Sequence
  RNA Oligomer
uuucccacuguucuuuucuuc

SEQ ID NO: 24680 - RNA, 21 nt, Artificial Sequence
  RNA Oligomer
aauauuuccagguaguuuagc

SEQ ID NO: 24681 - RNA, 21 nt, Artificial Sequence
  RNA Oligomer
aaauguaaucuaacuucaccg

SEQ ID NO: 24682 - RNA, 21 nt, Artificial Sequence
  RNA Oligomer
aucuucuuguucaucaaaacc

SEQ ID NO: 24683 - RNA, 21 nt, Artificial Sequence
  RNA Oligomer
caguaccaacauccucagagc

SEQ ID NO: 24684 - RNA, 21 nt, Artificial Sequence
  RNA Oligomer
aacuguugauugucucuauuc

SEQ ID NO: 24685 - RNA, 21 nt, Artificial Sequence
  RNA Oligomer
uuauaugaauaugccucaagc

SEQ ID NO: 24686 - RNA, 21 nt, Artificial Sequence
  RNA Oligomer
aucagaggaaaaaagacagac

SEQ ID NO: 24687 - RNA, 21 nt, Artificial Sequence
  RNA Oligomer
uauuaagaguugaguggaagg

SEQ ID NO: 24688 - RNA, 21 nt, Artificial Sequence
  RNA Oligomer
uuucccuucauuuugccacuu

SEQ ID NO: 24689 - RNA, 21 nt, Artificial Sequence
  RNA Oligomer
gauuucaacuuguuuccuggc

SEQ ID NO: 24690 - RNA, 21 nt, Artificial Sequence
  RNA Oligomer
aaacauaucuaaguccacgug

SEQ ID NO: 24691 - RNA, 21 nt, Artificial Sequence
  RNA Oligomer
uucuucuugcacaaguccugc

SEQ ID NO: 24692 - RNA, 21 nt, Artificial Sequence
  RNA Oligomer
uucguaagugacaugcaaucg

SEQ ID NO: 24693 - RNA, 21 nt, Artificial Sequence
  RNA Oligomer
aucgauugaaguuaaugucug

SEQ ID NO: 24694 - RNA, 21 nt, Artificial Sequence
  RNA Oligomer
auacuccgauuucaucuuagc

SEQ ID NO: 24695 - RNA, 21 nt, Artificial Sequence
  RNA Oligomer
uacuccgauuucaucuuagca

SEQ ID NO: 24696 - RNA, 21 nt, Artificial Sequence
  RNA Oligomer
ucaucuuagcauuucgucgug

SEQ ID NO: 24697 - RNA, 21 nt, Artificial Sequence
  RNA Oligomer
uauccaaacuuucugauuccg

SEQ ID NO: 24698 - RNA, 21 nt, Artificial Sequence
  RNA Oligomer
auauaaauguugagcuucugc

SEQ ID NO: 24699 - RNA, 21 nt, Artificial Sequence
  RNA Oligomer
uuguauuucagaauagcaucc

SEQ ID NO: 24700 - RNA, 21 nt, Artificial Sequence
  RNA Oligomer
cauucaggcuagaaauauuuc

SEQ ID NO: 24701 - RNA, 21 nt, Artificial Sequence
  RNA Oligomer
aucuaacuucaccgcccuuag

SEQ ID NO: 24702 - RNA, 21 nt, Artificial Sequence
  RNA Oligomer
uugauugucucuauucucuuc

SEQ ID NO: 24703 - RNA, 21 nt, Artificial Sequence
  RNA Oligomer
agcauauuaagaguugagugg

SEQ ID NO: 24704 - RNA, 21 nt, Artificial Sequence
  RNA Oligomer
aaaacauaucuaaguccacgu

SEQ ID NO: 24705 - RNA, 21 nt, Artificial Sequence
  RNA Oligomer
ugguauaugaauggauaaagc

SEQ ID NO: 24706 - RNA, 21 nt, Artificial Sequence
  RNA Oligomer
ugaacgucccucaaacaaucg

SEQ ID NO: 24707 - RNA, 21 nt, Artificial Sequence
  RNA Oligomer
uucaucuuagcauuucgucgu

SEQ ID NO: 24708 - RNA, 21 nt, Artificial Sequence
  RNA Oligomer
aucuuagcauuucgucgugga

SEQ ID NO: 24709 - RNA, 21 nt, Artificial Sequence
  RNA Oligomer
ucaucauggauucuauucuug

SEQ ID NO: 24710 - RNA, 21 nt, Artificial Sequence
  RNA Oligomer
gaaugauucaucuucuguuuc

SEQ ID NO: 24711 - RNA, 21 nt, Artificial Sequence
  RNA Oligomer
aucccagaaaucgaucaaagc

SEQ ID NO: 24712 - RNA, 21 nt, Artificial Sequence
  RNA Oligomer
uauuucagaauagcauccuuc

SEQ ID NO: 24713 - RNA, 21 nt, Artificial Sequence
  RNA Oligomer
auuccuuuaguguccauccaa

SEQ ID NO: 24714 - RNA, 21 nt, Artificial Sequence
  RNA Oligomer
cuacccgaauaguuacugugu

SEQ ID NO: 24715 - RNA, 21 nt, Artificial Sequence
  RNA Oligomer
uucuucucaucuccucaaugg

SEQ ID NO: 24716 - RNA, 21 nt, Artificial Sequence
  RNA Oligomer
uccaagccacuucuuaucugg

SEQ ID NO: 24717 - RNA, 21 nt, Artificial Sequence
  RNA Oligomer
cugguaauagucuuuuguuug

SEQ ID NO: 24718 - RNA, 21 nt, Artificial Sequence
  RNA Oligomer
uucaucaaaaccuggacuugu

SEQ ID NO: 24719 - RNA, 21 nt, Artificial Sequence
  RNA Oligomer
uucacuuuccuucucaaaugg

SEQ ID NO: 24720 - RNA, 21 nt, Artificial Sequence
  RNA Oligomer
uugucuagucaauuuguuguc

SEQ ID NO: 24721 - RNA, 21 nt, Artificial Sequence
  RNA Oligomer
acauccucagagccaacaucu

SEQ ID NO: 24722 - RNA, 21 nt, Artificial Sequence
  RNA Oligomer
cuguugauugucucuauucuc

SEQ ID NO: 24723 - RNA, 21 nt, Artificial Sequence
  RNA Oligomer
ugauugucucuauucucuuca

SEQ ID NO: 24724 - RNA, 21 nt, Artificial Sequence
  RNA Oligomer
uacugaucagaggaaaaaaga

SEQ ID NO: 24725 - RNA, 21 nt, Artificial Sequence
  RNA Oligomer
auuaagaguugaguggaaggc

SEQ ID NO: 24726 - RNA, 21 nt, Artificial Sequence
  RNA Oligomer
ggauggagggaguuuagaugu

SEQ ID NO: 24727 - RNA, 21 nt, Artificial Sequence
  RNA Oligomer
uuugccacuuacacauugcug

SEQ ID NO: 24728 - RNA, 21 nt, Artificial Sequence
  RNA Oligomer
uucauauauuacaccugacag

SEQ ID NO: 24729 - RNA, 21 nt, Artificial Sequence
  RNA Oligomer
acagcaugguauaugaaugga

SEQ ID NO: 24730 - RNA, 21 nt, Artificial Sequence
  RNA Oligomer
uucuucauuguaguaucguag

SEQ ID NO: 24731 - RNA, 21 nt, Artificial Sequence
  RNA Oligomer
ucaggauugauuaaaaagcgg

SEQ ID NO: 24732 - RNA, 21 nt, Artificial Sequence
  RNA Oligomer
auccaccuguagcaugccuug

SEQ ID NO: 24733 - RNA, 21 nt, Artificial Sequence
  RNA Oligomer
uuuuguacagaacucaucaug

SEQ ID NO: 24734 - RNA, 21 nt, Artificial Sequence
  RNA Oligomer
cgauugaaguuaaugucuggg

SEQ ID NO: 24735 - RNA, 21 nt, Artificial Sequence
  RNA Oligomer
gauugaaguuaaugucugggu

SEQ ID NO: 24736 - RNA, 21 nt, Artificial Sequence
  RNA Oligomer
auugaaguuaaugucugggua

SEQ ID NO: 24737 - RNA, 21 nt, Artificial Sequence
  RNA Oligomer
aaaagacuggcaaucuguucc

SEQ ID NO: 24738 - RNA, 21 nt, Artificial Sequence
  RNA Oligomer
aaagacuggcaaucuguuccu

SEQ ID NO: 24739 - RNA, 21 nt, Artificial Sequence
  RNA Oligomer
agacuggcaaucuguuccugc

SEQ ID NO: 24740 - RNA, 21 nt, Artificial Sequence
  RNA Oligomer
caucauggauucuauucuugu

SEQ ID NO: 24741 - RNA, 21 nt, Artificial Sequence
  RNA Oligomer
cuauccaaacuuucugauucc

SEQ ID NO: 24742 - RNA, 21 nt, Artificial Sequence
  RNA Oligomer
auaugccacauuguauuucag

SEQ ID NO: 24743 - RNA, 21 nt, Artificial Sequence
  RNA Oligomer
uuccacuggguacaaauuuug

SEQ ID NO: 24744 - RNA, 21 nt, Artificial Sequence
  RNA Oligomer
uguguuggaaaagguuuagga

SEQ ID NO: 24745 - RNA, 21 nt, Artificial Sequence
  RNA Oligomer
aagaucuacccgaauaguuac

SEQ ID NO: 24746 - RNA, 21 nt, Artificial Sequence
  RNA Oligomer
uucccacuguucuuuucuucu

SEQ ID NO: 24747 - RNA, 21 nt, Artificial Sequence
  RNA Oligomer
cauguugcuuagaauuucugc

SEQ ID NO: 24748 - RNA, 21 nt, Artificial Sequence
  RNA Oligomer
auauuuccagguaguuuagca

SEQ ID NO: 24749 - RNA, 21 nt, Artificial Sequence
  RNA Oligomer
uauuuccagguaguuuagcau

SEQ ID NO: 24750 - RNA, 21 nt, Artificial Sequence
  RNA Oligomer
aaucauucauuccagugcgac

SEQ ID NO: 24751 - RNA, 21 nt, Artificial Sequence
  RNA Oligomer
uuugaaaacaagcgagguggc

SEQ ID NO: 24752 - RNA, 21 nt, Artificial Sequence
  RNA Oligomer
agaauuauccacauccaucgg

SEQ ID NO: 24753 - RNA, 21 nt, Artificial Sequence
  RNA Oligomer
cuuucuugucuagucaauuug

SEQ ID NO: 24754 - RNA, 21 nt, Artificial Sequence
  RNA Oligomer
caagacuugcugcacuucugg

SEQ ID NO: 24755 - RNA, 21 nt, Artificial Sequence
  RNA Oligomer
ugaucagaggaaaaaagacag

SEQ ID NO: 24756 - RNA, 21 nt, Artificial Sequence
  RNA Oligomer
ugcaagcauauuaagaguuga

SEQ ID NO: 24757 - RNA, 21 nt, Artificial Sequence
  RNA Oligomer
ugguauaauauaugggcagga

SEQ ID NO: 24758 - RNA, 21 nt, Artificial Sequence
  RNA Oligomer
gucaggauggagggaguuuag

SEQ ID NO: 24759 - RNA, 21 nt, Artificial Sequence
  RNA Oligomer
uuuugccacuuacacauugcu

SEQ ID NO: 24760 - RNA, 21 nt, Artificial Sequence
  RNA Oligomer
uggagggaguuuagauguacc

SEQ ID NO: 24761 - RNA, 21 nt, Artificial Sequence
  RNA Oligomer
auaaagcuugaugucuggucc

SEQ ID NO: 24762 - RNA, 21 nt, Artificial Sequence
  RNA Oligomer
ucuguauuaaggcuuuuaacc

SEQ ID NO: 24763 - RNA, 21 nt, Artificial Sequence
  RNA Oligomer
ucccuuucacucccaucuucg

SEQ ID NO: 24764 - RNA, 21 nt, Artificial Sequence
  RNA Oligomer
cucaggauugauuaaaaagcg

SEQ ID NO: 24765 - RNA, 21 nt, Artificial Sequence
  RNA Oligomer
accuccaacaaaacgauuugc

SEQ ID NO: 24766 - RNA, 21 nt, Artificial Sequence
  RNA Oligomer
uuguacagaacucaucaugga

SEQ ID NO: 24767 - RNA, 21 nt, Artificial Sequence
  RNA Oligomer
uugaaguuaaugucuggguaa

SEQ ID NO: 24768 - RNA, 21 nt, Artificial Sequence
  RNA Oligomer
uaacuagaauacuccgauuuc

SEQ ID NO: 24769 - RNA, 21 nt, Artificial Sequence
  RNA Oligomer
uaaaagacuggcaaucuguuc

SEQ ID NO: 24770 - RNA, 21 nt, Artificial Sequence
  RNA Oligomer
aagacuggcaaucuguuccug

SEQ ID NO: 24771 - RNA, 21 nt, Artificial Sequence
  RNA Oligomer
cuguuucaggagugguauugg

SEQ ID NO: 24772 - RNA, 21 nt, Artificial Sequence
  RNA Oligomer
auuucagaauagcauccuuca

SEQ ID NO: 24773 - RNA, 21 nt, Artificial Sequence
  RNA Oligomer
aauagcauccuucaaguuuug

SEQ ID NO: 24774 - RNA, 21 nt, Artificial Sequence
  RNA Oligomer
acuggguacaaauuuuguucu

SEQ ID NO: 24775 - RNA, 21 nt, Artificial Sequence
  RNA Oligomer
gucuugauuccuuuagugucc

SEQ ID NO: 24776 - RNA, 21 nt, Artificial Sequence
  RNA Oligomer
gaucuacccgaauaguuacug

SEQ ID NO: 24777 - RNA, 21 nt, Artificial Sequence
  RNA Oligomer
auucguucacuuucccaccac

SEQ ID NO: 24778 - RNA, 21 nt, Artificial Sequence
  RNA Oligomer
gugagguggaacguauuuagg

SEQ ID NO: 24779 - RNA, 21 nt, Artificial Sequence
  RNA Oligomer
gaacguauuuagggaucuucc

SEQ ID NO: 24780 - RNA, 21 nt, Artificial Sequence
  RNA Oligomer
ugcauucuacauucaggcuag

SEQ ID NO: 24781 - RNA, 21 nt, Artificial Sequence
  RNA Oligomer
uuccagguaguuuagcauuua

SEQ ID NO: 24782 - RNA, 21 nt, Artificial Sequence
  RNA Oligomer
auucaaugucagcgucucuug

SEQ ID NO: 24783 - RNA, 21 nt, Artificial Sequence
  RNA Oligomer
uauuugcuguuugggaggaac

SEQ ID NO: 24784 - RNA, 21 nt, Artificial Sequence
  RNA Oligomer
agagccucauuucacuaaccu

SEQ ID NO: 24785 - RNA, 21 nt, Artificial Sequence
  RNA Oligomer
agagccaacaucugacaaugg

SEQ ID NO: 24786 - RNA, 21 nt, Artificial Sequence
  RNA Oligomer
accacaucuaucucaucuugc

SEQ ID NO: 24787 - RNA, 21 nt, Artificial Sequence
  RNA Oligomer
uuacuguuugagguucacuuu

SEQ ID NO: 24788 - RNA, 21 nt, Artificial Sequence
  RNA Oligomer
uauagacacacuuaaagagca

SEQ ID NO: 24789 - RNA, 21 nt, Artificial Sequence
  RNA Oligomer
acacacuuaaagagcauacgu

SEQ ID NO: 24790 - RNA, 21 nt, Artificial Sequence
  RNA Oligomer
auagaugauaugggaguuucu

SEQ ID NO: 24791 - RNA, 21 nt, Artificial Sequence
  RNA Oligomer
ucacuuuccaaaagcugcucc

SEQ ID NO: 24792 - RNA, 21 nt, Artificial Sequence
  RNA Oligomer
auauuaagaguugaguggaag

SEQ ID NO: 24793 - RNA, 21 nt, Artificial Sequence
  RNA Oligomer
auauaugggcaggaagaaaga

SEQ ID NO: 24794 - RNA, 21 nt, Artificial Sequence
  RNA Oligomer
acaaaacauaucuaaguccac

SEQ ID NO: 24795 - RNA, 21 nt, Artificial Sequence
  RNA Oligomer
acucgacagcaugguauauga

SEQ ID NO: 24796 - RNA, 21 nt, Artificial Sequence
  RNA Oligomer
aguuucugcauucuucauugu

SEQ ID NO: 24797 - RNA, 21 nt, Artificial Sequence
  RNA Oligomer
aaaugucucucaucaauucug

SEQ ID NO: 24798 - RNA, 21 nt, Artificial Sequence
  RNA Oligomer
auccacaguaagccuuguuca

SEQ ID NO: 24799 - RNA, 21 nt, Artificial Sequence
  RNA Oligomer
uagaauacuccgauuucaucu

SEQ ID NO: 24800 - RNA, 21 nt, Artificial Sequence
  RNA Oligomer
gaauacuccgauuucaucuua

SEQ ID NO: 24801 - RNA, 21 nt, Artificial Sequence
  RNA Oligomer
aaacuuucugauuccgcuguc

SEQ ID NO: 24802 - RNA, 21 nt, Artificial Sequence
  RNA Oligomer
uaucccagaaaucgaucaaag

SEQ ID NO: 24803 - RNA, 21 nt, Artificial Sequence
  RNA Oligomer
aaaucgaucaaagcuguaaag

SEQ ID NO: 24804 - RNA, 21 nt, Artificial Sequence
  RNA Oligomer
uaugccacauuguauuucaga

SEQ ID NO: 24805 - RNA, 21 nt, Artificial Sequence
  RNA Oligomer
ugagaagugcagucugaauga

SEQ ID NO: 24806 - RNA, 21 nt, Artificial Sequence
  RNA Oligomer
uccacuggguacaaauuuugu

SEQ ID NO: 24807 - RNA, 21 nt, Artificial Sequence
  RNA Oligomer
cacuggguacaaauuuuguuc

SEQ ID NO: 24808 - RNA, 21 nt, Artificial Sequence
  RNA Oligomer
uugauuccuuuaguguccauc

SEQ ID NO: 24809 - RNA, 21 nt, Artificial Sequence
  RNA Oligomer
ugcucgcaaaagaucuacccg

SEQ ID NO: 24810 - RNA, 21 nt, Artificial Sequence
  RNA Oligomer
ucuacccgaauaguuacugug

SEQ ID NO: 24811 - RNA, 21 nt, Artificial Sequence
  RNA Oligomer
uucguucacuuucccaccacc

SEQ ID NO: 24812 - RNA, 21 nt, Artificial Sequence
  RNA Oligomer
uacccgaauaguuacugugug

SEQ ID NO: 24813 - RNA, 21 nt, Artificial Sequence
  RNA Oligomer
acccgaauaguuacuguguga

SEQ ID NO: 24814 - RNA, 21 nt, Artificial Sequence
  RNA Oligomer
ugagguggaacguauuuaggg

SEQ ID NO: 24815 - RNA, 21 nt, Artificial Sequence
  RNA Oligomer
uuucuguucuuugauguuugg

SEQ ID NO: 24816 - RNA, 21 nt, Artificial Sequence
  RNA Oligomer
cacuguucuuuucuucugucc

SEQ ID NO: 24817 - RNA, 21 nt, Artificial Sequence
  RNA Oligomer
auuuccagguaguuuagcauu

SEQ ID NO: 24818 - RNA, 21 nt, Artificial Sequence
  RNA Oligomer
uucauuccagugcgacucucu

SEQ ID NO: 24819 - RNA, 21 nt, Artificial Sequence
  RNA Oligomer
uguaaucuaacuucaccgccc

SEQ ID NO: 24820 - RNA, 21 nt, Artificial Sequence
  RNA Oligomer
uaacuucaccgcccuuaguag

SEQ ID NO: 24821 - RNA, 21 nt, Artificial Sequence
  RNA Oligomer
uuuccuaaauucaaugucagc

SEQ ID NO: 24822 - RNA, 21 nt, Artificial Sequence
  RNA Oligomer
aaauucaaugucagcgucucu

SEQ ID NO: 24823 - RNA, 21 nt, Artificial Sequence
  RNA Oligomer
cuucuuguucaucaaaaccug

SEQ ID NO: 24824 - RNA, 21 nt, Artificial Sequence
  RNA Oligomer
caucugcuucugagucuugac

SEQ ID NO: 24825 - RNA, 21 nt, Artificial Sequence
  RNA Oligomer
uagaauuauccacauccaucg

SEQ ID NO: 24826 - RNA, 21 nt, Artificial Sequence
  RNA Oligomer
ucuugucuagucaauuuguug

SEQ ID NO: 24827 - RNA, 21 nt, Artificial Sequence
  RNA Oligomer
aucuaucucaucuugcugaca

SEQ ID NO: 24828 - RNA, 21 nt, Artificial Sequence
  RNA Oligomer
uucucuggccuguucaucuuc

SEQ ID NO: 24829 - RNA, 21 nt, Artificial Sequence
  RNA Oligomer
gauugucucuauucucuucac

SEQ ID NO: 24830 - RNA, 21 nt, Artificial Sequence
  RNA Oligomer
caccaguccaauuuuauuuag

SEQ ID NO: 24831 - RNA, 21 nt, Artificial Sequence
  RNA Oligomer
auauagacacacuuaaagagc

SEQ ID NO: 24832 - RNA, 21 nt, Artificial Sequence
  RNA Oligomer
auagacacacuuaaagagcau

SEQ ID NO: 24833 - RNA, 21 nt, Artificial Sequence
  RNA Oligomer
uauagaugauaugggaguuuc

SEQ ID NO: 24834 - RNA, 21 nt, Artificial Sequence
  RNA Oligomer
auuccacauuuccuuucaucu

SEQ ID NO: 24835 - RNA, 21 nt, Artificial Sequence
  RNA Oligomer
aaacuauuuuaaccuaggagg

SEQ ID NO: 24836 - RNA, 21 nt, Artificial Sequence
  RNA Oligomer
uguguuucccuucauuuugcc

SEQ ID NO: 24837 - RNA, 21 nt, Artificial Sequence
  RNA Oligomer
agauuccuggauuucaacuug

SEQ ID NO: 24838 - RNA, 21 nt, Artificial Sequence
  RNA Oligomer
gauuccuggauuucaacuugu

SEQ ID NO: 24839 - RNA, 21 nt, Artificial Sequence
  RNA Oligomer
uuccuggauuucaacuuguuu

SEQ ID NO: 24840 - RNA, 21 nt, Artificial Sequence
  RNA Oligomer
aguuuagauguaccaacugac

SEQ ID NO: 24841 - RNA, 21 nt, Artificial Sequence
  RNA Oligomer
uugccacuuacacauugcugc

SEQ ID NO: 24842 - RNA, 21 nt, Artificial Sequence
  RNA Oligomer
uccaacagugaguuuccuuuc

SEQ ID NO: 24843 - RNA, 21 nt, Artificial Sequence
  RNA Oligomer
caaaauccaccuguagcaugc

SEQ ID NO: 24844 - RNA, 21 nt, Artificial Sequence
  RNA Oligomer
aaauccaccuguagcaugccu

SEQ ID NO: 24845 - RNA, 21 nt, Artificial Sequence
  RNA Oligomer
aaaugucaccaacccaguagg

SEQ ID NO: 24846 - RNA, 21 nt, Artificial Sequence
  RNA Oligomer
aacgucccucaaacaaucgau

SEQ ID NO: 24847 - RNA, 21 nt, Artificial Sequence
  RNA Oligomer
uuucaucuuagcauuucgucg

SEQ ID NO: 24848 - RNA, 21 nt, Artificial Sequence
  RNA Oligomer
aacucaucauggauucuauuc

SEQ ID NO: 24849 - RNA, 21 nt, Artificial Sequence
  RNA Oligomer
gauggacugauauaaauguug

SEQ ID NO: 24850 - RNA, 21 nt, Artificial Sequence
  RNA Oligomer
uucuucaaguaccuuauccca

SEQ ID NO: 24851 - RNA, 21 nt, Artificial Sequence
  RNA Oligomer
uguauuucagaauagcauccu

SEQ ID NO: 24852 - RNA, 21 nt, Artificial Sequence
  RNA Oligomer
agaagugcagucugaaugagc

SEQ ID NO: 24853 - RNA, 21 nt, Artificial Sequence
  RNA Oligomer
ucuugauuccuuuagugucca

SEQ ID NO: 24854 - RNA, 21 nt, Artificial Sequence
  RNA Oligomer
guguuggaaaagguuuaggaa

SEQ ID NO: 24855 - RNA, 21 nt, Artificial Sequence
  RNA Oligomer
cugcucgcaaaagaucuaccc

SEQ ID NO: 24856 - RNA, 21 nt, Artificial Sequence
  RNA Oligomer
agucucaugaaaugaucugug

SEQ ID NO: 24857 - RNA, 21 nt, Artificial Sequence
  RNA Oligomer
auucgggauucguucacuuuc

SEQ ID NO: 24858 - RNA, 21 nt, Artificial Sequence
  RNA Oligomer
guaaucuaacuucaccgcccu

SEQ ID NO: 24859 - RNA, 21 nt, Artificial Sequence
  RNA Oligomer
uuaguagaguaccguuuccua

SEQ ID NO: 24860 - RNA, 21 nt, Artificial Sequence
  RNA Oligomer
aacuaccaucuucuuguucau

SEQ ID NO: 24861 - RNA, 21 nt, Artificial Sequence
  RNA Oligomer
ucacuaaccugagagagaugg

SEQ ID NO: 24862 - RNA, 21 nt, Artificial Sequence
  RNA Oligomer
cacaucuaucucaucuugcug

SEQ ID NO: 24863 - RNA, 21 nt, Artificial Sequence
  RNA Oligomer
caucuaucucaucuugcugac

SEQ ID NO: 24864 - RNA, 21 nt, Artificial Sequence
  RNA Oligomer
ugugagaaacuguugauuguc

SEQ ID NO: 24865 - RNA, 21 nt, Artificial Sequence
  RNA Oligomer
agacacacuuaaagagcauac

SEQ ID NO: 24866 - RNA, 21 nt, Artificial Sequence
  RNA Oligomer
gacacacuuaaagagcauacg

SEQ ID NO: 24867 - RNA, 21 nt, Artificial Sequence
  RNA Oligomer
augauaugggaguuucugaca

SEQ ID NO: 24868 - RNA, 21 nt, Artificial Sequence
  RNA Oligomer
uucacuuuccaaaagcugcuc

SEQ ID NO: 24869 - RNA, 21 nt, Artificial Sequence
  RNA Oligomer
cuucaauauguacaaaucagc

SEQ ID NO: 24870 - RNA, 21 nt, Artificial Sequence
  RNA Oligomer
gaucagaggaaaaaagacaga

SEQ ID NO: 24871 - RNA, 21 nt, Artificial Sequence
  RNA Oligomer
ccuaggagguuugcauuaugc

SEQ ID NO: 24872 - RNA, 21 nt, Artificial Sequence
  RNA Oligomer
ucacagggagauuuuuagcaa

SEQ ID NO: 24873 - RNA, 21 nt, Artificial Sequence
  RNA Oligomer
auuucaacuuguuuccuggca

SEQ ID NO: 24874 - RNA, 21 nt, Artificial Sequence
  RNA Oligomer
auguaccaacugacaacugca

SEQ ID NO: 24875 - RNA, 21 nt, Artificial Sequence
  RNA Oligomer
acauguguggaagagauugcg

SEQ ID NO: 24876 - RNA, 21 nt, Artificial Sequence
  RNA Oligomer
gguauaugaauggauaaagcu

SEQ ID NO: 24877 - RNA, 21 nt, Artificial Sequence
  RNA Oligomer
cauucuucauuguaguaucgu

SEQ ID NO: 24878 - RNA, 21 nt, Artificial Sequence
  RNA Oligomer
ucuucauuguaguaucguagc

SEQ ID NO: 24879 - RNA, 21 nt, Artificial Sequence
  RNA Oligomer
agaaauccacaguaagccuug

SEQ ID NO: 24880 - RNA, 21 nt, Artificial Sequence
  RNA Oligomer
aauccacaguaagccuuguuc

SEQ ID NO: 24881 - RNA, 21 nt, Artificial Sequence
  RNA Oligomer
cucgcgucucauuuucucagg

SEQ ID NO: 24882 - RNA, 21 nt, Artificial Sequence
  RNA Oligomer
aucgugucaaggguuuuucac

SEQ ID NO: 24883 - RNA, 21 nt, Artificial Sequence
  RNA Oligomer
uaaaugucaccaacccaguag

SEQ ID NO: 24884 - RNA, 21 nt, Artificial Sequence
  RNA Oligomer
auuucaucuuagcauuucguc

SEQ ID NO: 24885 - RNA, 21 nt, Artificial Sequence
  RNA Oligomer
uuucaggagugguauuggcug

SEQ ID NO: 24886 - RNA, 21 nt, Artificial Sequence
  RNA Oligomer
ugcaauuuucaccauaucagg

SEQ ID NO: 24887 - RNA, 21 nt, Artificial Sequence
  RNA Oligomer
aguaccuuaucccagaaaucg

SEQ ID NO: 24888 - RNA, 21 nt, Artificial Sequence
  RNA Oligomer
gucccauuucuuagaauaugc

SEQ ID NO: 24889 - RNA, 21 nt, Artificial Sequence
  RNA Oligomer
ucccauuucuuagaauaugcc

SEQ ID NO: 24890 - RNA, 21 nt, Artificial Sequence
  RNA Oligomer
uucuuagaauaugccacauug

SEQ ID NO: 24891 - RNA, 21 nt, Artificial Sequence
  RNA Oligomer
cacauuguauuucagaauagc

SEQ ID NO: 24892 - RNA, 21 nt, Artificial Sequence
  RNA Oligomer
auucuucucaucuccucaaug

SEQ ID NO: 24893 - RNA, 21 nt, Artificial Sequence
  RNA Oligomer
guuccaagccacuucuuaucu

SEQ ID NO: 24894 - RNA, 21 nt, Artificial Sequence
  RNA Oligomer
uuccaagccacuucuuaucug

SEQ ID NO: 24895 - RNA, 21 nt, Artificial Sequence
  RNA Oligomer
uaaaucauucauuccagugcg

SEQ ID NO: 24896 - RNA, 21 nt, Artificial Sequence
  RNA Oligomer
cauucauuccagugcgacucu

SEQ ID NO: 24897 - RNA, 21 nt, Artificial Sequence
  RNA Oligomer
cuuaguagaguaccguuuccu

SEQ ID NO: 24898 - RNA, 21 nt, Artificial Sequence
  RNA Oligomer
gaguaccguuuccuaaauuca

SEQ ID NO: 24899 - RNA, 21 nt, Artificial Sequence
  RNA Oligomer
accguuuccuaaauucaaugu

SEQ ID NO: 24900 - RNA, 21 nt, Artificial Sequence
  RNA Oligomer
uuuccuaggcaacuuucuugu

SEQ ID NO: 24901 - RNA, 21 nt, Artificial Sequence
  RNA Oligomer
uugugagaaacuguugauugu

SEQ ID NO: 24902 - RNA, 21 nt, Artificial Sequence
  RNA Oligomer
ucuauucucuucacuaucugu

SEQ ID NO: 24903 - RNA, 21 nt, Artificial Sequence
  RNA Oligomer
aaacacucgccugcuuucucu

SEQ ID NO: 24904 - RNA, 21 nt, Artificial Sequence
  RNA Oligomer
cacuuuccaaaagcugcuccg

SEQ ID NO: 24905 - RNA, 21 nt, Artificial Sequence
  RNA Oligomer
uauuccacauuuccuuucauc

SEQ ID NO: 24906 - RNA, 21 nt, Artificial Sequence
  RNA Oligomer
auuccuggauuucaacuuguu

SEQ ID NO: 24907 - RNA, 21 nt, Artificial Sequence
  RNA Oligomer
aagagaucugauggacaaaag

SEQ ID NO: 24908 - RNA, 21 nt, Artificial Sequence
  RNA Oligomer
cauuuugccacuuacacauug

SEQ ID NO: 24909 - RNA, 21 nt, Artificial Sequence
  RNA Oligomer
guuuagauguaccaacugaca

SEQ ID NO: 24910 - RNA, 21 nt, Artificial Sequence
  RNA Oligomer
uagauguaccaacugacaacu

SEQ ID NO: 24911 - RNA, 21 nt, Artificial Sequence
  RNA Oligomer
uauauuacaccugacagcuca

SEQ ID NO: 24912 - RNA, 21 nt, Artificial Sequence
  RNA Oligomer
caguuucugcauucuucauug

SEQ ID NO: 24913 - RNA, 21 nt, Artificial Sequence
  RNA Oligomer
caguaaggaaaaugugcaugc

SEQ ID NO: 24914 - RNA, 21 nt, Artificial Sequence
  RNA Oligomer
auaaaccacaucucgcucagc

SEQ ID NO: 24915 - RNA, 21 nt, Artificial Sequence
  RNA Oligomer
agcucgcgucucauuuucuca

SEQ ID NO: 24916 - RNA, 21 nt, Artificial Sequence
  RNA Oligomer
accugugauaauuagacauuc

SEQ ID NO: 24917 - RNA, 21 nt, Artificial Sequence
  RNA Oligomer
ucugucuuguaaaugucacca

SEQ ID NO: 24918 - RNA, 21 nt, Artificial Sequence
  RNA Oligomer
aaguagcagaagagcguuuua

SEQ ID NO: 24919 - RNA, 21 nt, Artificial Sequence
  RNA Oligomer
aacuagaauacuccgauuuca

SEQ ID NO: 24920 - RNA, 21 nt, Artificial Sequence
  RNA Oligomer
uguuucaggagugguauuggc

SEQ ID NO: 24921 - RNA, 21 nt, Artificial Sequence
  RNA Oligomer
guuucaggagugguauuggcu

SEQ ID NO: 24922 - RNA, 21 nt, Artificial Sequence
  RNA Oligomer
ugaacaaggcauuuuaacaug

SEQ ID NO: 24923 - RNA, 21 nt, Artificial Sequence
  RNA Oligomer
guggaacguauuuagggaucu

SEQ ID NO: 24924 - RNA, 21 nt, Artificial Sequence
  RNA Oligomer
auguuugguuucccacuguuc

SEQ ID NO: 24925 - RNA, 21 nt, Artificial Sequence
  RNA Oligomer
agaguaccguuuccuaaauuc

SEQ ID NO: 24926 - RNA, 21 nt, Artificial Sequence
  RNA Oligomer
uuccuaaauucaaugucagcg

SEQ ID NO: 24927 - RNA, 21 nt, Artificial Sequence
  RNA Oligomer
caccacaucuaucucaucuug

SEQ ID NO: 24928 - RNA, 21 nt, Artificial Sequence
  RNA Oligomer
cucuauucucuucacuaucug

SEQ ID NO: 24929 - RNA, 21 nt, Artificial Sequence
  RNA Oligomer
uugaauaccagagaaacuuca

SEQ ID NO: 24930 - RNA, 21 nt, Artificial Sequence
  RNA Oligomer
uaccagagaaacuucaauaug

SEQ ID NO: 24931 - RNA, 21 nt, Artificial Sequence
  RNA Oligomer
aaaucagcaugaaguucccag

SEQ ID NO: 24932 - RNA, 21 nt, Artificial Sequence
  RNA Oligomer
aaucagcaugaaguucccagu

SEQ ID NO: 24933 - RNA, 21 nt, Artificial Sequence
  RNA Oligomer
aucagcaugaaguucccaguu

SEQ ID NO: 24934 - RNA, 21 nt, Artificial Sequence
  RNA Oligomer
uuccaaaagcugcuccgugug

SEQ ID NO: 24935 - RNA, 21 nt, Artificial Sequence
  RNA Oligomer
ccacaaaagaaacauuagucc

SEQ ID NO: 24936 - RNA, 21 nt, Artificial Sequence
  RNA Oligomer
gauguaccaacugacaacugc

SEQ ID NO: 24937 - RNA, 21 nt, Artificial Sequence
  RNA Oligomer
cauguguggaagagauugcgu

SEQ ID NO: 24938 - RNA, 21 nt, Artificial Sequence
  RNA Oligomer
acuuacacauugcugcagucu

SEQ ID NO: 24939 - RNA, 21 nt, Artificial Sequence
  RNA Oligomer
auuacaccugacagcucaaac

SEQ ID NO: 24940 - RNA, 21 nt, Artificial Sequence
  RNA Oligomer
cagcucaaacaggacgucucu

SEQ ID NO: 24941 - RNA, 21 nt, Artificial Sequence
  RNA Oligomer
uaaagcuugaugucuggucca

SEQ ID NO: 24942 - RNA, 21 nt, Artificial Sequence
  RNA Oligomer
caacagcuuauacacaucucc

SEQ ID NO: 24943 - RNA, 21 nt, Artificial Sequence
  RNA Oligomer
aacagcuuauacacaucucca

SEQ ID NO: 24944 - RNA, 21 nt, Artificial Sequence
  RNA Oligomer
agccgugaaauaaucaacuca

SEQ ID NO: 24945 - RNA, 21 nt, Artificial Sequence
  RNA Oligomer
caggauugauuaaaaagcgga

SEQ ID NO: 24946 - RNA, 21 nt, Artificial Sequence
  RNA Oligomer
ugacuuaucaagacuuagcug

SEQ ID NO: 24947 - RNA, 21 nt, Artificial Sequence
  RNA Oligomer
guaccuucguaagugacaugc

SEQ ID NO: 24948 - RNA, 21 nt, Artificial Sequence
  RNA Oligomer
uaccuucguaagugacaugca

SEQ ID NO: 24949 - RNA, 21 nt, Artificial Sequence
  RNA Oligomer
cucugucuuguaaaugucacc

SEQ ID NO: 24950 - RNA, 21 nt, Artificial Sequence
  RNA Oligomer
guuccugcgacauugugaugg

SEQ ID NO: 24951 - RNA, 21 nt, Artificial Sequence
  RNA Oligomer
uggacugauauaaauguugag

SEQ ID NO: 24952 - RNA, 21 nt, Artificial Sequence
  RNA Oligomer
cugauauaaauguugagcuuc

SEQ ID NO: 24953 - RNA, 21 nt, Artificial Sequence
  RNA Oligomer
aaguaccuuaucccagaaauc

SEQ ID NO: 24954 - RNA, 21 nt, Artificial Sequence
  RNA Oligomer
accuuaucccagaaaucgauc

SEQ ID NO: 24955 - RNA, 21 nt, Artificial Sequence
  RNA Oligomer
ucuuagaauaugccacauugu

SEQ ID NO: 24956 - RNA, 21 nt, Artificial Sequence
  RNA Oligomer
uccugcucgcaaaagaucuac

SEQ ID NO: 24957 - RNA, 21 nt, Artificial Sequence
  RNA Oligomer
gagaaaggugagguggaacgu

SEQ ID NO: 24958 - RNA, 21 nt, Artificial Sequence
  RNA Oligomer
uucuguucuuugauguuuggu

SEQ ID NO: 24959 - RNA, 21 nt, Artificial Sequence
  RNA Oligomer
auucauuccagugcgacucuc

SEQ ID NO: 24960 - RNA, 21 nt, Artificial Sequence
  RNA Oligomer
ggaaauguaaucuaacuucac

SEQ ID NO: 24961 - RNA, 21 nt, Artificial Sequence
  RNA Oligomer
gaaauguaaucuaacuucacc

SEQ ID NO: 24962 - RNA, 21 nt, Artificial Sequence
  RNA Oligomer
uucaccgcccuuaguagagua

SEQ ID NO: 24963 - RNA, 21 nt, Artificial Sequence
  RNA Oligomer
ucaccgcccuuaguagaguac

SEQ ID NO: 24964 - RNA, 21 nt, Artificial Sequence
  RNA Oligomer
uaccguuuccuaaauucaaug

SEQ ID NO: 24965 - RNA, 21 nt, Artificial Sequence
  RNA Oligomer
guuuccuaaauucaaugucag

SEQ ID NO: 24966 - RNA, 21 nt, Artificial Sequence
  RNA Oligomer
cuaaauucaaugucagcgucu

SEQ ID NO: 24967 - RNA, 21 nt, Artificial Sequence
  RNA Oligomer
ucugacaauggacucucuggc

SEQ ID NO: 24968 - RNA, 21 nt, Artificial Sequence
  RNA Oligomer
cugacaauggacucucuggca

SEQ ID NO: 24969 - RNA, 21 nt, Artificial Sequence
  RNA Oligomer
aagacuugcugcacuucuggu

SEQ ID NO: 24970 - RNA, 21 nt, Artificial Sequence
  RNA Oligomer
ucucuggccuguucaucuucc

SEQ ID NO: 24971 - RNA, 21 nt, Artificial Sequence
  RNA Oligomer
uaaacacucgccugcuuucuc

SEQ ID NO: 24972 - RNA, 21 nt, Artificial Sequence
  RNA Oligomer
acuuuccaaaagcugcuccgu

SEQ ID NO: 24973 - RNA, 21 nt, Artificial Sequence
  RNA Oligomer
cacaaaagaaacauuaguccu

SEQ ID NO: 24974 - RNA, 21 nt, Artificial Sequence
  RNA Oligomer
uuccacauuuccuuucaucuc

SEQ ID NO: 24975 - RNA, 21 nt, Artificial Sequence
  RNA Oligomer
guguguuucccuucauuuugc

SEQ ID NO: 24976 - RNA, 21 nt, Artificial Sequence
  RNA Oligomer
aacugguauaauauaugggca

SEQ ID NO: 24977 - RNA, 21 nt, Artificial Sequence
  RNA Oligomer
ugccacuuacacauugcugca

SEQ ID NO: 24978 - RNA, 21 nt, Artificial Sequence
  RNA Oligomer
auauuacaccugacagcucaa

SEQ ID NO: 24979 - RNA, 21 nt, Artificial Sequence
  RNA Oligomer
gaacaguuucugcauucuuca

SEQ ID NO: 24980 - RNA, 21 nt, Artificial Sequence
  RNA Oligomer
uucauuguaguaucguagcaa

SEQ ID NO: 24981 - RNA, 21 nt, Artificial Sequence
  RNA Oligomer
aauaaaccacaucucgcucag

SEQ ID NO: 24982 - RNA, 21 nt, Artificial Sequence
  RNA Oligomer
uucagcucgcgucucauuuuc

SEQ ID NO: 24983 - RNA, 21 nt, Artificial Sequence
  RNA Oligomer
ucagcucgcgucucauuuucu

SEQ ID NO: 24984 - RNA, 21 nt, Artificial Sequence
  RNA Oligomer
aguaccugugauaauuagaca

SEQ ID NO: 24985 - RNA, 21 nt, Artificial Sequence
  RNA Oligomer
ugaagagccgugaaauaauca

SEQ ID NO: 24986 - RNA, 21 nt, Artificial Sequence
  RNA Oligomer
auuucuucuugcacaaguccu

SEQ ID NO: 24987 - RNA, 21 nt, Artificial Sequence
  RNA Oligomer
ugucaaggguuuuucacaucu

SEQ ID NO: 24988 - RNA, 21 nt, Artificial Sequence
  RNA Oligomer
gaaaaucuucaagacucuguc

SEQ ID NO: 24989 - RNA, 21 nt, Artificial Sequence
  RNA Oligomer
acuuagcugagaaacauuuuc

SEQ ID NO: 24990 - RNA, 21 nt, Artificial Sequence
  RNA Oligomer
aaaguagcagaagagcguuuu

SEQ ID NO: 24991 - RNA, 21 nt, Artificial Sequence
  RNA Oligomer
uuuuaaguuucuccgguuucc

SEQ ID NO: 24992 - RNA, 21 nt, Artificial Sequence
  RNA Oligomer
agugcaauuuucaccauauca

SEQ ID NO: 24993 - RNA, 21 nt, Artificial Sequence
  RNA Oligomer
caagauggacugauauaaaug

SEQ ID NO: 24994 - RNA, 21 nt, Artificial Sequence
  RNA Oligomer
cuucuucaaguaccuuauccc

SEQ ID NO: 24995 - RNA, 21 nt, Artificial Sequence
  RNA Oligomer
guucugaacaaggcauuuuaa

SEQ ID NO: 24996 - RNA, 21 nt, Artificial Sequence
  RNA Oligomer
uccauguugcuuagaauuucu

SEQ ID NO: 24997 - RNA, 21 nt, Artificial Sequence
  RNA Oligomer
cucucuccuccuucaaauugg

SEQ ID NO: 24998 - RNA, 21 nt, Artificial Sequence
  RNA Oligomer
cguuuccuaaauucaauguca

SEQ ID NO: 24999 - RNA, 21 nt, Artificial Sequence
  RNA Oligomer
uccuaaauucaaugucagcgu

SEQ ID NO: 25000 - RNA, 21 nt, Artificial Sequence
  RNA Oligomer
uugucuccucaucugcuucug

SEQ ID NO: 25001 - RNA, 21 nt, Artificial Sequence
  RNA Oligomer
cucuggcaccacaucuaucuc

SEQ ID NO: 25002 - RNA, 21 nt, Artificial Sequence
  RNA Oligomer
cucaucuugcugacaacuugc

SEQ ID NO: 25003 - RNA, 21 nt, Artificial Sequence
  RNA Oligomer
uagaugauaugggaguuucug

SEQ ID NO: 25004 - RNA, 21 nt, Artificial Sequence
  RNA Oligomer
gaaauaaaccacaucucgcuc

SEQ ID NO: 25005 - RNA, 21 nt, Artificial Sequence
  RNA Oligomer
aaauaaaccacaucucgcuca

SEQ ID NO: 25006 - RNA, 21 nt, Artificial Sequence
  RNA Oligomer
uauuaaggcuuuuaaccuggc

SEQ ID NO: 25007 - RNA, 21 nt, Artificial Sequence
  RNA Oligomer
aaauccacaguaagccuuguu

SEQ ID NO: 25008 - RNA, 21 nt, Artificial Sequence
  RNA Oligomer
aagagccgugaaauaaucaac

SEQ ID NO: 25009 - RNA, 21 nt, Artificial Sequence
  RNA Oligomer
gauuaaaaagcggauuucuuc

SEQ ID NO: 25010 - RNA, 21 nt, Artificial Sequence
  RNA Oligomer
uuucuucuugcacaaguccug

SEQ ID NO: 25011 - RNA, 21 nt, Artificial Sequence
  RNA Oligomer
caccuccaacaaaacgauuug

SEQ ID NO: 25012 - RNA, 21 nt, Artificial Sequence
  RNA Oligomer
uuuucuucuaugguaccuucg

SEQ ID NO: 25013 - RNA, 21 nt, Artificial Sequence
  RNA Oligomer
gucuuguaaaugucaccaacc

SEQ ID NO: 25014 - RNA, 21 nt, Artificial Sequence
  RNA Oligomer
cuuguaaaugucaccaaccca

SEQ ID NO: 25015 - RNA, 21 nt, Artificial Sequence
  RNA Oligomer
uuguaaaugucaccaacccag

SEQ ID NO: 25016 - RNA, 21 nt, Artificial Sequence
  RNA Oligomer
gacuuagcugagaaacauuuu

SEQ ID NO: 25017 - RNA, 21 nt, Artificial Sequence
  RNA Oligomer
cuuuuuguacagaacucauca

SEQ ID NO: 25018 - RNA, 21 nt, Artificial Sequence
  RNA Oligomer
uuuaaguuucuccgguuuccu

SEQ ID NO: 25019 - RNA, 21 nt, Artificial Sequence
  RNA Oligomer
gacugauauaaauguugagcu

SEQ ID NO: 25020 - RNA, 21 nt, Artificial Sequence
  RNA Oligomer
gauauaaauguugagcuucug

SEQ ID NO: 25021 - RNA, 21 nt, Artificial Sequence
  RNA Oligomer
cauuucuuagaauaugccaca

SEQ ID NO: 25022 - RNA, 21 nt, Artificial Sequence
  RNA Oligomer
gaauccuuuuuuccauguugc

SEQ ID NO: 25023 - RNA, 21 nt, Artificial Sequence
  RNA Oligomer
aauccuuuuuuccauguugcu

SEQ ID NO: 25024 - RNA, 21 nt, Artificial Sequence
  RNA Oligomer
uuccauguugcuuagaauuuc

SEQ ID NO: 25025 - RNA, 21 nt, Artificial Sequence
  RNA Oligomer
uuaaaucauucauuccagugc

SEQ ID NO: 25026 - RNA, 21 nt, Artificial Sequence
  RNA Oligomer
aagguuuauuugcuguuuggg

SEQ ID NO: 25027 - RNA, 21 nt, Artificial Sequence
  RNA Oligomer
acuugucuccucaucugcuuc

SEQ ID NO: 25028 - RNA, 21 nt, Artificial Sequence
  RNA Oligomer
auuuccuaggcaacuuucuug

SEQ ID NO: 25029 - RNA, 21 nt, Artificial Sequence
  RNA Oligomer
uguucaucuuccguagucugc

SEQ ID NO: 25030 - RNA, 21 nt, Artificial Sequence
  RNA Oligomer
caucuuccguagucugcuuug

SEQ ID NO: 25031 - RNA, 21 nt, Artificial Sequence
  RNA Oligomer
auaugggaguuucugacaaag

SEQ ID NO: 25032 - RNA, 21 nt, Artificial Sequence
  RNA Oligomer
accacaaaagaaacauuaguc

SEQ ID NO: 25033 - RNA, 21 nt, Artificial Sequence
  RNA Oligomer
gaaacuauuuuaaccuaggag

SEQ ID NO: 25034 - RNA, 21 nt, Artificial Sequence
  RNA Oligomer
auguguggaagagauugcguc

SEQ ID NO: 25035 - RNA, 21 nt, Artificial Sequence
  RNA Oligomer
uuauacacaucuccaacagug

SEQ ID NO: 25036 - RNA, 21 nt, Artificial Sequence
  RNA Oligomer
uucaguaaggaaaaugugcau

SEQ ID NO: 25037 - RNA, 21 nt, Artificial Sequence
  RNA Oligomer
aguaaggaaaaugugcaugcu

SEQ ID NO: 25038 - RNA, 21 nt, Artificial Sequence
  RNA Oligomer
acucaggauugauuaaaaagc

SEQ ID NO: 25039 - RNA, 21 nt, Artificial Sequence
  RNA Oligomer
uacaccaccuccaacaaaacg

SEQ ID NO: 25040 - RNA, 21 nt, Artificial Sequence
  RNA Oligomer
gugacuuaucaagacuuagcu

SEQ ID NO: 25041 - RNA, 21 nt, Artificial Sequence
  RNA Oligomer
acuuaucaagacuuagcugag

SEQ ID NO: 25042 - RNA, 21 nt, Artificial Sequence
  RNA Oligomer
uucacaucuuucccauucugg

SEQ ID NO: 25043 - RNA, 21 nt, Artificial Sequence
  RNA Oligomer
ggacugauauaaauguugagc

SEQ ID NO: 25044 - RNA, 21 nt, Artificial Sequence
  RNA Oligomer
uucaaguaccuuaucccagaa

SEQ ID NO: 25045 - RNA, 21 nt, Artificial Sequence
  RNA Oligomer
guaaagucccauuucuuagaa

SEQ ID NO: 25046 - RNA, 21 nt, Artificial Sequence
  RNA Oligomer
cccauuucuuagaauaugcca

SEQ ID NO: 25047 - RNA, 21 nt, Artificial Sequence
  RNA Oligomer
aaaucauucauuccagugcga

SEQ ID NO: 25048 - RNA, 21 nt, Artificial Sequence
  RNA Oligomer
guuuauuugcuguuugggagg

SEQ ID NO: 25049 - RNA, 21 nt, Artificial Sequence
  RNA Oligomer
ugucuccucaucugcuucuga

SEQ ID NO: 25050 - RNA, 21 nt, Artificial Sequence
  RNA Oligomer
ucuggccuguucaucuuccgu

SEQ ID NO: 25051 - RNA, 21 nt, Artificial Sequence
  RNA Oligomer
uggccuguucaucuuccguag

SEQ ID NO: 25052 - RNA, 21 nt, Artificial Sequence
  RNA Oligomer
cuguucaucuuccguagucug

SEQ ID NO: 25053 - RNA, 21 nt, Artificial Sequence
  RNA Oligomer
auugucucuauucucuucacu

SEQ ID NO: 25054 - RNA, 21 nt, Artificial Sequence
  RNA Oligomer
uaugggaguuucugacaaagu

SEQ ID NO: 25055 - RNA, 21 nt, Artificial Sequence
  RNA Oligomer
ugggaguuucugacaaaguga

SEQ ID NO: 25056 - RNA, 21 nt, Artificial Sequence
  RNA Oligomer
cuccuuuuauuccacauuucc

SEQ ID NO: 25057 - RNA, 21 nt, Artificial Sequence
  RNA Oligomer
uaucguagcaacagcuuauac

SEQ ID NO: 25058 - RNA, 21 nt, Artificial Sequence
  RNA Oligomer
guaaggaaaaugugcaugcug

SEQ ID NO: 25059 - RNA, 21 nt, Artificial Sequence
  RNA Oligomer
aaaccacaucucgcucagcug

SEQ ID NO: 25060 - RNA, 21 nt, Artificial Sequence
  RNA Oligomer
guauuaaggcuuuuaaccugg

SEQ ID NO: 25061 - RNA, 21 nt, Artificial Sequence
  RNA Oligomer
agagccgugaaauaaucaacu

SEQ ID NO: 25062 - RNA, 21 nt, Artificial Sequence
  RNA Oligomer
uuacaccaccuccaacaaaac

SEQ ID NO: 25063 - RNA, 21 nt, Artificial Sequence
  RNA Oligomer
aucaagacuuagcugagaaac

SEQ ID NO: 25064 - RNA, 21 nt, Artificial Sequence
  RNA Oligomer
ucuuguaaaugucaccaaccc

SEQ ID NO: 25065 - RNA, 21 nt, Artificial Sequence
  RNA Oligomer
aagagcguuuuaaguuucucc

SEQ ID NO: 25066 - RNA, 21 nt, Artificial Sequence
  RNA Oligomer
uuccuugaugaacgucccuca

SEQ ID NO: 25067 - RNA, 21 nt, Artificial Sequence
  RNA Oligomer
gauuucaucuuagcauuucgu

SEQ ID NO: 25068 - RNA, 21 nt, Artificial Sequence
  RNA Oligomer
uuuucaccauaucaggcaaga

SEQ ID NO: 25069 - RNA, 21 nt, Artificial Sequence
  RNA Oligomer
uuucaccauaucaggcaagau

SEQ ID NO: 25070 - RNA, 21 nt, Artificial Sequence
  RNA Oligomer
ucgcucaccauucucaucuuc

SEQ ID NO: 25071 - RNA, 21 nt, Artificial Sequence
  RNA Oligomer
cugucuugauuccuuuagugu

SEQ ID NO: 25072 - RNA, 21 nt, Artificial Sequence
  RNA Oligomer
cuuucuguucuuugauguuug

SEQ ID NO: 25073 - RNA, 21 nt, Artificial Sequence
  RNA Oligomer
ugaucugugauuuuagaaucc

SEQ ID NO: 25074 - RNA, 21 nt, Artificial Sequence
  RNA Oligomer
agaauccuuuuuuccauguug

SEQ ID NO: 25075 - RNA, 21 nt, Artificial Sequence
  RNA Oligomer
auguuagcauuacuaaacugc

SEQ ID NO: 25076 - RNA, 21 nt, Artificial Sequence
  RNA Oligomer
uucccaccaguccaauuuuau

SEQ ID NO: 25077 - RNA, 21 nt, Artificial Sequence
  RNA Oligomer
auuuuaaccuaggagguuugc

SEQ ID NO: 25078 - RNA, 21 nt, Artificial Sequence
  RNA Oligomer
caacacauaugaaaaaaaccc

SEQ ID NO: 25079 - RNA, 21 nt, Artificial Sequence
  RNA Oligomer
aucgagguagcgucugaagug

SEQ ID NO: 25080 - RNA, 21 nt, Artificial Sequence
  RNA Oligomer
auuuucuucuaugguaccuuc

SEQ ID NO: 25081 - RNA, 21 nt, Artificial Sequence
  RNA Oligomer
uuaucaagacuuagcugagaa

SEQ ID NO: 25082 - RNA, 21 nt, Artificial Sequence
  RNA Oligomer
guuuuaaguuucuccgguuuc

SEQ ID NO: 25083 - RNA, 21 nt, Artificial Sequence
  RNA Oligomer
cgauuucaucuuagcauuucg

SEQ ID NO: 25084 - RNA, 21 nt, Artificial Sequence
  RNA Oligomer
uucuuugauguuugguuuccc

SEQ ID NO: 25085 - RNA, 21 nt, Artificial Sequence
  RNA Oligomer
uuuauuugcuguuugggagga

SEQ ID NO: 25086 - RNA, 21 nt, Artificial Sequence
  RNA Oligomer
uuauuugcuguuugggaggaa

SEQ ID NO: 25087 - RNA, 21 nt, Artificial Sequence
  RNA Oligomer
uuuguugucauuuuuuggccc

SEQ ID NO: 25088 - RNA, 21 nt, Artificial Sequence
  RNA Oligomer
cauauagacacacuuaaagag

SEQ ID NO: 25089 - RNA, 21 nt, Artificial Sequence
  RNA Oligomer
caacugguauaauauaugggc

SEQ ID NO: 25090 - RNA, 21 nt, Artificial Sequence
  RNA Oligomer
ucaguaaggaaaaugugcaug

SEQ ID NO: 25091 - RNA, 21 nt, Artificial Sequence
  RNA Oligomer
ucucucaucaauucugagucc

SEQ ID NO: 25092 - RNA, 21 nt, Artificial Sequence
  RNA Oligomer
cucaccauucucaucuuccac

SEQ ID NO: 25093 - RNA, 21 nt, Artificial Sequence
  RNA Oligomer
uucugcauucuacauucaggc

SEQ ID NO: 25094 - RNA, 21 nt, Artificial Sequence
  RNA Oligomer
uaucucaucuugcugacaacu

SEQ ID NO: 25095 - RNA, 21 nt, Artificial Sequence
  RNA Oligomer
auuugcaagcuuuacaguugu

SEQ ID NO: 25096 - RNA, 21 nt, Artificial Sequence
  RNA Oligomer
uaccaggguuacuguuugagg

SEQ ID NO: 25097 - RNA, 21 nt, Artificial Sequence
  RNA Oligomer
uuuucuuuacaccacaucagg

SEQ ID NO: 25098 - RNA, 21 nt, Artificial Sequence
  RNA Oligomer
uauaugggcaggaagaaagag

SEQ ID NO: 25099 - RNA, 21 nt, Artificial Sequence
  RNA Oligomer
augggcaggaagaaagagacc

SEQ ID NO: 25100 - RNA, 21 nt, Artificial Sequence
  RNA Oligomer
ugaauggauaaagcuugaugu

SEQ ID NO: 25101 - RNA, 21 nt, Artificial Sequence
  RNA Oligomer
uaaggaaaaugugcaugcugu

SEQ ID NO: 25102 - RNA, 21 nt, Artificial Sequence
  RNA Oligomer
uagcaugccuuggccauuuuc

SEQ ID NO: 25103 - RNA, 21 nt, Artificial Sequence
  RNA Oligomer
uuuucacaucuuucccauucu

SEQ ID NO: 25104 - RNA, 21 nt, Artificial Sequence
  RNA Oligomer
uuucacaucuuucccauucug

SEQ ID NO: 25105 - RNA, 21 nt, Artificial Sequence
  RNA Oligomer
uaaguuucuccgguuuccuug

SEQ ID NO: 25106 - RNA, 21 nt, Artificial Sequence
  RNA Oligomer
aucaaagcuguaaagucccau

SEQ ID NO: 25107 - RNA, 21 nt, Artificial Sequence
  RNA Oligomer
cgcucaccauucucaucuucc

SEQ ID NO: 25108 - RNA, 21 nt, Artificial Sequence
  RNA Oligomer
aauaguuacugugugauuggc

SEQ ID NO: 25109 - RNA, 21 nt, Artificial Sequence
  RNA Oligomer
uuaguguccauccaacuggua

SEQ ID NO: 25110 - RNA, 21 nt, Artificial Sequence
  RNA Oligomer
uucuucuguccucugcuuugg

SEQ ID NO: 25111 - RNA, 21 nt, Artificial Sequence
  RNA Oligomer
uuuuuggcccaguaccaacau

SEQ ID NO: 25112 - RNA, 21 nt, Artificial Sequence
  RNA Oligomer
ucagaggaaaaaagacagaca

SEQ ID NO: 25113 - RNA, 21 nt, Artificial Sequence
  RNA Oligomer
gcaacacauaugaaaaaaacc

SEQ ID NO: 25114 - RNA, 21 nt, Artificial Sequence
  RNA Oligomer
augaauggauaaagcuugaug

SEQ ID NO: 25115 - RNA, 21 nt, Artificial Sequence
  RNA Oligomer
uguccauccaacugguaauag

SEQ ID NO: 25116 - RNA, 21 nt, Artificial Sequence
  RNA Oligomer
uauuuagggaucuuccuuucu

SEQ ID NO: 25117 - RNA, 21 nt, Artificial Sequence
  RNA Oligomer
uucuuuucuucuguccucugc

SEQ ID NO: 25118 - RNA, 21 nt, Artificial Sequence
  RNA Oligomer
cauuucacuaaccugagagag

SEQ ID NO: 25119 - RNA, 21 nt, Artificial Sequence
  RNA Oligomer
auuuguugucauuuuuuggcc

SEQ ID NO: 25120 - RNA, 21 nt, Artificial Sequence
  RNA Oligomer
uuuggcccaguaccaacaucc

SEQ ID NO: 25121 - RNA, 21 nt, Artificial Sequence
  RNA Oligomer
uugguuauaugaauaugccuc

SEQ ID NO: 25122 - RNA, 21 nt, Artificial Sequence
  RNA Oligomer
aaucuguuuucuuuacaccac

SEQ ID NO: 25123 - RNA, 21 nt, Artificial Sequence
  RNA Oligomer
gaaaaaagacagacaaaccau

SEQ ID NO: 25124 - RNA, 21 nt, Artificial Sequence
  RNA Oligomer
uaugggcaggaagaaagagac

SEQ ID NO: 25125 - RNA, 21 nt, Artificial Sequence
  RNA Oligomer
gaauggauaaagcuugauguc

SEQ ID NO: 25126 - RNA, 21 nt, Artificial Sequence
  RNA Oligomer
augcuguaaaugucucucauc

SEQ ID NO: 25127 - RNA, 21 nt, Artificial Sequence
  RNA Oligomer
ugccaauaucuguauuaaggc

SEQ ID NO: 25128 - RNA, 21 nt, Artificial Sequence
  RNA Oligomer
aaguuucuccgguuuccuuga

SEQ ID NO: 25129 - RNA, 21 nt, Artificial Sequence
  RNA Oligomer
uuucuccgguuuccuugauga

SEQ ID NO: 25130 - RNA, 21 nt, Artificial Sequence
  RNA Oligomer
aagcauuagcuaaaagacugg

SEQ ID NO: 25131 - RNA, 21 nt, Artificial Sequence
  RNA Oligomer
gacauugugauggaaugauuc

SEQ ID NO: 25132 - RNA, 21 nt, Artificial Sequence
  RNA Oligomer
aauuuuguucugaacaaggca

SEQ ID NO: 25133 - RNA, 21 nt, Artificial Sequence
  RNA Oligomer
gaauaguuacugugugauugg

SEQ ID NO: 25134 - RNA, 21 nt, Artificial Sequence
  RNA Oligomer
uacugugugauuggcagaugg

SEQ ID NO: 25135 - RNA, 21 nt, Artificial Sequence
  RNA Oligomer
uuuaguguccauccaacuggu

SEQ ID NO: 25136 - RNA, 21 nt, Artificial Sequence
  RNA Oligomer
aucuggagaaaggugaggugg

SEQ ID NO: 25137 - RNA, 21 nt, Artificial Sequence
  RNA Oligomer
uguucuuugauguuugguuuc

SEQ ID NO: 25138 - RNA, 21 nt, Artificial Sequence
  RNA Oligomer
acugugaucaucauuuugagg

SEQ ID NO: 25139 - RNA, 21 nt, Artificial Sequence
  RNA Oligomer
cagagaaacuucaauauguac

SEQ ID NO: 25140 - RNA, 21 nt, Artificial Sequence
  RNA Oligomer
cuuugguuauaugaauaugcc

SEQ ID NO: 25141 - RNA, 21 nt, Artificial Sequence
  RNA Oligomer
aucuguuuucuuuacaccaca

SEQ ID NO: 25142 - RNA, 21 nt, Artificial Sequence
  RNA Oligomer
gcaacugguauaauauauggg

SEQ ID NO: 25143 - RNA, 21 nt, Artificial Sequence
  RNA Oligomer
auuucacaagagaucugaugg

SEQ ID NO: 25144 - RNA, 21 nt, Artificial Sequence
  RNA Oligomer
aucuaaguccacgugagucag

SEQ ID NO: 25145 - RNA, 21 nt, Artificial Sequence
  RNA Oligomer
augugcaugcuguaaaugucu

SEQ ID NO: 25146 - RNA, 21 nt, Artificial Sequence
  RNA Oligomer
uagccuguguauucacuguac

SEQ ID NO: 25147 - RNA, 21 nt, Artificial Sequence
  RNA Oligomer
uuuuucacaucuuucccauuc

SEQ ID NO: 25148 - RNA, 21 nt, Artificial Sequence
  RNA Oligomer
agguuuuuucucugugacucu

SEQ ID NO: 25149 - RNA, 21 nt, Artificial Sequence
  RNA Oligomer
guuuuuucucugugacucuuc

SEQ ID NO: 25150 - RNA, 21 nt, Artificial Sequence
  RNA Oligomer
uugugauggaaugauucaucu

SEQ ID NO: 25151 - RNA, 21 nt, Artificial Sequence
  RNA Oligomer
cgcaguaaaaucuuugacaaa

SEQ ID NO: 25152 - RNA, 21 nt, Artificial Sequence
  RNA Oligomer
ccgcaguaaaaucuuugacaa

SEQ ID NO: 25153 - RNA, 21 nt, Artificial Sequence
  RNA Oligomer
caagggugcauuuauuucaaa

SEQ ID NO: 25154 - RNA, 21 nt, Artificial Sequence
  RNA Oligomer
uguauuuuuguacccuuccua

SEQ ID NO: 25155 - RNA, 21 nt, Artificial Sequence
  RNA Oligomer
ugauguauuuuuguacccuuc

SEQ ID NO: 25156 - RNA, 21 nt, Artificial Sequence
  RNA Oligomer
gcaugauguauuuuuguaccc

SEQ ID NO: 25157 - RNA, 21 nt, Artificial Sequence
  RNA Oligomer
ucaagggugcauuuauuucaa

SEQ ID NO: 25158 - RNA, 21 nt, Artificial Sequence
  RNA Oligomer
ccuuguugcaugauguauuuu

SEQ ID NO: 25159 - RNA, 21 nt, Artificial Sequence
  RNA Oligomer
accuuguugcaugauguauuu

SEQ ID NO: 25160 - RNA, 21 nt, Artificial Sequence
  RNA Oligomer
gaaaagugaaugcucaaguuu

SEQ ID NO: 25161 - RNA, 21 nt, Artificial Sequence
  RNA Oligomer
agaaaagugaaugcucaaguu

SEQ ID NO: 25162 - RNA, 21 nt, Artificial Sequence
  RNA Oligomer
ggaaucgauuauaagcaaaag

SEQ ID NO: 25163 - RNA, 21 nt, Artificial Sequence
  RNA Oligomer
guauuuuuguacccuuccuac

SEQ ID NO: 25164 - RNA, 21 nt, Artificial Sequence
  RNA Oligomer
gguaacauccuuucuauugaa

SEQ ID NO: 25165 - RNA, 21 nt, Artificial Sequence
  RNA Oligomer
agaauaaaagaucuggcccau

SEQ ID NO: 25166 - RNA, 21 nt, Artificial Sequence
  RNA Oligomer
cuggaaucgauuauaagcaaa

SEQ ID NO: 25167 - RNA, 21 nt, Artificial Sequence
  RNA Oligomer
gcuggaaucgauuauaagcaa

SEQ ID NO: 25168 - RNA, 21 nt, Artificial Sequence
  RNA Oligomer
ccauaauuugcaaccagagaa

SEQ ID NO: 25169 - RNA, 21 nt, Artificial Sequence
  RNA Oligomer
caaaacauccuugcaacauua

SEQ ID NO: 25170 - RNA, 21 nt, Artificial Sequence
  RNA Oligomer
cuuucaagggugcauuuauuu

SEQ ID NO: 25171 - RNA, 21 nt, Artificial Sequence
  RNA Oligomer
gcuuucaagggugcauuuauu

SEQ ID NO: 25172 - RNA, 21 nt, Artificial Sequence
  RNA Oligomer
gaaugcucaaguuuuucagaa

SEQ ID NO: 25173 - RNA, 21 nt, Artificial Sequence
  RNA Oligomer
ugaagaaaagugaaugcucaa

SEQ ID NO: 25174 - RNA, 21 nt, Artificial Sequence
  RNA Oligomer
cucaugugauccuuuuauguu

SEQ ID NO: 25175 - RNA, 21 nt, Artificial Sequence
  RNA Oligomer
ucucaugugauccuuuuaugu

SEQ ID NO: 25176 - RNA, 21 nt, Artificial Sequence
  RNA Oligomer
acauguagacugccaaagugu

SEQ ID NO: 25177 - RNA, 21 nt, Artificial Sequence
  RNA Oligomer
gacaaguuucuucagugugug

SEQ ID NO: 25178 - RNA, 21 nt, Artificial Sequence
  RNA Oligomer
agagcuggaaucgauuauaag

SEQ ID NO: 25179 - RNA, 21 nt, Artificial Sequence
  RNA Oligomer
ugauacaugguggaagagaag

SEQ ID NO: 25180 - RNA, 21 nt, Artificial Sequence
  RNA Oligomer
gggugauacaugguggaagag

SEQ ID NO: 25181 - RNA, 21 nt, Artificial Sequence
  RNA Oligomer
cccgcaguaaaaucuuugaca

SEQ ID NO: 25182 - RNA, 21 nt, Artificial Sequence
  RNA Oligomer
ugaaugcucaaguuuuucaga

SEQ ID NO: 25183 - RNA, 21 nt, Artificial Sequence
  RNA Oligomer
agaacaggcaagugaagaaaa

SEQ ID NO: 25184 - RNA, 21 nt, Artificial Sequence
  RNA Oligomer
cacuuuaauucucaugugauc

SEQ ID NO: 25185 - RNA, 21 nt, Artificial Sequence
  RNA Oligomer
cagaccugacaaguuucuuca

SEQ ID NO: 25186 - RNA, 21 nt, Artificial Sequence
  RNA Oligomer
aagagcuggaaucgauuauaa

SEQ ID NO: 25187 - RNA, 21 nt, Artificial Sequence
  RNA Oligomer
gugauacaugguggaagagaa

SEQ ID NO: 25188 - RNA, 21 nt, Artificial Sequence
  RNA Oligomer
ggaguguggaaguccauaauu

SEQ ID NO: 25189 - RNA, 21 nt, Artificial Sequence
  RNA Oligomer
gcucaauggaucccgcaguaa

SEQ ID NO: 25190 - RNA, 21 nt, Artificial Sequence
  RNA Oligomer
gcaacauuacugaagaagacu

SEQ ID NO: 25191 - RNA, 21 nt, Artificial Sequence
  RNA Oligomer
gugaaugcucaaguuuuucag

SEQ ID NO: 25192 - RNA, 21 nt, Artificial Sequence
  RNA Oligomer
gcaagugaagaaaagugaaug

SEQ ID NO: 25193 - RNA, 21 nt, Artificial Sequence
  RNA Oligomer
ggcaagugaagaaaagugaau

SEQ ID NO: 25194 - RNA, 21 nt, Artificial Sequence
  RNA Oligomer
ccuugacuccuugugguuuau

SEQ ID NO: 25195 - RNA, 21 nt, Artificial Sequence
  RNA Oligomer
cugagaugagacauguagacu

SEQ ID NO: 25196 - RNA, 21 nt, Artificial Sequence
  RNA Oligomer
ugacaaguuucuucagugugu

SEQ ID NO: 25197 - RNA, 21 nt, Artificial Sequence
  RNA Oligomer
aaagagcuggaaucgauuaua

SEQ ID NO: 25198 - RNA, 21 nt, Artificial Sequence
  RNA Oligomer
agagaagauuccagagacuua

SEQ ID NO: 25199 - RNA, 21 nt, Artificial Sequence
  RNA Oligomer
ugggugauacaugguggaaga

SEQ ID NO: 25200 - RNA, 21 nt, Artificial Sequence
  RNA Oligomer
gaaguccauaauuugcaacca

SEQ ID NO: 25201 - RNA, 21 nt, Artificial Sequence
  RNA Oligomer
gaauaaaagaucuggcccauc

SEQ ID NO: 25202 - RNA, 21 nt, Artificial Sequence
  RNA Oligomer
ucaaaacauccuugcaacauu

SEQ ID NO: 25203 - RNA, 21 nt, Artificial Sequence
  RNA Oligomer
gaccuuguugcaugauguauu

SEQ ID NO: 25204 - RNA, 21 nt, Artificial Sequence
  RNA Oligomer
ugaaugaccuuguugcaugau

SEQ ID NO: 25205 - RNA, 21 nt, Artificial Sequence
  RNA Oligomer
aggcaagugaagaaaagugaa

SEQ ID NO: 25206 - RNA, 21 nt, Artificial Sequence
  RNA Oligomer
uuauuagaacaggcaagugaa

SEQ ID NO: 25207 - RNA, 21 nt, Artificial Sequence
  RNA Oligomer
cucuuauuagaacaggcaagu

SEQ ID NO: 25208 - RNA, 21 nt, Artificial Sequence
  RNA Oligomer
uccugagaugagacauguaga

SEQ ID NO: 25209 - RNA, 21 nt, Artificial Sequence
  RNA Oligomer
ccugggugauacaugguggaa

SEQ ID NO: 25210 - RNA, 21 nt, Artificial Sequence
  RNA Oligomer
guccauaauuugcaaccagag

SEQ ID NO: 25211 - RNA, 21 nt, Artificial Sequence
  RNA Oligomer
ggaaguccauaauuugcaacc

SEQ ID NO: 25212 - RNA, 21 nt, Artificial Sequence
  RNA Oligomer
gggugcauuuauuucaaaaca

SEQ ID NO: 25213 - RNA, 21 nt, Artificial Sequence
  RNA Oligomer
ugaccuuguugcaugauguau

SEQ ID NO: 25214 - RNA, 21 nt, Artificial Sequence
  RNA Oligomer
acuuauaucaucagcauaccu

SEQ ID NO: 25215 - RNA, 21 nt, Artificial Sequence
  RNA Oligomer
gaaucgauuauaagcaaaagg

SEQ ID NO: 25216 - RNA, 21 nt, Artificial Sequence
  RNA Oligomer
auaaaagagcuggaaucgauu

SEQ ID NO: 25217 - RNA, 21 nt, Artificial Sequence
  RNA Oligomer
agaagauuccagagacuuaug

SEQ ID NO: 25218 - RNA, 21 nt, Artificial Sequence
  RNA Oligomer
acaugguggaagagaagauuc

SEQ ID NO: 25219 - RNA, 21 nt, Artificial Sequence
  RNA Oligomer
ucaauggaucccgcaguaaaa

SEQ ID NO: 25220 - RNA, 21 nt, Artificial Sequence
  RNA Oligomer
gugguccaugugaugcucaau

SEQ ID NO: 25221 - RNA, 21 nt, Artificial Sequence
  RNA Oligomer
augaccuuguugcaugaugua

SEQ ID NO: 25222 - RNA, 21 nt, Artificial Sequence
  RNA Oligomer
cucaaguuuuucagaaagcau

SEQ ID NO: 25223 - RNA, 21 nt, Artificial Sequence
  RNA Oligomer
caggcaagugaagaaaaguga

SEQ ID NO: 25224 - RNA, 21 nt, Artificial Sequence
  RNA Oligomer
gugguuguuuuagcuccuuga

SEQ ID NO: 25225 - RNA, 21 nt, Artificial Sequence
  RNA Oligomer
cugaggauucaucuugcacau

SEQ ID NO: 25226 - RNA, 21 nt, Artificial Sequence
  RNA Oligomer
gagaagauuccagagacuuau

SEQ ID NO: 25227 - RNA, 21 nt, Artificial Sequence
  RNA Oligomer
aagagaagauuccagagacuu

SEQ ID NO: 25228 - RNA, 21 nt, Artificial Sequence
  RNA Oligomer
aguccauaauuugcaaccaga

SEQ ID NO: 25229 - RNA, 21 nt, Artificial Sequence
  RNA Oligomer
ucccgcaguaaaaucuuugac

SEQ ID NO: 25230 - RNA, 21 nt, Artificial Sequence
  RNA Oligomer
cgucaaguacacugaaauuca

SEQ ID NO: 25231 - RNA, 21 nt, Artificial Sequence
  RNA Oligomer
caacauuacugaagaagacua

SEQ ID NO: 25232 - RNA, 21 nt, Artificial Sequence
  RNA Oligomer
ucaucagcauaccuuuauugu

SEQ ID NO: 25233 - RNA, 21 nt, Artificial Sequence
  RNA Oligomer
ugguuguuuuagcuccuugac

SEQ ID NO: 25234 - RNA, 21 nt, Artificial Sequence
  RNA Oligomer
cugugguuguuuuagcuccuu

SEQ ID NO: 25235 - RNA, 21 nt, Artificial Sequence
  RNA Oligomer
caauggaucccgcaguaaaau

SEQ ID NO: 25236 - RNA, 21 nt, Artificial Sequence
  RNA Oligomer
cucaauggaucccgcaguaaa

SEQ ID NO: 25237 - RNA, 21 nt, Artificial Sequence
  RNA Oligomer
ucaaguacacugaaauucauc

SEQ ID NO: 25238 - RNA, 21 nt, Artificial Sequence
  RNA Oligomer
caguauucuggaaaacgguuu

SEQ ID NO: 25239 - RNA, 21 nt, Artificial Sequence
  RNA Oligomer
gcuggugcagagcugaagauu

SEQ ID NO: 25240 - RNA, 21 nt, Artificial Sequence
  RNA Oligomer
gcugugguuguuuuagcuccu

SEQ ID NO: 25241 - RNA, 21 nt, Artificial Sequence
  RNA Oligomer
ucuuugacaaaaacagcacuu

SEQ ID NO: 25242 - RNA, 21 nt, Artificial Sequence
  RNA Oligomer
gucaaguacacugaaauucau

SEQ ID NO: 25243 - RNA, 21 nt, Artificial Sequence
  RNA Oligomer
agggugcauuuauuucaaaac

SEQ ID NO: 25244 - RNA, 21 nt, Artificial Sequence
  RNA Oligomer
ugaggauucaucuugcacauc

SEQ ID NO: 25245 - RNA, 21 nt, Artificial Sequence
  RNA Oligomer
gagaagguucagacacuagag

SEQ ID NO: 25246 - RNA, 21 nt, Artificial Sequence
  RNA Oligomer
gaguguggaaguccauaauuu

SEQ ID NO: 25247 - RNA, 21 nt, Artificial Sequence
  RNA Oligomer
cuuugacaaaaacagcacuuu

SEQ ID NO: 25248 - RNA, 21 nt, Artificial Sequence
  RNA Oligomer
acauuacugaagaagacuauc

SEQ ID NO: 25249 - RNA, 21 nt, Artificial Sequence
  RNA Oligomer
caaaugaaugaccuuguugca

SEQ ID NO: 25250 - RNA, 21 nt, Artificial Sequence
  RNA Oligomer
acauuuccaaaugaaugaccu

SEQ ID NO: 25251 - RNA, 21 nt, Artificial Sequence
  RNA Oligomer
gcagagcugaagauuuuggag

SEQ ID NO: 25252 - RNA, 21 nt, Artificial Sequence
  RNA Oligomer
uccugaggauucaucuugcac

SEQ ID NO: 25253 - RNA, 21 nt, Artificial Sequence
  RNA Oligomer
acaaguuucuucaguguguga

SEQ ID NO: 25254 - RNA, 21 nt, Artificial Sequence
  RNA Oligomer
gaauaucuacagaccugacaa

SEQ ID NO: 25255 - RNA, 21 nt, Artificial Sequence
  RNA Oligomer
cagagaagguucagacacuag

SEQ ID NO: 25256 - RNA, 21 nt, Artificial Sequence
  RNA Oligomer
acacugaaauucauccugaga

SEQ ID NO: 25257 - RNA, 21 nt, Artificial Sequence
  RNA Oligomer
cauuuccaaaugaaugaccuu

SEQ ID NO: 25258 - RNA, 21 nt, Artificial Sequence
  RNA Oligomer
agcugaagauuuuggaggguc

SEQ ID NO: 25259 - RNA, 21 nt, Artificial Sequence
  RNA Oligomer
gagcugaagauuuuggagggu

SEQ ID NO: 25260 - RNA, 21 nt, Artificial Sequence
  RNA Oligomer
ggugcagagcugaagauuuug

SEQ ID NO: 25261 - RNA, 21 nt, Artificial Sequence
  RNA Oligomer
uggugcagagcugaagauuuu

SEQ ID NO: 25262 - RNA, 21 nt, Artificial Sequence
  RNA Oligomer
cugugaugugguccaugugau

SEQ ID NO: 25263 - RNA, 21 nt, Artificial Sequence
  RNA Oligomer
uggagaaaggacugcagcaac

SEQ ID NO: 25264 - RNA, 21 nt, Artificial Sequence
  RNA Oligomer
aagaagacuaucagccacuaa

SEQ ID NO: 25265 - RNA, 21 nt, Artificial Sequence
  RNA Oligomer
gaagagaagauuccagagacu

SEQ ID NO: 25266 - RNA, 21 nt, Artificial Sequence
  RNA Oligomer
cuacagauagucaaaccauaa

SEQ ID NO: 25267 - RNA, 21 nt, Artificial Sequence
  RNA Oligomer
ugcagagcugaagauuuugga

SEQ ID NO: 25268 - RNA, 21 nt, Artificial Sequence
  RNA Oligomer
cuggugcagagcugaagauuu

SEQ ID NO: 25269 - RNA, 21 nt, Artificial Sequence
  RNA Oligomer
caauaaggucaaugccagaga

SEQ ID NO: 25270 - RNA, 21 nt, Artificial Sequence
  RNA Oligomer
caagaauaucuacagaccuga

SEQ ID NO: 25271 - RNA, 21 nt, Artificial Sequence
  RNA Oligomer
ccaggaucccaccauaaaaga

SEQ ID NO: 25272 - RNA, 21 nt, Artificial Sequence
  RNA Oligomer
gggaguguggaaguccauaau

SEQ ID NO: 25273 - RNA, 21 nt, Artificial Sequence
  RNA Oligomer
gcaacaacccuguuucaguau

SEQ ID NO: 25274 - RNA, 21 nt, Artificial Sequence
  RNA Oligomer
ucagaccguaccuugcaacaa

SEQ ID NO: 25275 - RNA, 21 nt, Artificial Sequence
  RNA Oligomer
ugagacauguagacugccaaa

SEQ ID NO: 25276 - RNA, 21 nt, Artificial Sequence
  RNA Oligomer
gcaagaauaucuacagaccug

SEQ ID NO: 25277 - RNA, 21 nt, Artificial Sequence
  RNA Oligomer
aggagagcccaacucugucuu

SEQ ID NO: 25278 - RNA, 21 nt, Artificial Sequence
  RNA Oligomer
accugacaaguuucuucagug

SEQ ID NO: 25279 - RNA, 21 nt, Artificial Sequence
  RNA Oligomer
acagauagucaaaccauaaac

SEQ ID NO: 25280 - RNA, 21 nt, Artificial Sequence
  RNA Oligomer
aggauucaucuugcacaucug

SEQ ID NO: 25281 - RNA, 21 nt, Artificial Sequence
  RNA Oligomer
cuguuucaguauucuggaaaa

SEQ ID NO: 25282 - RNA, 21 nt, Artificial Sequence
  RNA Oligomer
cucucuuauuagaacaggcaa

SEQ ID NO: 25283 - RNA, 21 nt, Artificial Sequence
  RNA Oligomer
gcuccuugacuccuugugguu

SEQ ID NO: 25284 - RNA, 21 nt, Artificial Sequence
  RNA Oligomer
ccagucgcugugguuguuuua

SEQ ID NO: 25285 - RNA, 21 nt, Artificial Sequence
  RNA Oligomer
ggaucccaccauaaaagagcu

SEQ ID NO: 25286 - RNA, 21 nt, Artificial Sequence
  RNA Oligomer
gaagaagacuaucagccacua

SEQ ID NO: 25287 - RNA, 21 nt, Artificial Sequence
  RNA Oligomer
caacucugucuuggcgucagu

SEQ ID NO: 25288 - RNA, 21 nt, Artificial Sequence
  RNA Oligomer
uccuacagauagucaaaccau

SEQ ID NO: 25289 - RNA, 21 nt, Artificial Sequence
  RNA Oligomer
cccuuccuacagauagucaaa

SEQ ID NO: 25290 - RNA, 21 nt, Artificial Sequence
  RNA Oligomer
ccaaaguguaugggaugcuuu

SEQ ID NO: 25291 - RNA, 21 nt, Artificial Sequence
  RNA Oligomer
ucaucauacaugacucagcau

SEQ ID NO: 25292 - RNA, 21 nt, Artificial Sequence
  RNA Oligomer
gguuuaugucaucauacauga

SEQ ID NO: 25293 - RNA, 21 nt, Artificial Sequence
  RNA Oligomer
uggugaauucaacacuuccaa

SEQ ID NO: 25294 - RNA, 21 nt, Artificial Sequence
  RNA Oligomer
cgaugcgucaaguacacugaa

SEQ ID NO: 25295 - RNA, 21 nt, Artificial Sequence
  RNA Oligomer
gguguggugaauucaacacuu

SEQ ID NO: 25296 - RNA, 21 nt, Artificial Sequence
  RNA Oligomer
gaagacuaucagccacuaaug

SEQ ID NO: 25297 - RNA, 21 nt, Artificial Sequence
  RNA Oligomer
aacuucauggucauggguaaa

SEQ ID NO: 25298 - RNA, 21 nt, Artificial Sequence
  RNA Oligomer
augagacauguagacugccaa

SEQ ID NO: 25299 - RNA, 21 nt, Artificial Sequence
  RNA Oligomer
ccugacaaguuucuucagugu

SEQ ID NO: 25300 - RNA, 21 nt, Artificial Sequence
  RNA Oligomer
ggaauauucaauuuuccugca

SEQ ID NO: 25301 - RNA, 21 nt, Artificial Sequence
  RNA Oligomer
ccaccauaaaagagcuggaau

SEQ ID NO: 25302 - RNA, 21 nt, Artificial Sequence
  RNA Oligomer
gccaggaucccaccauaaaag

SEQ ID NO: 25303 - RNA, 21 nt, Artificial Sequence
  RNA Oligomer
uggaucccgcaguaaaaucuu

SEQ ID NO: 25304 - RNA, 21 nt, Artificial Sequence
  RNA Oligomer
ggaugcuuucaagggugcauu

SEQ ID NO: 25305 - RNA, 21 nt, Artificial Sequence
  RNA Oligomer
ugacucagcauaccugcuggu

SEQ ID NO: 25306 - RNA, 21 nt, Artificial Sequence
  RNA Oligomer
agacauguagacugccaaagu

SEQ ID NO: 25307 - RNA, 21 nt, Artificial Sequence
  RNA Oligomer
uccuugacuccuugugguuua

SEQ ID NO: 25308 - RNA, 21 nt, Artificial Sequence
  RNA Oligomer
gugugaaaaauccugaggauu

SEQ ID NO: 25309 - RNA, 21 nt, Artificial Sequence
  RNA Oligomer
ccagagacuuaugccaggauc

SEQ ID NO: 25310 - RNA, 21 nt, Artificial Sequence
  RNA Oligomer
guggaaguccauaauuugcaa

SEQ ID NO: 25311 - RNA, 21 nt, Artificial Sequence
  RNA Oligomer
gaaaacgguuucccgcagguu

SEQ ID NO: 25312 - RNA, 21 nt, Artificial Sequence
  RNA Oligomer
acaacccuguuucaguauucu

SEQ ID NO: 25313 - RNA, 21 nt, Artificial Sequence
  RNA Oligomer
caacaacccuguuucaguauu

SEQ ID NO: 25314 - RNA, 21 nt, Artificial Sequence
  RNA Oligomer
agaagacuaucagccacuaau

SEQ ID NO: 25315 - RNA, 21 nt, Artificial Sequence
  RNA Oligomer
ugaagaagacuaucagccacu

SEQ ID NO: 25316 - RNA, 21 nt, Artificial Sequence
  RNA Oligomer
acccuuccuacagauagucaa

SEQ ID NO: 25317 - RNA, 21 nt, Artificial Sequence
  RNA Oligomer
gccaaaguguaugggaugcuu

SEQ ID NO: 25318 - RNA, 21 nt, Artificial Sequence
  RNA Oligomer
agacugccaaaguguauggga

SEQ ID NO: 25319 - RNA, 21 nt, Artificial Sequence
  RNA Oligomer
ccagagacggaagccuuuuuc

SEQ ID NO: 25320 - RNA, 21 nt, Artificial Sequence
  RNA Oligomer
ccacaauaaggucaaugccag

SEQ ID NO: 25321 - RNA, 21 nt, Artificial Sequence
  RNA Oligomer
ugugugaaaaauccugaggau

SEQ ID NO: 25322 - RNA, 21 nt, Artificial Sequence
  RNA Oligomer
agaccugacaaguuucuucag

SEQ ID NO: 25323 - RNA, 21 nt, Artificial Sequence
  RNA Oligomer
ugcaagaauaucuacagaccu

SEQ ID NO: 25324 - RNA, 21 nt, Artificial Sequence
  RNA Oligomer
cccaccauaaaagagcuggaa

SEQ ID NO: 25325 - RNA, 21 nt, Artificial Sequence
  RNA Oligomer
aguguggaaguccauaauuug

SEQ ID NO: 25326 - RNA, 21 nt, Artificial Sequence
  RNA Oligomer
guacacugaaauucauccuga

SEQ ID NO: 25327 - RNA, 21 nt, Artificial Sequence
  RNA Oligomer
gugaauucaacacuuccaaaa

SEQ ID NO: 25328 - RNA, 21 nt, Artificial Sequence
  RNA Oligomer
guguggugaauucaacacuuc

SEQ ID NO: 25329 - RNA, 21 nt, Artificial Sequence
  RNA Oligomer
aaccauaaacuucauggucau

SEQ ID NO: 25330 - RNA, 21 nt, Artificial Sequence
  RNA Oligomer
ugcucaaguuuuucagaaagc

SEQ ID NO: 25331 - RNA, 21 nt, Artificial Sequence
  RNA Oligomer
ugccaaaguguaugggaugcu

SEQ ID NO: 25332 - RNA, 21 nt, Artificial Sequence
  RNA Oligomer
cuucacuuuaauucucaugug

SEQ ID NO: 25333 - RNA, 21 nt, Artificial Sequence
  RNA Oligomer
gccagagacggaagccuuuuu

SEQ ID NO: 25334 - RNA, 21 nt, Artificial Sequence
  RNA Oligomer
cugacaaguuucuucagugug

SEQ ID NO: 25335 - RNA, 21 nt, Artificial Sequence
  RNA Oligomer
cacugaaauucauccugagau

SEQ ID NO: 25336 - RNA, 21 nt, Artificial Sequence
  RNA Oligomer
ugggaguguggaaguccauaa

SEQ ID NO: 25337 - RNA, 21 nt, Artificial Sequence
  RNA Oligomer
ggaucccgcaguaaaaucuuu

SEQ ID NO: 25338 - RNA, 21 nt, Artificial Sequence
  RNA Oligomer
agcaacaacccuguuucagua

SEQ ID NO: 25339 - RNA, 21 nt, Artificial Sequence
  RNA Oligomer
augcgucaaguacacugaaau

SEQ ID NO: 25340 - RNA, 21 nt, Artificial Sequence
  RNA Oligomer
ggugaauucaacacuuccaaa

SEQ ID NO: 25341 - RNA, 21 nt, Artificial Sequence
  RNA Oligomer
gcgaugcgucaaguacacuga

SEQ ID NO: 25342 - RNA, 21 nt, Artificial Sequence
  RNA Oligomer
cugcuaggcuaccuugcugau

SEQ ID NO: 25343 - RNA, 21 nt, Artificial Sequence
  RNA Oligomer
ccaucaguucacacaggucca

SEQ ID NO: 25344 - RNA, 21 nt, Artificial Sequence
  RNA Oligomer
gcagaauaaaagaucuggccc

SEQ ID NO: 25345 - RNA, 21 nt, Artificial Sequence
  RNA Oligomer
ucuucuuuggagcagaauaaa

SEQ ID NO: 25346 - RNA, 21 nt, Artificial Sequence
  RNA Oligomer
gcaacaagauucuucuuugga

SEQ ID NO: 25347 - RNA, 21 nt, Artificial Sequence
  RNA Oligomer
ccacuaaugaaguugggaacu

SEQ ID NO: 25348 - RNA, 21 nt, Artificial Sequence
  RNA Oligomer
ugcuuucaagggugcauuuau

SEQ ID NO: 25349 - RNA, 21 nt, Artificial Sequence
  RNA Oligomer
cagauagucaaaccauaaacu

SEQ ID NO: 25350 - RNA, 21 nt, Artificial Sequence
  RNA Oligomer
cacaauaaggucaaugccaga

SEQ ID NO: 25351 - RNA, 21 nt, Artificial Sequence
  RNA Oligomer
gucaucauacaugacucagca

SEQ ID NO: 25352 - RNA, 21 nt, Artificial Sequence
  RNA Oligomer
ccugcaagaauaucuacagac

SEQ ID NO: 25353 - RNA, 21 nt, Artificial Sequence
  RNA Oligomer
uccagagacuuaugccaggau

SEQ ID NO: 25354 - RNA, 21 nt, Artificial Sequence
  RNA Oligomer
ugcucaauggaucccgcagua

SEQ ID NO: 25355 - RNA, 21 nt, Artificial Sequence
  RNA Oligomer
ugcgucaaguacacugaaauu

SEQ ID NO: 25356 - RNA, 21 nt, Artificial Sequence
  RNA Oligomer
accuugcugaugaccucacau

SEQ ID NO: 25357 - RNA, 21 nt, Artificial Sequence
  RNA Oligomer
cgucaguauccugguccugau

SEQ ID NO: 25358 - RNA, 21 nt, Artificial Sequence
  RNA Oligomer
cuaaugaaguugggaacucag

SEQ ID NO: 25359 - RNA, 21 nt, Artificial Sequence
  RNA Oligomer
gccacuaaugaaguugggaac

SEQ ID NO: 25360 - RNA, 21 nt, Artificial Sequence
  RNA Oligomer
agccacuaaugaaguugggaa

SEQ ID NO: 25361 - RNA, 21 nt, Artificial Sequence
  RNA Oligomer
cuaucagccacuaaugaaguu

SEQ ID NO: 25362 - RNA, 21 nt, Artificial Sequence
  RNA Oligomer
agacuaucagccacuaaugaa

SEQ ID NO: 25363 - RNA, 21 nt, Artificial Sequence
  RNA Oligomer
ccuacagauagucaaaccaua

SEQ ID NO: 25364 - RNA, 21 nt, Artificial Sequence
  RNA Oligomer
guacccuuccuacagauaguc

SEQ ID NO: 25365 - RNA, 21 nt, Artificial Sequence
  RNA Oligomer
ucgcugugguuguuuuagcuc

SEQ ID NO: 25366 - RNA, 21 nt, Artificial Sequence
  RNA Oligomer
gccagucgcugugguuguuuu

SEQ ID NO: 25367 - RNA, 21 nt, Artificial Sequence
  RNA Oligomer
ucagugugugaaaaauccuga

SEQ ID NO: 25368 - RNA, 21 nt, Artificial Sequence
  RNA Oligomer
ugccaggaucccaccauaaaa

SEQ ID NO: 25369 - RNA, 21 nt, Artificial Sequence
  RNA Oligomer
agcacuuuugggaguguggaa

SEQ ID NO: 25370 - RNA, 21 nt, Artificial Sequence
  RNA Oligomer
agguuugcagaagcugccugu

SEQ ID NO: 25371 - RNA, 21 nt, Artificial Sequence
  RNA Oligomer
ugcagcaacaacccuguuuca

SEQ ID NO: 25372 - RNA, 21 nt, Artificial Sequence
  RNA Oligomer
cugcagcaacaacccuguuuc

SEQ ID NO: 25373 - RNA, 21 nt, Artificial Sequence
  RNA Oligomer
ccucacaugguguggugaauu

SEQ ID NO: 25374 - RNA, 21 nt, Artificial Sequence
  RNA Oligomer
gucaguauccugguccugauc

SEQ ID NO: 25375 - RNA, 21 nt, Artificial Sequence
  RNA Oligomer
cagccacuaaugaaguuggga

SEQ ID NO: 25376 - RNA, 21 nt, Artificial Sequence
  RNA Oligomer
ccuugcaacauuacugaagaa

SEQ ID NO: 25377 - RNA, 21 nt, Artificial Sequence
  RNA Oligomer
gggaugcuuucaagggugcau

SEQ ID NO: 25378 - RNA, 21 nt, Artificial Sequence
  RNA Oligomer
accauaaacuucauggucaug

SEQ ID NO: 25379 - RNA, 21 nt, Artificial Sequence
  RNA Oligomer
uccaaaugaaugaccuuguug

SEQ ID NO: 25380 - RNA, 21 nt, Artificial Sequence
  RNA Oligomer
uuccaaaugaaugaccuuguu

SEQ ID NO: 25381 - RNA, 21 nt, Artificial Sequence
  RNA Oligomer
cagaaagcauuacauuuccaa

SEQ ID NO: 25382 - RNA, 21 nt, Artificial Sequence
  RNA Oligomer
ucagaaagcauuacauuucca

SEQ ID NO: 25383 - RNA, 21 nt, Artificial Sequence
  RNA Oligomer
cuauugaaaaaucaccacacc

SEQ ID NO: 25384 - RNA, 21 nt, Artificial Sequence
  RNA Oligomer
agccagucgcugugguuguuu

SEQ ID NO: 25385 - RNA, 21 nt, Artificial Sequence
  RNA Oligomer
ugaaaaauccugaggauucau

SEQ ID NO: 25386 - RNA, 21 nt, Artificial Sequence
  RNA Oligomer
gugugugaaaaauccugagga

SEQ ID NO: 25387 - RNA, 21 nt, Artificial Sequence
  RNA Oligomer
uccugcaagaauaucuacaga

SEQ ID NO: 25388 - RNA, 21 nt, Artificial Sequence
  RNA Oligomer
cauccugagaugagacaugua

SEQ ID NO: 25389 - RNA, 21 nt, Artificial Sequence
  RNA Oligomer
uggaaguccauaauuugcaac

SEQ ID NO: 25390 - RNA, 21 nt, Artificial Sequence
  RNA Oligomer
gcugaugaccucacauggugu

SEQ ID NO: 25391 - RNA, 21 nt, Artificial Sequence
  RNA Oligomer
cuaggcuaccuugcugaugac

SEQ ID NO: 25392 - RNA, 21 nt, Artificial Sequence
  RNA Oligomer
agauucuucuuuggagcagaa

SEQ ID NO: 25393 - RNA, 21 nt, Artificial Sequence
  RNA Oligomer
guaccuugcaacaagauucuu

SEQ ID NO: 25394 - RNA, 21 nt, Artificial Sequence
  RNA Oligomer
gaaguugggaacucagaccgu

SEQ ID NO: 25395 - RNA, 21 nt, Artificial Sequence
  RNA Oligomer
gaugcuuucaagggugcauuu

SEQ ID NO: 25396 - RNA, 21 nt, Artificial Sequence
  RNA Oligomer
caaaccauaaacuucaugguc

SEQ ID NO: 25397 - RNA, 21 nt, Artificial Sequence
  RNA Oligomer
ucaaaccauaaacuucauggu

SEQ ID NO: 25398 - RNA, 21 nt, Artificial Sequence
  RNA Oligomer
gucgcugugguuguuuuagcu

SEQ ID NO: 25399 - RNA, 21 nt, Artificial Sequence
  RNA Oligomer
acaucugagaucugagccagu

SEQ ID NO: 25400 - RNA, 21 nt, Artificial Sequence
  RNA Oligomer
ccauaaaagagcuggaaucga

SEQ ID NO: 25401 - RNA, 21 nt, Artificial Sequence
  RNA Oligomer
cugaaauucauccugagauga

SEQ ID NO: 25402 - RNA, 21 nt, Artificial Sequence
  RNA Oligomer
ccuguuucaguauucuggaaa

SEQ ID NO: 25403 - RNA, 21 nt, Artificial Sequence
  RNA Oligomer
caacccuguuucaguauucug

SEQ ID NO: 25404 - RNA, 21 nt, Artificial Sequence
  RNA Oligomer
acaagauucuucuuuggagca

SEQ ID NO: 25405 - RNA, 21 nt, Artificial Sequence
  RNA Oligomer
acauccuugcaacauuacuga

SEQ ID NO: 25406 - RNA, 21 nt, Artificial Sequence
  RNA Oligomer
uugaaaaaucaccacaccaaa

SEQ ID NO: 25407 - RNA, 21 nt, Artificial Sequence
  RNA Oligomer
ugccagagacggaagccuuuu

SEQ ID NO: 25408 - RNA, 21 nt, Artificial Sequence
  RNA Oligomer
ucauccugagaugagacaugu

SEQ ID NO: 25409 - RNA, 21 nt, Artificial Sequence
  RNA Oligomer
ucccaccauaaaagagcugga

SEQ ID NO: 25410 - RNA, 21 nt, Artificial Sequence
  RNA Oligomer
acacuagaggccugggugaua

SEQ ID NO: 25411 - RNA, 21 nt, Artificial Sequence
  RNA Oligomer
acugaaauucauccugagaug

SEQ ID NO: 25412 - RNA, 21 nt, Artificial Sequence
  RNA Oligomer
gagaaaggacugcagcaacaa

SEQ ID NO: 25413 - RNA, 21 nt, Artificial Sequence
  RNA Oligomer
ucacaugguguggugaauuca

SEQ ID NO: 25414 - RNA, 21 nt, Artificial Sequence
  RNA Oligomer
ugaccucacauggugugguga

SEQ ID NO: 25415 - RNA, 21 nt, Artificial Sequence
  RNA Oligomer
gcucaaguuuuucagaaagca

SEQ ID NO: 25416 - RNA, 21 nt, Artificial Sequence
  RNA Oligomer
ugguaacauccuuucuauuga

SEQ ID NO: 25417 - RNA, 21 nt, Artificial Sequence
  RNA Oligomer
gcacaucugagaucugagcca

SEQ ID NO: 25418 - RNA, 21 nt, Artificial Sequence
  RNA Oligomer
uuaugccaggaucccaccaua

SEQ ID NO: 25419 - RNA, 21 nt, Artificial Sequence
  RNA Oligomer
gcacuuuugggaguguggaag

SEQ ID NO: 25420 - RNA, 21 nt, Artificial Sequence
  RNA Oligomer
ccaugugaugcucaauggauc

SEQ ID NO: 25421 - RNA, 21 nt, Artificial Sequence
  RNA Oligomer
guccaugugaugcucaaugga

SEQ ID NO: 25422 - RNA, 21 nt, Artificial Sequence
  RNA Oligomer
ucaguauucuggaaaacgguu

SEQ ID NO: 25423 - RNA, 21 nt, Artificial Sequence
  RNA Oligomer
gacugcagcaacaacccuguu

SEQ ID NO: 25424 - RNA, 21 nt, Artificial Sequence
  RNA Oligomer
cuaucaaucuugcccagacug

SEQ ID NO: 25425 - RNA, 21 nt, Artificial Sequence
  RNA Oligomer
acuaucaaucuugcccagacu

SEQ ID NO: 25426 - RNA, 21 nt, Artificial Sequence
  RNA Oligomer
ugguguggugaauucaacacu

SEQ ID NO: 25427 - RNA, 21 nt, Artificial Sequence
  RNA Oligomer
gcuaccuugcugaugaccuca

SEQ ID NO: 25428 - RNA, 21 nt, Artificial Sequence
  RNA Oligomer
cauccuugcaacauuacugaa

SEQ ID NO: 25429 - RNA, 21 nt, Artificial Sequence
  RNA Oligomer
ugggaugcuuucaagggugca

SEQ ID NO: 25430 - RNA, 21 nt, Artificial Sequence
  RNA Oligomer
gugaucuaucaauagucaaga

SEQ ID NO: 25431 - RNA, 21 nt, Artificial Sequence
  RNA Oligomer
ugaugcucaauggaucccgca

SEQ ID NO: 25432 - RNA, 21 nt, Artificial Sequence
  RNA Oligomer
cccuguuucaguauucuggaa

SEQ ID NO: 25433 - RNA, 21 nt, Artificial Sequence
  RNA Oligomer
gcgucaaguacacugaaauuc

SEQ ID NO: 25434 - RNA, 21 nt, Artificial Sequence
  RNA Oligomer
gcagcaacaacccuguuucag

SEQ ID NO: 25435 - RNA, 21 nt, Artificial Sequence
  RNA Oligomer
ggagaaaggacugcagcaaca

SEQ ID NO: 25436 - RNA, 21 nt, Artificial Sequence
  RNA Oligomer
cacaugguguggugaauucaa

SEQ ID NO: 25437 - RNA, 21 nt, Artificial Sequence
  RNA Oligomer
accucacaugguguggugaau

SEQ ID NO: 25438 - RNA, 21 nt, Artificial Sequence
  RNA Oligomer
gauucuucuuuggagcagaau

SEQ ID NO: 25439 - RNA, 21 nt, Artificial Sequence
  RNA Oligomer
ugcaacaagauucuucuuugg

SEQ ID NO: 25440 - RNA, 21 nt, Artificial Sequence
  RNA Oligomer
ccuugcaacaagauucuucuu

SEQ ID NO: 25441 - RNA, 21 nt, Artificial Sequence
  RNA Oligomer
gaccguaccuugcaacaagau

SEQ ID NO: 25442 - RNA, 21 nt, Artificial Sequence
  RNA Oligomer
acuaaugaaguugggaacuca

SEQ ID NO: 25443 - RNA, 21 nt, Artificial Sequence
  RNA Oligomer
gcugaagauuuuggagggucc

SEQ ID NO: 25444 - RNA, 21 nt, Artificial Sequence
  RNA Oligomer
guuucuucagugugugaaaaa

SEQ ID NO: 25445 - RNA, 21 nt, Artificial Sequence
  RNA Oligomer
ggaagagaagauuccagagac

SEQ ID NO: 25446 - RNA, 21 nt, Artificial Sequence
  RNA Oligomer
uccaugugaugcucaauggau

SEQ ID NO: 25447 - RNA, 21 nt, Artificial Sequence
  RNA Oligomer
gguccaugugaugcucaaugg

SEQ ID NO: 25448 - RNA, 21 nt, Artificial Sequence
  RNA Oligomer
agaagcugccugugauguggu

SEQ ID NO: 25449 - RNA, 21 nt, Artificial Sequence
  RNA Oligomer
uccuugcaacauuacugaaga

SEQ ID NO: 25450 - RNA, 21 nt, Artificial Sequence
  RNA Oligomer
aaguuucuucagugugugaaa

SEQ ID NO: 25451 - RNA, 21 nt, Artificial Sequence
  RNA Oligomer
ccagagaagguucagacacua

SEQ ID NO: 25452 - RNA, 21 nt, Artificial Sequence
  RNA Oligomer
cuggagaaaggacugcagcaa

SEQ ID NO: 25453 - RNA, 21 nt, Artificial Sequence
  RNA Oligomer
agacuggagaaaggacugcag

SEQ ID NO: 25454 - RNA, 21 nt, Artificial Sequence
  RNA Oligomer
gaccucacaugguguggugaa

SEQ ID NO: 25455 - RNA, 21 nt, Artificial Sequence
  RNA Oligomer
cguaccuugcaacaagauucu

SEQ ID NO: 25456 - RNA, 21 nt, Artificial Sequence
  RNA Oligomer
agaccguaccuugcaacaaga

SEQ ID NO: 25457 - RNA, 21 nt, Artificial Sequence
  RNA Oligomer
gaggugcaguuucagaaccca

SEQ ID NO: 25458 - RNA, 21 nt, Artificial Sequence
  RNA Oligomer
caaguuucuucagugugugaa

SEQ ID NO: 25459 - RNA, 21 nt, Artificial Sequence
  RNA Oligomer
gguggaagagaagauuccaga

SEQ ID NO: 25460 - RNA, 21 nt, Artificial Sequence
  RNA Oligomer
gcaaccagagaagguucagac

SEQ ID NO: 25461 - RNA, 21 nt, Artificial Sequence
  RNA Oligomer
ccguaccuugcaacaagauuc

SEQ ID NO: 25462 - RNA, 21 nt, Artificial Sequence
  RNA Oligomer
ggauucaucuugcacaucuga

SEQ ID NO: 25463 - RNA, 21 nt, Artificial Sequence
  RNA Oligomer
acccuguuucaguauucugga

SEQ ID NO: 25464 - RNA, 21 nt, Artificial Sequence
  RNA Oligomer
accuugcaacaagauucuucu

SEQ ID NO: 25465 - RNA, 21 nt, Artificial Sequence
  RNA Oligomer
accguaccuugcaacaagauu

SEQ ID NO: 25466 - RNA, 21 nt, Artificial Sequence
  RNA Oligomer
auaaaagaucuggcccaucag

SEQ ID NO: 25467 - RNA, 21 nt, Artificial Sequence
  RNA Oligomer
ggagcagaauaaaagaucugg

SEQ ID NO: 25468 - RNA, 21 nt, Artificial Sequence
  RNA Oligomer
gugaaaaauccugaggauuca

SEQ ID NO: 25469 - RNA, 21 nt, Artificial Sequence
  RNA Oligomer
uggagcagaauaaaagaucug

SEQ ID NO: 25470 - RNA, 21 nt, Artificial Sequence
  RNA Oligomer
cacuuuugggaguguggaagu

SEQ ID NO: 25471 - RNA, 21 nt, Artificial Sequence
  RNA Oligomer
uguuucaguauucuggaaaac

SEQ ID NO: 25472 - RNA, 21 nt, Artificial Sequence
  RNA Oligomer
uucaucuugcacaucugagau

SEQ ID NO: 25473 - RNA, 21 nt, Artificial Sequence
  RNA Oligomer
guggaagagaagauuccagag

SEQ ID NO: 25474 - RNA, 21 nt, Artificial Sequence
  RNA Oligomer
caaccagagaagguucagaca

SEQ ID NO: 25475 - RNA, 21 nt, Artificial Sequence
  RNA Oligomer
caaaaacagcacuuuugggag

SEQ ID NO: 25476 - RNA, 21 nt, Artificial Sequence
  RNA Oligomer
ugacaaaaacagcacuuuugg

SEQ ID NO: 25477 - RNA, 21 nt, Artificial Sequence
  RNA Oligomer
uuugucaaagauuuuacugcg

SEQ ID NO: 25478 - RNA, 21 nt, Artificial Sequence
  RNA Oligomer
uugucaaagauuuuacugcgg

SEQ ID NO: 25479 - RNA, 21 nt, Artificial Sequence
  RNA Oligomer
uuugaaauaaaugcacccuug

SEQ ID NO: 25480 - RNA, 21 nt, Artificial Sequence
  RNA Oligomer
uaggaaggguacaaaaauaca

SEQ ID NO: 25481 - RNA, 21 nt, Artificial Sequence
  RNA Oligomer
gaaggguacaaaaauacauca

SEQ ID NO: 25482 - RNA, 21 nt, Artificial Sequence
  RNA Oligomer
ggguacaaaaauacaucaugc

SEQ ID NO: 25483 - RNA, 21 nt, Artificial Sequence
  RNA Oligomer
uugaaauaaaugcacccuuga

SEQ ID NO: 25484 - RNA, 21 nt, Artificial Sequence
  RNA Oligomer
aaaauacaucaugcaacaagg

SEQ ID NO: 25485 - RNA, 21 nt, Artificial Sequence
  RNA Oligomer
aaauacaucaugcaacaaggu

SEQ ID NO: 25486 - RNA, 21 nt, Artificial Sequence
  RNA Oligomer
aaacuugagcauucacuuuuc

SEQ ID NO: 25487 - RNA, 21 nt, Artificial Sequence
  RNA Oligomer
aacuugagcauucacuuuucu

SEQ ID NO: 25488 - RNA, 21 nt, Artificial Sequence
  RNA Oligomer
cuuuugcuuauaaucgauucc

SEQ ID NO: 25489 - RNA, 21 nt, Artificial Sequence
  RNA Oligomer
guaggaaggguacaaaaauac

SEQ ID NO: 25490 - RNA, 21 nt, Artificial Sequence
  RNA Oligomer
uucaauagaaaggauguuacc

SEQ ID NO: 25491 - RNA, 21 nt, Artificial Sequence
  RNA Oligomer
augggccagaucuuuuauucu

SEQ ID NO: 25492 - RNA, 21 nt, Artificial Sequence
  RNA Oligomer
uuugcuuauaaucgauuccag

SEQ ID NO: 25493 - RNA, 21 nt, Artificial Sequence
  RNA Oligomer
uugcuuauaaucgauuccagc

SEQ ID NO: 25494 - RNA, 21 nt, Artificial Sequence
  RNA Oligomer
uucucugguugcaaauuaugg

SEQ ID NO: 25495 - RNA, 21 nt, Artificial Sequence
  RNA Oligomer
uaauguugcaaggauguuuug

SEQ ID NO: 25496 - RNA, 21 nt, Artificial Sequence
  RNA Oligomer
aaauaaaugcacccuugaaag

SEQ ID NO: 25497 - RNA, 21 nt, Artificial Sequence
  RNA Oligomer
aauaaaugcacccuugaaagc

SEQ ID NO: 25498 - RNA, 21 nt, Artificial Sequence
  RNA Oligomer
uucugaaaaacuugagcauuc

SEQ ID NO: 25499 - RNA, 21 nt, Artificial Sequence
  RNA Oligomer
uugagcauucacuuuucuuca

SEQ ID NO: 25500 - RNA, 21 nt, Artificial Sequence
  RNA Oligomer
aacauaaaaggaucacaugag

SEQ ID NO: 25501 - RNA, 21 nt, Artificial Sequence
  RNA Oligomer
acauaaaaggaucacaugaga

SEQ ID NO: 25502 - RNA, 21 nt, Artificial Sequence
  RNA Oligomer
acacuuuggcagucuacaugu

SEQ ID NO: 25503 - RNA, 21 nt, Artificial Sequence
  RNA Oligomer
cacacacugaagaaacuuguc

SEQ ID NO: 25504 - RNA, 21 nt, Artificial Sequence
  RNA Oligomer
cuuauaaucgauuccagcucu

SEQ ID NO: 25505 - RNA, 21 nt, Artificial Sequence
  RNA Oligomer
cuucucuuccaccauguauca

SEQ ID NO: 25506 - RNA, 21 nt, Artificial Sequence
  RNA Oligomer
cucuuccaccauguaucaccc

SEQ ID NO: 25507 - RNA, 21 nt, Artificial Sequence
  RNA Oligomer
ugucaaagauuuuacugcggg

SEQ ID NO: 25508 - RNA, 21 nt, Artificial Sequence
  RNA Oligomer
ucugaaaaacuugagcauuca

SEQ ID NO: 25509 - RNA, 21 nt, Artificial Sequence
  RNA Oligomer
uuuucuucacuugccuguucu

SEQ ID NO: 25510 - RNA, 21 nt, Artificial Sequence
  RNA Oligomer
gaucacaugagaauuaaagug

SEQ ID NO: 25511 - RNA, 21 nt, Artificial Sequence
  RNA Oligomer
ugaagaaacuugucaggucug

SEQ ID NO: 25512 - RNA, 21 nt, Artificial Sequence
  RNA Oligomer
uuauaaucgauuccagcucuu

SEQ ID NO: 25513 - RNA, 21 nt, Artificial Sequence
  RNA Oligomer
uucucuuccaccauguaucac

SEQ ID NO: 25514 - RNA, 21 nt, Artificial Sequence
  RNA Oligomer
aauuauggacuuccacacucc

SEQ ID NO: 25515 - RNA, 21 nt, Artificial Sequence
  RNA Oligomer
uuacugcgggauccauugagc

SEQ ID NO: 25516 - RNA, 21 nt, Artificial Sequence
  RNA Oligomer
agucuucuucaguaauguugc

SEQ ID NO: 25517 - RNA, 21 nt, Artificial Sequence
  RNA Oligomer
cugaaaaacuugagcauucac

SEQ ID NO: 25518 - RNA, 21 nt, Artificial Sequence
  RNA Oligomer
cauucacuuuucuucacuugc

SEQ ID NO: 25519 - RNA, 21 nt, Artificial Sequence
  RNA Oligomer
auucacuuuucuucacuugcc

SEQ ID NO: 25520 - RNA, 21 nt, Artificial Sequence
  RNA Oligomer
auaaaccacaaggagucaagg

SEQ ID NO: 25521 - RNA, 21 nt, Artificial Sequence
  RNA Oligomer
agucuacaugucucaucucag

SEQ ID NO: 25522 - RNA, 21 nt, Artificial Sequence
  RNA Oligomer
acacacugaagaaacuuguca

SEQ ID NO: 25523 - RNA, 21 nt, Artificial Sequence
  RNA Oligomer
uauaaucgauuccagcucuuu

SEQ ID NO: 25524 - RNA, 21 nt, Artificial Sequence
  RNA Oligomer
uaagucucuggaaucuucucu

SEQ ID NO: 25525 - RNA, 21 nt, Artificial Sequence
  RNA Oligomer
ucuuccaccauguaucaccca

SEQ ID NO: 25526 - RNA, 21 nt, Artificial Sequence
  RNA Oligomer
ugguugcaaauuauggacuuc

SEQ ID NO: 25527 - RNA, 21 nt, Artificial Sequence
  RNA Oligomer
gaugggccagaucuuuuauuc

SEQ ID NO: 25528 - RNA, 21 nt, Artificial Sequence
  RNA Oligomer
aauguugcaaggauguuuuga

SEQ ID NO: 25529 - RNA, 21 nt, Artificial Sequence
  RNA Oligomer
aauacaucaugcaacaagguc

SEQ ID NO: 25530 - RNA, 21 nt, Artificial Sequence
  RNA Oligomer
aucaugcaacaaggucauuca

SEQ ID NO: 25531 - RNA, 21 nt, Artificial Sequence
  RNA Oligomer
uucacuuuucuucacuugccu

SEQ ID NO: 25532 - RNA, 21 nt, Artificial Sequence
  RNA Oligomer
uucacuugccuguucuaauaa

SEQ ID NO: 25533 - RNA, 21 nt, Artificial Sequence
  RNA Oligomer
acuugccuguucuaauaagag

SEQ ID NO: 25534 - RNA, 21 nt, Artificial Sequence
  RNA Oligomer
ucuacaugucucaucucagga

SEQ ID NO: 25535 - RNA, 21 nt, Artificial Sequence
  RNA Oligomer
uuccaccauguaucacccagg

SEQ ID NO: 25536 - RNA, 21 nt, Artificial Sequence
  RNA Oligomer
cucugguugcaaauuauggac

SEQ ID NO: 25537 - RNA, 21 nt, Artificial Sequence
  RNA Oligomer
gguugcaaauuauggacuucc

SEQ ID NO: 25538 - RNA, 21 nt, Artificial Sequence
  RNA Oligomer
uguuuugaaauaaaugcaccc

SEQ ID NO: 25539 - RNA, 21 nt, Artificial Sequence
  RNA Oligomer
auacaucaugcaacaagguca

SEQ ID NO: 25540 - RNA, 21 nt, Artificial Sequence
  RNA Oligomer
agguaugcugaugauauaagu

SEQ ID NO: 25541 - RNA, 21 nt, Artificial Sequence
  RNA Oligomer
ccuuuugcuuauaaucgauuc

SEQ ID NO: 25542 - RNA, 21 nt, Artificial Sequence
  RNA Oligomer
aaucgauuccagcucuuuuau

SEQ ID NO: 25543 - RNA, 21 nt, Artificial Sequence
  RNA Oligomer
cauaagucucuggaaucuucu

SEQ ID NO: 25544 - RNA, 21 nt, Artificial Sequence
  RNA Oligomer
gaaucuucucuuccaccaugu

SEQ ID NO: 25545 - RNA, 21 nt, Artificial Sequence
  RNA Oligomer
uuuuacugcgggauccauuga

SEQ ID NO: 25546 - RNA, 21 nt, Artificial Sequence
  RNA Oligomer
auugagcaucacauggaccac

SEQ ID NO: 25547 - RNA, 21 nt, Artificial Sequence
  RNA Oligomer
uacaucaugcaacaaggucau

SEQ ID NO: 25548 - RNA, 21 nt, Artificial Sequence
  RNA Oligomer
augcuuucugaaaaacuugag

SEQ ID NO: 25549 - RNA, 21 nt, Artificial Sequence
  RNA Oligomer
ucacuuuucuucacuugccug

SEQ ID NO: 25550 - RNA, 21 nt, Artificial Sequence
  RNA Oligomer
ucaaggagcuaaaacaaccac

SEQ ID NO: 25551 - RNA, 21 nt, Artificial Sequence
  RNA Oligomer
augugcaagaugaauccucag

SEQ ID NO: 25552 - RNA, 21 nt, Artificial Sequence
  RNA Oligomer
auaagucucuggaaucuucuc

SEQ ID NO: 25553 - RNA, 21 nt, Artificial Sequence
  RNA Oligomer
aagucucuggaaucuucucuu

SEQ ID NO: 25554 - RNA, 21 nt, Artificial Sequence
  RNA Oligomer
ucugguugcaaauuauggacu

SEQ ID NO: 25555 - RNA, 21 nt, Artificial Sequence
  RNA Oligomer
gucaaagauuuuacugcggga

SEQ ID NO: 25556 - RNA, 21 nt, Artificial Sequence
  RNA Oligomer
ugaauuucaguguacuugacg

SEQ ID NO: 25557 - RNA, 21 nt, Artificial Sequence
  RNA Oligomer
uagucuucuucaguaauguug

SEQ ID NO: 25558 - RNA, 21 nt, Artificial Sequence
  RNA Oligomer
acaauaaagguaugcugauga

SEQ ID NO: 25559 - RNA, 21 nt, Artificial Sequence
  RNA Oligomer
gucaaggagcuaaaacaacca

SEQ ID NO: 25560 - RNA, 21 nt, Artificial Sequence
  RNA Oligomer
aaggagcuaaaacaaccacag

SEQ ID NO: 25561 - RNA, 21 nt, Artificial Sequence
  RNA Oligomer
auuuuacugcgggauccauug

SEQ ID NO: 25562 - RNA, 21 nt, Artificial Sequence
  RNA Oligomer
uuuacugcgggauccauugag

SEQ ID NO: 25563 - RNA, 21 nt, Artificial Sequence
  RNA Oligomer
gaugaauuucaguguacuuga

SEQ ID NO: 25564 - RNA, 21 nt, Artificial Sequence
  RNA Oligomer
aaaccguuuuccagaauacug

SEQ ID NO: 25565 - RNA, 21 nt, Artificial Sequence
  RNA Oligomer
aaucuucagcucugcaccagc

SEQ ID NO: 25566 - RNA, 21 nt, Artificial Sequence
  RNA Oligomer
aggagcuaaaacaaccacagc

SEQ ID NO: 25567 - RNA, 21 nt, Artificial Sequence
  RNA Oligomer
aagugcuguuuuugucaaaga

SEQ ID NO: 25568 - RNA, 21 nt, Artificial Sequence
  RNA Oligomer
augaauuucaguguacuugac

SEQ ID NO: 25569 - RNA, 21 nt, Artificial Sequence
  RNA Oligomer
guuuugaaauaaaugcacccu

SEQ ID NO: 25570 - RNA, 21 nt, Artificial Sequence
  RNA Oligomer
gaugugcaagaugaauccuca

SEQ ID NO: 25571 - RNA, 21 nt, Artificial Sequence
  RNA Oligomer
cucuagugucugaaccuucuc

SEQ ID NO: 25572 - RNA, 21 nt, Artificial Sequence
  RNA Oligomer
aaauuauggacuuccacacuc

SEQ ID NO: 25573 - RNA, 21 nt, Artificial Sequence
  RNA Oligomer
aaagugcuguuuuugucaaag

SEQ ID NO: 25574 - RNA, 21 nt, Artificial Sequence
  RNA Oligomer
gauagucuucuucaguaaugu

SEQ ID NO: 25575 - RNA, 21 nt, Artificial Sequence
  RNA Oligomer
ugcaacaaggucauucauuug

SEQ ID NO: 25576 - RNA, 21 nt, Artificial Sequence
  RNA Oligomer
aggucauucauuuggaaaugu

SEQ ID NO: 25577 - RNA, 21 nt, Artificial Sequence
  RNA Oligomer
cuccaaaaucuucagcucugc

SEQ ID NO: 25578 - RNA, 21 nt, Artificial Sequence
  RNA Oligomer
gugcaagaugaauccucagga

SEQ ID NO: 25579 - RNA, 21 nt, Artificial Sequence
  RNA Oligomer
ucacacacugaagaaacuugu

SEQ ID NO: 25580 - RNA, 21 nt, Artificial Sequence
  RNA Oligomer
uugucaggucuguagauauuc

SEQ ID NO: 25581 - RNA, 21 nt, Artificial Sequence
  RNA Oligomer
cuagugucugaaccuucucug

SEQ ID NO: 25582 - RNA, 21 nt, Artificial Sequence
  RNA Oligomer
ucucaggaugaauuucagugu

SEQ ID NO: 25583 - RNA, 21 nt, Artificial Sequence
  RNA Oligomer
aaggucauucauuuggaaaug

SEQ ID NO: 25584 - RNA, 21 nt, Artificial Sequence
  RNA Oligomer
gacccuccaaaaucuucagcu

SEQ ID NO: 25585 - RNA, 21 nt, Artificial Sequence
  RNA Oligomer
acccuccaaaaucuucagcuc

SEQ ID NO: 25586 - RNA, 21 nt, Artificial Sequence
  RNA Oligomer
caaaaucuucagcucugcacc

SEQ ID NO: 25587 - RNA, 21 nt, Artificial Sequence
  RNA Oligomer
aaaaucuucagcucugcacca

SEQ ID NO: 25588 - RNA, 21 nt, Artificial Sequence
  RNA Oligomer
aucacauggaccacaucacag

SEQ ID NO: 25589 - RNA, 21 nt, Artificial Sequence
  RNA Oligomer
guugcugcaguccuuucucca

SEQ ID NO: 25590 - RNA, 21 nt, Artificial Sequence
  RNA Oligomer
uuaguggcugauagucuucuu

SEQ ID NO: 25591 - RNA, 21 nt, Artificial Sequence
  RNA Oligomer
agucucuggaaucuucucuuc

SEQ ID NO: 25592 - RNA, 21 nt, Artificial Sequence
  RNA Oligomer
uuaugguuugacuaucuguag

SEQ ID NO: 25593 - RNA, 21 nt, Artificial Sequence
  RNA Oligomer
uccaaaaucuucagcucugca

SEQ ID NO: 25594 - RNA, 21 nt, Artificial Sequence
  RNA Oligomer
aaaucuucagcucugcaccag

SEQ ID NO: 25595 - RNA, 21 nt, Artificial Sequence
  RNA Oligomer
ucucuggcauugaccuuauug

SEQ ID NO: 25596 - RNA, 21 nt, Artificial Sequence
  RNA Oligomer
ucaggucuguagauauucuug

SEQ ID NO: 25597 - RNA, 21 nt, Artificial Sequence
  RNA Oligomer
ucuuuuauggugggauccugg

SEQ ID NO: 25598 - RNA, 21 nt, Artificial Sequence
  RNA Oligomer
auuauggacuuccacacuccc

SEQ ID NO: 25599 - RNA, 21 nt, Artificial Sequence
  RNA Oligomer
auacugaaacaggguuguugc

SEQ ID NO: 25600 - RNA, 21 nt, Artificial Sequence
  RNA Oligomer
uuguugcaagguacggucuga

SEQ ID NO: 25601 - RNA, 21 nt, Artificial Sequence
  RNA Oligomer
uuuggcagucuacaugucuca

SEQ ID NO: 25602 - RNA, 21 nt, Artificial Sequence
  RNA Oligomer
caggucuguagauauucuugc

SEQ ID NO: 25603 - RNA, 21 nt, Artificial Sequence
  RNA Oligomer
aagacagaguugggcucuccu

SEQ ID NO: 25604 - RNA, 21 nt, Artificial Sequence
  RNA Oligomer
cacugaagaaacuugucaggu

SEQ ID NO: 25605 - RNA, 21 nt, Artificial Sequence
  RNA Oligomer
guuuaugguuugacuaucugu

SEQ ID NO: 25606 - RNA, 21 nt, Artificial Sequence
  RNA Oligomer
cagaugugcaagaugaauccu

SEQ ID NO: 25607 - RNA, 21 nt, Artificial Sequence
  RNA Oligomer
uuuuccagaauacugaaacag

SEQ ID NO: 25608 - RNA, 21 nt, Artificial Sequence
  RNA Oligomer
uugccuguucuaauaagagag

SEQ ID NO: 25609 - RNA, 21 nt, Artificial Sequence
  RNA Oligomer
aaccacaaggagucaaggagc

SEQ ID NO: 25610 - RNA, 21 nt, Artificial Sequence
  RNA Oligomer
uaaaacaaccacagcgacugg

SEQ ID NO: 25611 - RNA, 21 nt, Artificial Sequence
  RNA Oligomer
agcucuuuuauggugggaucc

SEQ ID NO: 25612 - RNA, 21 nt, Artificial Sequence
  RNA Oligomer
uaguggcugauagucuucuuc

SEQ ID NO: 25613 - RNA, 21 nt, Artificial Sequence
  RNA Oligomer
acugacgccaagacagaguug

SEQ ID NO: 25614 - RNA, 21 nt, Artificial Sequence
  RNA Oligomer
augguuugacuaucuguagga

SEQ ID NO: 25615 - RNA, 21 nt, Artificial Sequence
  RNA Oligomer
uuugacuaucuguaggaaggg

SEQ ID NO: 25616 - RNA, 21 nt, Artificial Sequence
  RNA Oligomer
aaagcaucccauacacuuugg

SEQ ID NO: 25617 - RNA, 21 nt, Artificial Sequence
  RNA Oligomer
augcugagucauguaugauga

SEQ ID NO: 25618 - RNA, 21 nt, Artificial Sequence
  RNA Oligomer
ucauguaugaugacauaaacc

SEQ ID NO: 25619 - RNA, 21 nt, Artificial Sequence
  RNA Oligomer
uuggaaguguugaauucacca

SEQ ID NO: 25620 - RNA, 21 nt, Artificial Sequence
  RNA Oligomer
uucaguguacuugacgcaucg

SEQ ID NO: 25621 - RNA, 21 nt, Artificial Sequence
  RNA Oligomer
aaguguugaauucaccacacc

SEQ ID NO: 25622 - RNA, 21 nt, Artificial Sequence
  RNA Oligomer
cauuaguggcugauagucuuc

SEQ ID NO: 25623 - RNA, 21 nt, Artificial Sequence
  RNA Oligomer
uuuacccaugaccaugaaguu

SEQ ID NO: 25624 - RNA, 21 nt, Artificial Sequence
  RNA Oligomer
uuggcagucuacaugucucau

SEQ ID NO: 25625 - RNA, 21 nt, Artificial Sequence
  RNA Oligomer
acacugaagaaacuugucagg

SEQ ID NO: 25626 - RNA, 21 nt, Artificial Sequence
  RNA Oligomer
ugcaggaaaauugaauauucc

SEQ ID NO: 25627 - RNA, 21 nt, Artificial Sequence
  RNA Oligomer
auuccagcucuuuuauggugg

SEQ ID NO: 25628 - RNA, 21 nt, Artificial Sequence
  RNA Oligomer
cuuuuauggugggauccuggc

SEQ ID NO: 25629 - RNA, 21 nt, Artificial Sequence
  RNA Oligomer
aagauuuuacugcgggaucca

SEQ ID NO: 25630 - RNA, 21 nt, Artificial Sequence
  RNA Oligomer
aaugcacccuugaaagcaucc

SEQ ID NO: 25631 - RNA, 21 nt, Artificial Sequence
  RNA Oligomer
accagcagguaugcugaguca

SEQ ID NO: 25632 - RNA, 21 nt, Artificial Sequence
  RNA Oligomer
acuuuggcagucuacaugucu

SEQ ID NO: 25633 - RNA, 21 nt, Artificial Sequence
  RNA Oligomer
uaaaccacaaggagucaagga

SEQ ID NO: 25634 - RNA, 21 nt, Artificial Sequence
  RNA Oligomer
aauccucaggauuuuucacac

SEQ ID NO: 25635 - RNA, 21 nt, Artificial Sequence
  RNA Oligomer
gauccuggcauaagucucugg

SEQ ID NO: 25636 - RNA, 21 nt, Artificial Sequence
  RNA Oligomer
uugcaaauuauggacuuccac

SEQ ID NO: 25637 - RNA, 21 nt, Artificial Sequence
  RNA Oligomer
aaccugcgggaaaccguuuuc

SEQ ID NO: 25638 - RNA, 21 nt, Artificial Sequence
  RNA Oligomer
agaauacugaaacaggguugu

SEQ ID NO: 25639 - RNA, 21 nt, Artificial Sequence
  RNA Oligomer
aauacugaaacaggguuguug

SEQ ID NO: 25640 - RNA, 21 nt, Artificial Sequence
  RNA Oligomer
auuaguggcugauagucuucu

SEQ ID NO: 25641 - RNA, 21 nt, Artificial Sequence
  RNA Oligomer
aguggcugauagucuucuuca

SEQ ID NO: 25642 - RNA, 21 nt, Artificial Sequence
  RNA Oligomer
uugacuaucuguaggaagggu

SEQ ID NO: 25643 - RNA, 21 nt, Artificial Sequence
  RNA Oligomer
aagcaucccauacacuuuggc

SEQ ID NO: 25644 - RNA, 21 nt, Artificial Sequence
  RNA Oligomer
ucccauacacuuuggcagucu

SEQ ID NO: 25645 - RNA, 21 nt, Artificial Sequence
  RNA Oligomer
gaaaaaggcuuccgucucugg

SEQ ID NO: 25646 - RNA, 21 nt, Artificial Sequence
  RNA Oligomer
cuggcauugaccuuauugugg

SEQ ID NO: 25647 - RNA, 21 nt, Artificial Sequence
  RNA Oligomer
auccucaggauuuuucacaca

SEQ ID NO: 25648 - RNA, 21 nt, Artificial Sequence
  RNA Oligomer
cugaagaaacuugucaggucu

SEQ ID NO: 25649 - RNA, 21 nt, Artificial Sequence
  RNA Oligomer
aggucuguagauauucuugca

SEQ ID NO: 25650 - RNA, 21 nt, Artificial Sequence
  RNA Oligomer
uuccagcucuuuuaugguggg

SEQ ID NO: 25651 - RNA, 21 nt, Artificial Sequence
  RNA Oligomer
caaauuauggacuuccacacu

SEQ ID NO: 25652 - RNA, 21 nt, Artificial Sequence
  RNA Oligomer
ucaggaugaauuucaguguac

SEQ ID NO: 25653 - RNA, 21 nt, Artificial Sequence
  RNA Oligomer
uuuuggaaguguugaauucac

SEQ ID NO: 25654 - RNA, 21 nt, Artificial Sequence
  RNA Oligomer
gaaguguugaauucaccacac

SEQ ID NO: 25655 - RNA, 21 nt, Artificial Sequence
  RNA Oligomer
augaccaugaaguuuaugguu

SEQ ID NO: 25656 - RNA, 21 nt, Artificial Sequence
  RNA Oligomer
gcuuucugaaaaacuugagca

SEQ ID NO: 25657 - RNA, 21 nt, Artificial Sequence
  RNA Oligomer
agcaucccauacacuuuggca

SEQ ID NO: 25658 - RNA, 21 nt, Artificial Sequence
  RNA Oligomer
cacaugagaauuaaagugaag

SEQ ID NO: 25659 - RNA, 21 nt, Artificial Sequence
  RNA Oligomer
aaaaaggcuuccgucucuggc

SEQ ID NO: 25660 - RNA, 21 nt, Artificial Sequence
  RNA Oligomer
cacacugaagaaacuugucag

SEQ ID NO: 25661 - RNA, 21 nt, Artificial Sequence
  RNA Oligomer
aucucaggaugaauuucagug

SEQ ID NO: 25662 - RNA, 21 nt, Artificial Sequence
  RNA Oligomer
uuauggacuuccacacuccca

SEQ ID NO: 25663 - RNA, 21 nt, Artificial Sequence
  RNA Oligomer
aaagauuuuacugcgggaucc

SEQ ID NO: 25664 - RNA, 21 nt, Artificial Sequence
  RNA Oligomer
uacugaaacaggguuguugcu

SEQ ID NO: 25665 - RNA, 21 nt, Artificial Sequence
  RNA Oligomer
auuucaguguacuugacgcau

SEQ ID NO: 25666 - RNA, 21 nt, Artificial Sequence
  RNA Oligomer
uuuggaaguguugaauucacc

SEQ ID NO: 25667 - RNA, 21 nt, Artificial Sequence
  RNA Oligomer
ucaguguacuugacgcaucgc

SEQ ID NO: 25668 - RNA, 21 nt, Artificial Sequence
  RNA Oligomer
aucagcaagguagccuagcag

SEQ ID NO: 25669 - RNA, 21 nt, Artificial Sequence
  RNA Oligomer
uggaccugugugaacugaugg

SEQ ID NO: 25670 - RNA, 21 nt, Artificial Sequence
  RNA Oligomer
gggccagaucuuuuauucugc

SEQ ID NO: 25671 - RNA, 21 nt, Artificial Sequence
  RNA Oligomer
uuuauucugcuccaaagaaga

SEQ ID NO: 25672 - RNA, 21 nt, Artificial Sequence
  RNA Oligomer
uccaaagaagaaucuuguugc

SEQ ID NO: 25673 - RNA, 21 nt, Artificial Sequence
  RNA Oligomer
aguucccaacuucauuagugg

SEQ ID NO: 25674 - RNA, 21 nt, Artificial Sequence
  RNA Oligomer
auaaaugcacccuugaaagca

SEQ ID NO: 25675 - RNA, 21 nt, Artificial Sequence
  RNA Oligomer
aguuuaugguuugacuaucug

SEQ ID NO: 25676 - RNA, 21 nt, Artificial Sequence
  RNA Oligomer
ucuggcauugaccuuauugug

SEQ ID NO: 25677 - RNA, 21 nt, Artificial Sequence
  RNA Oligomer
ugcugagucauguaugaugac

SEQ ID NO: 25678 - RNA, 21 nt, Artificial Sequence
  RNA Oligomer
gucuguagauauucuugcagg

SEQ ID NO: 25679 - RNA, 21 nt, Artificial Sequence
  RNA Oligomer
auccuggcauaagucucugga

SEQ ID NO: 25680 - RNA, 21 nt, Artificial Sequence
  RNA Oligomer
uacugcgggauccauugagca

SEQ ID NO: 25681 - RNA, 21 nt, Artificial Sequence
  RNA Oligomer
aauuucaguguacuugacgca

SEQ ID NO: 25682 - RNA, 21 nt, Artificial Sequence
  RNA Oligomer
augugaggucaucagcaaggu

SEQ ID NO: 25683 - RNA, 21 nt, Artificial Sequence
  RNA Oligomer
aucaggaccaggauacugacg

SEQ ID NO: 25684 - RNA, 21 nt, Artificial Sequence
  RNA Oligomer
cugaguucccaacuucauuag

SEQ ID NO: 25685 - RNA, 21 nt, Artificial Sequence
  RNA Oligomer
guucccaacuucauuaguggc

SEQ ID NO: 25686 - RNA, 21 nt, Artificial Sequence
  RNA Oligomer
uucccaacuucauuaguggcu

SEQ ID NO: 25687 - RNA, 21 nt, Artificial Sequence
  RNA Oligomer
aacuucauuaguggcugauag

SEQ ID NO: 25688 - RNA, 21 nt, Artificial Sequence
  RNA Oligomer
uucauuaguggcugauagucu

SEQ ID NO: 25689 - RNA, 21 nt, Artificial Sequence
  RNA Oligomer
uaugguuugacuaucuguagg

SEQ ID NO: 25690 - RNA, 21 nt, Artificial Sequence
  RNA Oligomer
gacuaucuguaggaaggguac

SEQ ID NO: 25691 - RNA, 21 nt, Artificial Sequence
  RNA Oligomer
gagcuaaaacaaccacagcga

SEQ ID NO: 25692 - RNA, 21 nt, Artificial Sequence
  RNA Oligomer
aaaacaaccacagcgacuggc

SEQ ID NO: 25693 - RNA, 21 nt, Artificial Sequence
  RNA Oligomer
ucaggauuuuucacacacuga

SEQ ID NO: 25694 - RNA, 21 nt, Artificial Sequence
  RNA Oligomer
uuuuauggugggauccuggca

SEQ ID NO: 25695 - RNA, 21 nt, Artificial Sequence
  RNA Oligomer
uuccacacucccaaaagugcu

SEQ ID NO: 25696 - RNA, 21 nt, Artificial Sequence
  RNA Oligomer
acaggcagcuucugcaaaccu

SEQ ID NO: 25697 - RNA, 21 nt, Artificial Sequence
  RNA Oligomer
ugaaacaggguuguugcugca

SEQ ID NO: 25698 - RNA, 21 nt, Artificial Sequence
  RNA Oligomer
gaaacaggguuguugcugcag

SEQ ID NO: 25699 - RNA, 21 nt, Artificial Sequence
  RNA Oligomer
aauucaccacaccaugugagg

SEQ ID NO: 25700 - RNA, 21 nt, Artificial Sequence
  RNA Oligomer
gaucaggaccaggauacugac

SEQ ID NO: 25701 - RNA, 21 nt, Artificial Sequence
  RNA Oligomer
ucccaacuucauuaguggcug

SEQ ID NO: 25702 - RNA, 21 nt, Artificial Sequence
  RNA Oligomer
uucuucaguaauguugcaagg

SEQ ID NO: 25703 - RNA, 21 nt, Artificial Sequence
  RNA Oligomer
augcacccuugaaagcauccc

SEQ ID NO: 25704 - RNA, 21 nt, Artificial Sequence
  RNA Oligomer
caugaccaugaaguuuauggu

SEQ ID NO: 25705 - RNA, 21 nt, Artificial Sequence
  RNA Oligomer
caacaaggucauucauuugga

SEQ ID NO: 25706 - RNA, 21 nt, Artificial Sequence
  RNA Oligomer
aacaaggucauucauuuggaa

SEQ ID NO: 25707 - RNA, 21 nt, Artificial Sequence
  RNA Oligomer
uuggaaauguaaugcuuucug

SEQ ID NO: 25708 - RNA, 21 nt, Artificial Sequence
  RNA Oligomer
uggaaauguaaugcuuucuga

SEQ ID NO: 25709 - RNA, 21 nt, Artificial Sequence
  RNA Oligomer
gguguggugauuuuucaauag

SEQ ID NO: 25710 - RNA, 21 nt, Artificial Sequence
  RNA Oligomer
aaacaaccacagcgacuggcu

SEQ ID NO: 25711 - RNA, 21 nt, Artificial Sequence
  RNA Oligomer
augaauccucaggauuuuuca

SEQ ID NO: 25712 - RNA, 21 nt, Artificial Sequence
  RNA Oligomer
uccucaggauuuuucacacac

SEQ ID NO: 25713 - RNA, 21 nt, Artificial Sequence
  RNA Oligomer
ucuguagauauucuugcagga

SEQ ID NO: 25714 - RNA, 21 nt, Artificial Sequence
  RNA Oligomer
uacaugucucaucucaggaug

SEQ ID NO: 25715 - RNA, 21 nt, Artificial Sequence
  RNA Oligomer
guugcaaauuauggacuucca

SEQ ID NO: 25716 - RNA, 21 nt, Artificial Sequence
  RNA Oligomer
acaccaugugaggucaucagc

SEQ ID NO: 25717 - RNA, 21 nt, Artificial Sequence
  RNA Oligomer
gucaucagcaagguagccuag

SEQ ID NO: 25718 - RNA, 21 nt, Artificial Sequence
  RNA Oligomer
uucugcuccaaagaagaaucu

SEQ ID NO: 25719 - RNA, 21 nt, Artificial Sequence
  RNA Oligomer
aagaaucuuguugcaagguac

SEQ ID NO: 25720 - RNA, 21 nt, Artificial Sequence
  RNA Oligomer
acggucugaguucccaacuuc

SEQ ID NO: 25721 - RNA, 21 nt, Artificial Sequence
  RNA Oligomer
aaaugcacccuugaaagcauc

SEQ ID NO: 25722 - RNA, 21 nt, Artificial Sequence
  RNA Oligomer
gaccaugaaguuuaugguuug

SEQ ID NO: 25723 - RNA, 21 nt, Artificial Sequence
  RNA Oligomer
accaugaaguuuaugguuuga

SEQ ID NO: 25724 - RNA, 21 nt, Artificial Sequence
  RNA Oligomer
agcuaaaacaaccacagcgac

SEQ ID NO: 25725 - RNA, 21 nt, Artificial Sequence
  RNA Oligomer
acuggcucagaucucagaugu

SEQ ID NO: 25726 - RNA, 21 nt, Artificial Sequence
  RNA Oligomer
ucgauuccagcucuuuuaugg

SEQ ID NO: 25727 - RNA, 21 nt, Artificial Sequence
  RNA Oligomer
ucaucucaggaugaauuucag

SEQ ID NO: 25728 - RNA, 21 nt, Artificial Sequence
  RNA Oligomer
uuuccagaauacugaaacagg

SEQ ID NO: 25729 - RNA, 21 nt, Artificial Sequence
  RNA Oligomer
cagaauacugaaacaggguug

SEQ ID NO: 25730 - RNA, 21 nt, Artificial Sequence
  RNA Oligomer
ugcuccaaagaagaaucuugu

SEQ ID NO: 25731 - RNA, 21 nt, Artificial Sequence
  RNA Oligomer
ucaguaauguugcaaggaugu

SEQ ID NO: 25732 - RNA, 21 nt, Artificial Sequence
  RNA Oligomer
uuugguguggugauuuuucaa

SEQ ID NO: 25733 - RNA, 21 nt, Artificial Sequence
  RNA Oligomer
aaaaggcuuccgucucuggca

SEQ ID NO: 25734 - RNA, 21 nt, Artificial Sequence
  RNA Oligomer
acaugucucaucucaggauga

SEQ ID NO: 25735 - RNA, 21 nt, Artificial Sequence
  RNA Oligomer
uccagcucuuuuaugguggga

SEQ ID NO: 25736 - RNA, 21 nt, Artificial Sequence
  RNA Oligomer
uaucacccaggccucuagugu

SEQ ID NO: 25737 - RNA, 21 nt, Artificial Sequence
  RNA Oligomer
caucucaggaugaauuucagu

SEQ ID NO: 25738 - RNA, 21 nt, Artificial Sequence
  RNA Oligomer
uuguugcugcaguccuuucuc

SEQ ID NO: 25739 - RNA, 21 nt, Artificial Sequence
  RNA Oligomer
ugaauucaccacaccauguga

SEQ ID NO: 25740 - RNA, 21 nt, Artificial Sequence
  RNA Oligomer
ucaccacaccaugugagguca

SEQ ID NO: 25741 - RNA, 21 nt, Artificial Sequence
  RNA Oligomer
ugcuuucugaaaaacuugagc

SEQ ID NO: 25742 - RNA, 21 nt, Artificial Sequence
  RNA Oligomer
ucaauagaaaggauguuacca

SEQ ID NO: 25743 - RNA, 21 nt, Artificial Sequence
  RNA Oligomer
uggcucagaucucagaugugc

SEQ ID NO: 25744 - RNA, 21 nt, Artificial Sequence
  RNA Oligomer
uauggugggauccuggcauaa

SEQ ID NO: 25745 - RNA, 21 nt, Artificial Sequence
  RNA Oligomer
cuuccacacucccaaaagugc

SEQ ID NO: 25746 - RNA, 21 nt, Artificial Sequence
  RNA Oligomer
gauccauugagcaucacaugg

SEQ ID NO: 25747 - RNA, 21 nt, Artificial Sequence
  RNA Oligomer
uccauugagcaucacauggac

SEQ ID NO: 25748 - RNA, 21 nt, Artificial Sequence
  RNA Oligomer
aaccguuuuccagaauacuga

SEQ ID NO: 25749 - RNA, 21 nt, Artificial Sequence
  RNA Oligomer
aacaggguuguugcugcaguc

SEQ ID NO: 25750 - RNA, 21 nt, Artificial Sequence
  RNA Oligomer
cagucugggcaagauugauag

SEQ ID NO: 25751 - RNA, 21 nt, Artificial Sequence
  RNA Oligomer
agucugggcaagauugauagu

SEQ ID NO: 25752 - RNA, 21 nt, Artificial Sequence
  RNA Oligomer
aguguugaauucaccacacca

SEQ ID NO: 25753 - RNA, 21 nt, Artificial Sequence
  RNA Oligomer
ugaggucaucagcaagguagc

SEQ ID NO: 25754 - RNA, 21 nt, Artificial Sequence
  RNA Oligomer
uucaguaauguugcaaggaug

SEQ ID NO: 25755 - RNA, 21 nt, Artificial Sequence
  RNA Oligomer
ugcacccuugaaagcauccca

SEQ ID NO: 25756 - RNA, 21 nt, Artificial Sequence
  RNA Oligomer
ucuugacuauugauagaucac

SEQ ID NO: 25757 - RNA, 21 nt, Artificial Sequence
  RNA Oligomer
ugcgggauccauugagcauca

SEQ ID NO: 25758 - RNA, 21 nt, Artificial Sequence
  RNA Oligomer
uuccagaauacugaaacaggg

SEQ ID NO: 25759 - RNA, 21 nt, Artificial Sequence
  RNA Oligomer
gaauuucaguguacuugacgc

SEQ ID NO: 25760 - RNA, 21 nt, Artificial Sequence
  RNA Oligomer
cugaaacaggguuguugcugc

SEQ ID NO: 25761 - RNA, 21 nt, Artificial Sequence
  RNA Oligomer
uguugcugcaguccuuucucc

SEQ ID NO: 25762 - RNA, 21 nt, Artificial Sequence
  RNA Oligomer
uugaauucaccacaccaugug

SEQ ID NO: 25763 - RNA, 21 nt, Artificial Sequence
  RNA Oligomer
auucaccacaccaugugaggu

SEQ ID NO: 25764 - RNA, 21 nt, Artificial Sequence
  RNA Oligomer
auucugcuccaaagaagaauc

SEQ ID NO: 25765 - RNA, 21 nt, Artificial Sequence
  RNA Oligomer
ccaaagaagaaucuuguugca

SEQ ID NO: 25766 - RNA, 21 nt, Artificial Sequence
  RNA Oligomer
aagaagaaucuuguugcaagg

SEQ ID NO: 25767 - RNA, 21 nt, Artificial Sequence
  RNA Oligomer
aucuuguugcaagguacgguc

SEQ ID NO: 25768 - RNA, 21 nt, Artificial Sequence
  RNA Oligomer
ugaguucccaacuucauuagu

SEQ ID NO: 25769 - RNA, 21 nt, Artificial Sequence
  RNA Oligomer
ggacccuccaaaaucuucagc

SEQ ID NO: 25770 - RNA, 21 nt, Artificial Sequence
  RNA Oligomer
uuuuucacacacugaagaaac

SEQ ID NO: 25771 - RNA, 21 nt, Artificial Sequence
  RNA Oligomer
gucucuggaaucuucucuucc

SEQ ID NO: 25772 - RNA, 21 nt, Artificial Sequence
  RNA Oligomer
auccauugagcaucacaugga

SEQ ID NO: 25773 - RNA, 21 nt, Artificial Sequence
  RNA Oligomer
ccauugagcaucacauggacc

SEQ ID NO: 25774 - RNA, 21 nt, Artificial Sequence
  RNA Oligomer
accacaucacaggcagcuucu

SEQ ID NO: 25775 - RNA, 21 nt, Artificial Sequence
  RNA Oligomer
ucuucaguaauguugcaagga

SEQ ID NO: 25776 - RNA, 21 nt, Artificial Sequence
  RNA Oligomer
uuucacacacugaagaaacuu

SEQ ID NO: 25777 - RNA, 21 nt, Artificial Sequence
  RNA Oligomer
uagugucugaaccuucucugg

SEQ ID NO: 25778 - RNA, 21 nt, Artificial Sequence
  RNA Oligomer
uugcugcaguccuuucuccag

SEQ ID NO: 25779 - RNA, 21 nt, Artificial Sequence
  RNA Oligomer
cugcaguccuuucuccagucu

SEQ ID NO: 25780 - RNA, 21 nt, Artificial Sequence
  RNA Oligomer
uucaccacaccaugugagguc

SEQ ID NO: 25781 - RNA, 21 nt, Artificial Sequence
  RNA Oligomer
agaaucuuguugcaagguacg

SEQ ID NO: 25782 - RNA, 21 nt, Artificial Sequence
  RNA Oligomer
ucuuguugcaagguacggucu

SEQ ID NO: 25783 - RNA, 21 nt, Artificial Sequence
  RNA Oligomer
uggguucugaaacugcaccuc

SEQ ID NO: 25784 - RNA, 21 nt, Artificial Sequence
  RNA Oligomer
uucacacacugaagaaacuug

SEQ ID NO: 25785 - RNA, 21 nt, Artificial Sequence
  RNA Oligomer
ucuggaaucuucucuuccacc

SEQ ID NO: 25786 - RNA, 21 nt, Artificial Sequence
  RNA Oligomer
gucugaaccuucucugguugc

SEQ ID NO: 25787 - RNA, 21 nt, Artificial Sequence
  RNA Oligomer
gaaucuuguugcaagguacgg

SEQ ID NO: 25788 - RNA, 21 nt, Artificial Sequence
  RNA Oligomer
ucagaugugcaagaugaaucc

SEQ ID NO: 25789 - RNA, 21 nt, Artificial Sequence
  RNA Oligomer
uccagaauacugaaacagggu

SEQ ID NO: 25790 - RNA, 21 nt, Artificial Sequence
  RNA Oligomer
agaagaaucuuguugcaaggu

SEQ ID NO: 25791 - RNA, 21 nt, Artificial Sequence
  RNA Oligomer
aaucuuguugcaagguacggu

SEQ ID NO: 25792 - RNA, 21 nt, Artificial Sequence
  RNA Oligomer
cugaugggccagaucuuuuau

SEQ ID NO: 25793 - RNA, 21 nt, Artificial Sequence
  RNA Oligomer
ccagaucuuuuauucugcucc

SEQ ID NO: 25794 - RNA, 21 nt, Artificial Sequence
  RNA Oligomer
ugaauccucaggauuuuucac

SEQ ID NO: 25795 - RNA, 21 nt, Artificial Sequence
  RNA Oligomer
cagaucuuuuauucugcucca

SEQ ID NO: 25796 - RNA, 21 nt, Artificial Sequence
  RNA Oligomer
acuuccacacucccaaaagug

SEQ ID NO: 25797 - RNA, 21 nt, Artificial Sequence
  RNA Oligomer
guuuuccagaauacugaaaca

SEQ ID NO: 25798 - RNA, 21 nt, Artificial Sequence
  RNA Oligomer
aucucagaugugcaagaugaa

SEQ ID NO: 25799 - RNA, 21 nt, Artificial Sequence
  RNA Oligomer
cucuggaaucuucucuuccac

SEQ ID NO: 25800 - RNA, 21 nt, Artificial Sequence
  RNA Oligomer
ugucugaaccuucucugguug

SEQ ID NO: 25801 - RNA, 21 nt, Artificial Sequence
  RNA Oligomer
cucccaaaagugcuguuuuug

SEQ ID NO: 25802 - RNA, 21 nt, Artificial Sequence
  RNA Oligomer
ccaaaagugcuguuuuuguca

SEQ ID NO: 25803 - RNA, 21 nt, Artificial Sequence
  RNA Oligomer
ccaugaugaauucuagugaaa

SEQ ID NO: 25804 - RNA, 21 nt, Artificial Sequence
  RNA Oligomer
ccacugauaaaggcuuuauua

SEQ ID NO: 25805 - RNA, 21 nt, Artificial Sequence
  RNA Oligomer
agcaacaaccucaaaaucaau

SEQ ID NO: 25806 - RNA, 21 nt, Artificial Sequence
  RNA Oligomer
gcaccauuguagauugucuuu

SEQ ID NO: 25807 - RNA, 21 nt, Artificial Sequence
  RNA Oligomer
ccauuucuaaagugaccuuau

SEQ ID NO: 25808 - RNA, 21 nt, Artificial Sequence
  RNA Oligomer
ccagaaucuaaugcagaguac

SEQ ID NO: 25809 - RNA, 21 nt, Artificial Sequence
  RNA Oligomer
ccaguuuacuuaagguagaaa

SEQ ID NO: 25810 - RNA, 21 nt, Artificial Sequence
  RNA Oligomer
ccauauuaacacagcugacuc

SEQ ID NO: 25811 - RNA, 21 nt, Artificial Sequence
  RNA Oligomer
acaucaacaauccaggauauu

SEQ ID NO: 25812 - RNA, 21 nt, Artificial Sequence
  RNA Oligomer
caacaucaacaauccaggaua

SEQ ID NO: 25813 - RNA, 21 nt, Artificial Sequence
  RNA Oligomer
gcauagaugaucgaaaauuac

SEQ ID NO: 25814 - RNA, 21 nt, Artificial Sequence
  RNA Oligomer
gggaaugagguuuuuguuguu

SEQ ID NO: 25815 - RNA, 21 nt, Artificial Sequence
  RNA Oligomer
ggguugauaaaaguucuugau

SEQ ID NO: 25816 - RNA, 21 nt, Artificial Sequence
  RNA Oligomer
ggaagaucacugggauugaaa

SEQ ID NO: 25817 - RNA, 21 nt, Artificial Sequence
  RNA Oligomer
gccuuccuucauguccucuac

SEQ ID NO: 25818 - RNA, 21 nt, Artificial Sequence
  RNA Oligomer
ggaugauggcuuuuauaaaug

SEQ ID NO: 25819 - RNA, 21 nt, Artificial Sequence
  RNA Oligomer
gcguuuauuuauaacugguug

SEQ ID NO: 25820 - RNA, 21 nt, Artificial Sequence
  RNA Oligomer
gccauuucuaaagugaccuua

SEQ ID NO: 25821 - RNA, 21 nt, Artificial Sequence
  RNA Oligomer
ggaaugagguuuuuguuguuu

SEQ ID NO: 25822 - RNA, 21 nt, Artificial Sequence
  RNA Oligomer
gcugugugucuucuuguuuuu

SEQ ID NO: 25823 - RNA, 21 nt, Artificial Sequence
  RNA Oligomer
gggaugauggcuuuuauaaau

SEQ ID NO: 25824 - RNA, 21 nt, Artificial Sequence
  RNA Oligomer
caaugcauagaugaucgaaaa

SEQ ID NO: 25825 - RNA, 21 nt, Artificial Sequence
  RNA Oligomer
ggcauguaauucuuccucuau

SEQ ID NO: 25826 - RNA, 21 nt, Artificial Sequence
  RNA Oligomer
gcagaagucuugagcuauuca

SEQ ID NO: 25827 - RNA, 21 nt, Artificial Sequence
  RNA Oligomer
ggaacucaaaacacuagaaaa

SEQ ID NO: 25828 - RNA, 21 nt, Artificial Sequence
  RNA Oligomer
ggaaaggaacucaaaacacua

SEQ ID NO: 25829 - RNA, 21 nt, Artificial Sequence
  RNA Oligomer
caacaaccucaaaaucaauca

SEQ ID NO: 25830 - RNA, 21 nt, Artificial Sequence
  RNA Oligomer
gcacugaguuuggcauuuuuc

SEQ ID NO: 25831 - RNA, 21 nt, Artificial Sequence
  RNA Oligomer
ggugugaagauucaucauuau

SEQ ID NO: 25832 - RNA, 21 nt, Artificial Sequence
  RNA Oligomer
gguauaggaaagacugaauaa

SEQ ID NO: 25833 - RNA, 21 nt, Artificial Sequence
  RNA Oligomer
cgauggagauugggaaacuua

SEQ ID NO: 25834 - RNA, 21 nt, Artificial Sequence
  RNA Oligomer
gcacuuccucuuacuaugaau

SEQ ID NO: 25835 - RNA, 21 nt, Artificial Sequence
  RNA Oligomer
uccagaaucuaaugcagagua

SEQ ID NO: 25836 - RNA, 21 nt, Artificial Sequence
  RNA Oligomer
gcaacaaccucaaaaucaauc

SEQ ID NO: 25837 - RNA, 21 nt, Artificial Sequence
  RNA Oligomer
ggaaaaauauugguagacauc

SEQ ID NO: 25838 - RNA, 21 nt, Artificial Sequence
  RNA Oligomer
gcaaagguacacagaacacac

SEQ ID NO: 25839 - RNA, 21 nt, Artificial Sequence
  RNA Oligomer
aacaucaacaauccaggauau

SEQ ID NO: 25840 - RNA, 21 nt, Artificial Sequence
  RNA Oligomer
acaacaucaacaauccaggau

SEQ ID NO: 25841 - RNA, 21 nt, Artificial Sequence
  RNA Oligomer
gcauguaauucuuccucuaua

SEQ ID NO: 25842 - RNA, 21 nt, Artificial Sequence
  RNA Oligomer
gucuugcaaaauccaauagaa

SEQ ID NO: 25843 - RNA, 21 nt, Artificial Sequence
  RNA Oligomer
cuggugaucaaguuuguccua

SEQ ID NO: 25844 - RNA, 21 nt, Artificial Sequence
  RNA Oligomer
gggcuuaucauuccuugcacu

SEQ ID NO: 25845 - RNA, 21 nt, Artificial Sequence
  RNA Oligomer
ccuuccuucauguccucuaca

SEQ ID NO: 25846 - RNA, 21 nt, Artificial Sequence
  RNA Oligomer
cuauuuccauuccaaaucgua

SEQ ID NO: 25847 - RNA, 21 nt, Artificial Sequence
  RNA Oligomer
gugauggauauuguucguaau

SEQ ID NO: 25848 - RNA, 21 nt, Artificial Sequence
  RNA Oligomer
ugacuccuccaguuuacuuaa

SEQ ID NO: 25849 - RNA, 21 nt, Artificial Sequence
  RNA Oligomer
gucacuacucaccuauguuau

SEQ ID NO: 25850 - RNA, 21 nt, Artificial Sequence
  RNA Oligomer
ggcaucauaaucauagcaauc

SEQ ID NO: 25851 - RNA, 21 nt, Artificial Sequence
  RNA Oligomer
caaaauaacuaaaaggcacug

SEQ ID NO: 25852 - RNA, 21 nt, Artificial Sequence
  RNA Oligomer
aggaugguucucacuguuuuu

SEQ ID NO: 25853 - RNA, 21 nt, Artificial Sequence
  RNA Oligomer
agaauuuuagacagcaagcua

SEQ ID NO: 25854 - RNA, 21 nt, Artificial Sequence
  RNA Oligomer
gaaggguugauaaaaguucuu

SEQ ID NO: 25855 - RNA, 21 nt, Artificial Sequence
  RNA Oligomer
cccuuggauuucacuugcauu

SEQ ID NO: 25856 - RNA, 21 nt, Artificial Sequence
  RNA Oligomer
ccuaaugucuugcaaaaucca

SEQ ID NO: 25857 - RNA, 21 nt, Artificial Sequence
  RNA Oligomer
acauugcuugucuuugagaaa

SEQ ID NO: 25858 - RNA, 21 nt, Artificial Sequence
  RNA Oligomer
ggauuucugaacuaugguuuu

SEQ ID NO: 25859 - RNA, 21 nt, Artificial Sequence
  RNA Oligomer
ggcuuaucauuccuugcacug

SEQ ID NO: 25860 - RNA, 21 nt, Artificial Sequence
  RNA Oligomer
ggaacuggugauuuuggaaga

SEQ ID NO: 25861 - RNA, 21 nt, Artificial Sequence
  RNA Oligomer
ccaggcaauacucaagaagga

SEQ ID NO: 25862 - RNA, 21 nt, Artificial Sequence
  RNA Oligomer
agcaagagacuguauguauuu

SEQ ID NO: 25863 - RNA, 21 nt, Artificial Sequence
  RNA Oligomer
cagaaaagcaagagacuguau

SEQ ID NO: 25864 - RNA, 21 nt, Artificial Sequence
  RNA Oligomer
gugugucuucuuguuuuucua

SEQ ID NO: 25865 - RNA, 21 nt, Artificial Sequence
  RNA Oligomer
gugcugugugucuucuuguuu

SEQ ID NO: 25866 - RNA, 21 nt, Artificial Sequence
  RNA Oligomer
ccugcagcuauuuccaaugug

SEQ ID NO: 25867 - RNA, 21 nt, Artificial Sequence
  RNA Oligomer
gcaaagagugauggauauugu

SEQ ID NO: 25868 - RNA, 21 nt, Artificial Sequence
  RNA Oligomer
gaaucuaaugcagaguaccuu

SEQ ID NO: 25869 - RNA, 21 nt, Artificial Sequence
  RNA Oligomer
acaucagcaacaaccucaaaa

SEQ ID NO: 25870 - RNA, 21 nt, Artificial Sequence
  RNA Oligomer
cuggccuuacguaauauauuu

SEQ ID NO: 25871 - RNA, 21 nt, Artificial Sequence
  RNA Oligomer
gaaucuggccuuacguaauau

SEQ ID NO: 25872 - RNA, 21 nt, Artificial Sequence
  RNA Oligomer
uggcaucauaaucauagcaau

SEQ ID NO: 25873 - RNA, 21 nt, Artificial Sequence
  RNA Oligomer
gaagucuggcaucauaaucau

SEQ ID NO: 25874 - RNA, 21 nt, Artificial Sequence
  RNA Oligomer
agguauaggaaagacugaaua

SEQ ID NO: 25875 - RNA, 21 nt, Artificial Sequence
  RNA Oligomer
uggcauguaauucuuccucua

SEQ ID NO: 25876 - RNA, 21 nt, Artificial Sequence
  RNA Oligomer
ggaaguaaaggcaaacauaaa

SEQ ID NO: 25877 - RNA, 21 nt, Artificial Sequence
  RNA Oligomer
cuaaugucuugcaaaauccaa

SEQ ID NO: 25878 - RNA, 21 nt, Artificial Sequence
  RNA Oligomer
ggaagagaacaccauuuuauc

SEQ ID NO: 25879 - RNA, 21 nt, Artificial Sequence
  RNA Oligomer
gggcugggaaaggaacucaaa

SEQ ID NO: 25880 - RNA, 21 nt, Artificial Sequence
  RNA Oligomer
guccuaaucaugccaugugua

SEQ ID NO: 25881 - RNA, 21 nt, Artificial Sequence
  RNA Oligomer
ucagugauucauauguggcuu

SEQ ID NO: 25882 - RNA, 21 nt, Artificial Sequence
  RNA Oligomer
gaacuggugauuuuggaagau

SEQ ID NO: 25883 - RNA, 21 nt, Artificial Sequence
  RNA Oligomer
acccaggcaauacucaagaag

SEQ ID NO: 25884 - RNA, 21 nt, Artificial Sequence
  RNA Oligomer
cacuugugauuccuauucgau

SEQ ID NO: 25885 - RNA, 21 nt, Artificial Sequence
  RNA Oligomer
ugccuuccuucauguccucua

SEQ ID NO: 25886 - RNA, 21 nt, Artificial Sequence
  RNA Oligomer
gcaagagacuguauguauuuu

SEQ ID NO: 25887 - RNA, 21 nt, Artificial Sequence
  RNA Oligomer
gcacuuacacugcuugcuuug

SEQ ID NO: 25888 - RNA, 21 nt, Artificial Sequence
  RNA Oligomer
gcuauuuccauuccaaaucgu

SEQ ID NO: 25889 - RNA, 21 nt, Artificial Sequence
  RNA Oligomer
ggcuauuuccauuccaaaucg

SEQ ID NO: 25890 - RNA, 21 nt, Artificial Sequence
  RNA Oligomer
ugauggauauuguucguaauc

SEQ ID NO: 25891 - RNA, 21 nt, Artificial Sequence
  RNA Oligomer
ccacgugguaaaagcauuuaa

SEQ ID NO: 25892 - RNA, 21 nt, Artificial Sequence
  RNA Oligomer
caauauccagaaucuaaugca

SEQ ID NO: 25893 - RNA, 21 nt, Artificial Sequence
  RNA Oligomer
agggaugauggcuuuuauaaa

SEQ ID NO: 25894 - RNA, 21 nt, Artificial Sequence
  RNA Oligomer
uaagggaugauggcuuuuaua

SEQ ID NO: 25895 - RNA, 21 nt, Artificial Sequence
  RNA Oligomer
uuaagggaugauggcuuuuau

SEQ ID NO: 25896 - RNA, 21 nt, Artificial Sequence
  RNA Oligomer
cuaaacuucuuuacugcugau

SEQ ID NO: 25897 - RNA, 21 nt, Artificial Sequence
  RNA Oligomer
ccuuuuaacagauccaaacua

SEQ ID NO: 25898 - RNA, 21 nt, Artificial Sequence
  RNA Oligomer
gcauuuccagaccugaccuuu

SEQ ID NO: 25899 - RNA, 21 nt, Artificial Sequence
  RNA Oligomer
cucugaugguuuuggcauaau

SEQ ID NO: 25900 - RNA, 21 nt, Artificial Sequence
  RNA Oligomer
agagaagucuuuggaguuaac

SEQ ID NO: 25901 - RNA, 21 nt, Artificial Sequence
  RNA Oligomer
cguuuauuuauaacugguugc

SEQ ID NO: 25902 - RNA, 21 nt, Artificial Sequence
  RNA Oligomer
caccauuguagauugucuuuu

SEQ ID NO: 25903 - RNA, 21 nt, Artificial Sequence
  RNA Oligomer
ccauuggaugaggguguugcu

SEQ ID NO: 25904 - RNA, 21 nt, Artificial Sequence
  RNA Oligomer
ugguucucacuguuuuucugu

SEQ ID NO: 25905 - RNA, 21 nt, Artificial Sequence
  RNA Oligomer
gcugaaauuuaggaugguucu

SEQ ID NO: 25906 - RNA, 21 nt, Artificial Sequence
  RNA Oligomer
aggugugaagauucaucauua

SEQ ID NO: 25907 - RNA, 21 nt, Artificial Sequence
  RNA Oligomer
gaacaaugcauagaugaucga

SEQ ID NO: 25908 - RNA, 21 nt, Artificial Sequence
  RNA Oligomer
cuaguguaaauaaguagcuuc

SEQ ID NO: 25909 - RNA, 21 nt, Artificial Sequence
  RNA Oligomer
gguugauaaaaguucuugauc

SEQ ID NO: 25910 - RNA, 21 nt, Artificial Sequence
  RNA Oligomer
caaagaaggguugauaaaagu

SEQ ID NO: 25911 - RNA, 21 nt, Artificial Sequence
  RNA Oligomer
gcaaagaaggguugauaaaag

SEQ ID NO: 25912 - RNA, 21 nt, Artificial Sequence
  RNA Oligomer
cuauagagcuggcauguaauu

SEQ ID NO: 25913 - RNA, 21 nt, Artificial Sequence
  RNA Oligomer
ucuauagagcuggcauguaau

SEQ ID NO: 25914 - RNA, 21 nt, Artificial Sequence
  RNA Oligomer
aggcuuuauuagguauaucug

SEQ ID NO: 25915 - RNA, 21 nt, Artificial Sequence
  RNA Oligomer
ccaguggugcagaagucuuga

SEQ ID NO: 25916 - RNA, 21 nt, Artificial Sequence
  RNA Oligomer
ccauuuuaucucagguuagug

SEQ ID NO: 25917 - RNA, 21 nt, Artificial Sequence
  RNA Oligomer
aggaacucaaaacacuagaaa

SEQ ID NO: 25918 - RNA, 21 nt, Artificial Sequence
  RNA Oligomer
cuacguguuagggcuuaucau

SEQ ID NO: 25919 - RNA, 21 nt, Artificial Sequence
  RNA Oligomer
cagugauucauauguggcuuu

SEQ ID NO: 25920 - RNA, 21 nt, Artificial Sequence
  RNA Oligomer
guauguauuuuuggaacuggu

SEQ ID NO: 25921 - RNA, 21 nt, Artificial Sequence
  RNA Oligomer
gaaaagcaagagacuguaugu

SEQ ID NO: 25922 - RNA, 21 nt, Artificial Sequence
  RNA Oligomer
gacguaaucuacccuuauguu

SEQ ID NO: 25923 - RNA, 21 nt, Artificial Sequence
  RNA Oligomer
uggauauuguucguaaucuug

SEQ ID NO: 25924 - RNA, 21 nt, Artificial Sequence
  RNA Oligomer
caaagagugauggauauuguu

SEQ ID NO: 25925 - RNA, 21 nt, Artificial Sequence
  RNA Oligomer
agaaugaguuuacaacagaug

SEQ ID NO: 25926 - RNA, 21 nt, Artificial Sequence
  RNA Oligomer
gguagaaagaaugaguuuaca

SEQ ID NO: 25927 - RNA, 21 nt, Artificial Sequence
  RNA Oligomer
agguagaaagaaugaguuuac

SEQ ID NO: 25928 - RNA, 21 nt, Artificial Sequence
  RNA Oligomer
caguuuacuuaagguagaaag

SEQ ID NO: 25929 - RNA, 21 nt, Artificial Sequence
  RNA Oligomer
ucugaugguuuuggcauaaua

SEQ ID NO: 25930 - RNA, 21 nt, Artificial Sequence
  RNA Oligomer
augucacuacucaccuauguu

SEQ ID NO: 25931 - RNA, 21 nt, Artificial Sequence
  RNA Oligomer
aaaaugucacuacucaccuau

SEQ ID NO: 25932 - RNA, 21 nt, Artificial Sequence
  RNA Oligomer
gaaaaugucacuacucaccua

SEQ ID NO: 25933 - RNA, 21 nt, Artificial Sequence
  RNA Oligomer
auacaaaaaguuggacgacau

SEQ ID NO: 25934 - RNA, 21 nt, Artificial Sequence
  RNA Oligomer
ucagauaauaucuuugcacug

SEQ ID NO: 25935 - RNA, 21 nt, Artificial Sequence
  RNA Oligomer
ugaucuucccacauaucaaaa

SEQ ID NO: 25936 - RNA, 21 nt, Artificial Sequence
  RNA Oligomer
cuggcaucauaaucauagcaa

SEQ ID NO: 25937 - RNA, 21 nt, Artificial Sequence
  RNA Oligomer
gaaauuuaggaugguucucac

SEQ ID NO: 25938 - RNA, 21 nt, Artificial Sequence
  RNA Oligomer
agaugaucgaaaauuacggaa

SEQ ID NO: 25939 - RNA, 21 nt, Artificial Sequence
  RNA Oligomer
acaaugcauagaugaucgaaa

SEQ ID NO: 25940 - RNA, 21 nt, Artificial Sequence
  RNA Oligomer
agcuucuauaucugucuuagu

SEQ ID NO: 25941 - RNA, 21 nt, Artificial Sequence
  RNA Oligomer
cuauucagaagcagccaagaa

SEQ ID NO: 25942 - RNA, 21 nt, Artificial Sequence
  RNA Oligomer
acugaauaaaaauggagggau

SEQ ID NO: 25943 - RNA, 21 nt, Artificial Sequence
  RNA Oligomer
agagcuggcauguaauucuuc

SEQ ID NO: 25944 - RNA, 21 nt, Artificial Sequence
  RNA Oligomer
uagagcuggcauguaauucuu

SEQ ID NO: 25945 - RNA, 21 nt, Artificial Sequence
  RNA Oligomer
acguaucuauagagcuggcau

SEQ ID NO: 25946 - RNA, 21 nt, Artificial Sequence
  RNA Oligomer
agauauuuacugagaggaacu

SEQ ID NO: 25947 - RNA, 21 nt, Artificial Sequence
  RNA Oligomer
ggcuuuauuagguauaucuga

SEQ ID NO: 25948 - RNA, 21 nt, Artificial Sequence
  RNA Oligomer
ggcugaguuaagugaaaggaa

SEQ ID NO: 25949 - RNA, 21 nt, Artificial Sequence
  RNA Oligomer
accuaaugucuugcaaaaucc

SEQ ID NO: 25950 - RNA, 21 nt, Artificial Sequence
  RNA Oligomer
ugagaaauugacugacauacu

SEQ ID NO: 25951 - RNA, 21 nt, Artificial Sequence
  RNA Oligomer
accgugacugagggaaacauu

SEQ ID NO: 25952 - RNA, 21 nt, Artificial Sequence
  RNA Oligomer
gcuggauuucugaacuauggu

SEQ ID NO: 25953 - RNA, 21 nt, Artificial Sequence
  RNA Oligomer
gcuggugaucaaguuuguccu

SEQ ID NO: 25954 - RNA, 21 nt, Artificial Sequence
  RNA Oligomer
ugguguacggugggaagagau

SEQ ID NO: 25955 - RNA, 21 nt, Artificial Sequence
  RNA Oligomer
ggcuuugggaauacuuggguu

SEQ ID NO: 25956 - RNA, 21 nt, Artificial Sequence
  RNA Oligomer
cccaggcaauacucaagaagg

SEQ ID NO: 25957 - RNA, 21 nt, Artificial Sequence
  RNA Oligomer
acgauggagauugggaaacuu

SEQ ID NO: 25958 - RNA, 21 nt, Artificial Sequence
  RNA Oligomer
acacuugugauuccuauucga

SEQ ID NO: 25959 - RNA, 21 nt, Artificial Sequence
  RNA Oligomer
guauuuuuggaacuggugauu

SEQ ID NO: 25960 - RNA, 21 nt, Artificial Sequence
  RNA Oligomer
cuguauguauuuuuggaacug

SEQ ID NO: 25961 - RNA, 21 nt, Artificial Sequence
  RNA Oligomer
agacguaaucuacccuuaugu

SEQ ID NO: 25962 - RNA, 21 nt, Artificial Sequence
  RNA Oligomer
cccuucuauuugucugcugug

SEQ ID NO: 25963 - RNA, 21 nt, Artificial Sequence
  RNA Oligomer
uuguucguaaucuuggacuua

SEQ ID NO: 25964 - RNA, 21 nt, Artificial Sequence
  RNA Oligomer
ccucaaaaucaaucaauaucc

SEQ ID NO: 25965 - RNA, 21 nt, Artificial Sequence
  RNA Oligomer
cugaugguuuuggcauaauag

SEQ ID NO: 25966 - RNA, 21 nt, Artificial Sequence
  RNA Oligomer
gcugaccuauagaaaaaaaug

SEQ ID NO: 25967 - RNA, 21 nt, Artificial Sequence
  RNA Oligomer
gguaaaaugcugaccuauaga

SEQ ID NO: 25968 - RNA, 21 nt, Artificial Sequence
  RNA Oligomer
ucuagagaagucuuuggaguu

SEQ ID NO: 25969 - RNA, 21 nt, Artificial Sequence
  RNA Oligomer
ggcuggucuagagaagucuuu

SEQ ID NO: 25970 - RNA, 21 nt, Artificial Sequence
  RNA Oligomer
ucaguggaaaagauaaggaaa

SEQ ID NO: 25971 - RNA, 21 nt, Artificial Sequence
  RNA Oligomer
uacaaaaaguuggacgacauu

SEQ ID NO: 25972 - RNA, 21 nt, Artificial Sequence
  RNA Oligomer
gcaaggauacaaaaaguugga

SEQ ID NO: 25973 - RNA, 21 nt, Artificial Sequence
  RNA Oligomer
ugaaucuggccuuacguaaua

SEQ ID NO: 25974 - RNA, 21 nt, Artificial Sequence
  RNA Oligomer
gccuuaugcaugaucuuccca

SEQ ID NO: 25975 - RNA, 21 nt, Artificial Sequence
  RNA Oligomer
ucugugcugauaguacccuuu

SEQ ID NO: 25976 - RNA, 21 nt, Artificial Sequence
  RNA Oligomer
gugaagauucaucauuaugug

SEQ ID NO: 25977 - RNA, 21 nt, Artificial Sequence
  RNA Oligomer
gugugaagauucaucauuaug

SEQ ID NO: 25978 - RNA, 21 nt, Artificial Sequence
  RNA Oligomer
ccagaauuuuagacagcaagc

SEQ ID NO: 25979 - RNA, 21 nt, Artificial Sequence
  RNA Oligomer
aggguugauaaaaguucuuga

SEQ ID NO: 25980 - RNA, 21 nt, Artificial Sequence
  RNA Oligomer
agaaggguugauaaaaguucu

SEQ ID NO: 25981 - RNA, 21 nt, Artificial Sequence
  RNA Oligomer
cugaguuaagugaaaggaaaa

SEQ ID NO: 25982 - RNA, 21 nt, Artificial Sequence
  RNA Oligomer
ugagauugagacuagccuugu

SEQ ID NO: 25983 - RNA, 21 nt, Artificial Sequence
  RNA Oligomer
cuuugagaaauugacugacau

SEQ ID NO: 25984 - RNA, 21 nt, Artificial Sequence
  RNA Oligomer
uggauuucugaacuaugguuu

SEQ ID NO: 25985 - RNA, 21 nt, Artificial Sequence
  RNA Oligomer
ggcugggaaaggaacucaaaa

SEQ ID NO: 25986 - RNA, 21 nt, Artificial Sequence
  RNA Oligomer
caaaucucagaugguaucuuc

SEQ ID NO: 25987 - RNA, 21 nt, Artificial Sequence
  RNA Oligomer
ucagcccuucaaaucucagau

SEQ ID NO: 25988 - RNA, 21 nt, Artificial Sequence
  RNA Oligomer
agauuccucagcccuucaaau

SEQ ID NO: 25989 - RNA, 21 nt, Artificial Sequence
  RNA Oligomer
uggaagaucacugggauugaa

SEQ ID NO: 25990 - RNA, 21 nt, Artificial Sequence
  RNA Oligomer
gcuuugggaauacuuggguuu

SEQ ID NO: 25991 - RNA, 21 nt, Artificial Sequence
  RNA Oligomer
ggcucagugauucauaugugg

SEQ ID NO: 25992 - RNA, 21 nt, Artificial Sequence
  RNA Oligomer
uggcucagugauucauaugug

SEQ ID NO: 25993 - RNA, 21 nt, Artificial Sequence
  RNA Oligomer
uuggaacuggugauuuuggaa

SEQ ID NO: 25994 - RNA, 21 nt, Artificial Sequence
  RNA Oligomer
ggcuugaccacuggaugcuuu

SEQ ID NO: 25995 - RNA, 21 nt, Artificial Sequence
  RNA Oligomer
ucuuuccaauaacagcacuua

SEQ ID NO: 25996 - RNA, 21 nt, Artificial Sequence
  RNA Oligomer
ccauuccaaaucguaucuuuc

SEQ ID NO: 25997 - RNA, 21 nt, Artificial Sequence
  RNA Oligomer
uccauuccaaaucguaucuuu

SEQ ID NO: 25998 - RNA, 21 nt, Artificial Sequence
  RNA Oligomer
cguaaucuacccuuauguuua

SEQ ID NO: 25999 - RNA, 21 nt, Artificial Sequence
  RNA Oligomer
guguuauaagagacguaaucu

SEQ ID NO: 26000 - RNA, 21 nt, Artificial Sequence
  RNA Oligomer
cugugugucuucuuguuuuuc

SEQ ID NO: 26001 - RNA, 21 nt, Artificial Sequence
  RNA Oligomer
ugcugugugucuucuuguuuu

SEQ ID NO: 26002 - RNA, 21 nt, Artificial Sequence
  RNA Oligomer
ccucuuacuaugaauucuuca

SEQ ID NO: 26003 - RNA, 21 nt, Artificial Sequence
  RNA Oligomer
gagugauggauauuguucgua

SEQ ID NO: 26004 - RNA, 21 nt, Artificial Sequence
  RNA Oligomer
agagugauggauauuguucgu

SEQ ID NO: 26005 - RNA, 21 nt, Artificial Sequence
  RNA Oligomer
uagagaagucuuuggaguuaa

SEQ ID NO: 26006 - RNA, 21 nt, Artificial Sequence
  RNA Oligomer
cuagagaagucuuuggaguua

SEQ ID NO: 26007 - RNA, 21 nt, Artificial Sequence
  RNA Oligomer
aggcuggucuagagaagucuu

SEQ ID NO: 26008 - RNA, 21 nt, Artificial Sequence
  RNA Oligomer
cuggauacugcucuuuuacuu

SEQ ID NO: 26009 - RNA, 21 nt, Artificial Sequence
  RNA Oligomer
uacucaccuauguuaugcaaa

SEQ ID NO: 26010 - RNA, 21 nt, Artificial Sequence
  RNA Oligomer
ggauacaaaaaguuggacgac

SEQ ID NO: 26011 - RNA, 21 nt, Artificial Sequence
  RNA Oligomer
ggaugaggguguugcuuucau

SEQ ID NO: 26012 - RNA, 21 nt, Artificial Sequence
  RNA Oligomer
aucuggccuuacguaauauau

SEQ ID NO: 26013 - RNA, 21 nt, Artificial Sequence
  RNA Oligomer
ugcugaaauuuaggaugguuc

SEQ ID NO: 26014 - RNA, 21 nt, Artificial Sequence
  RNA Oligomer
agaggugugaagauucaucau

SEQ ID NO: 26015 - RNA, 21 nt, Artificial Sequence
  RNA Oligomer
gaugaucgaaaauuacggaaa

SEQ ID NO: 26016 - RNA, 21 nt, Artificial Sequence
  RNA Oligomer
gucugcagguauaaauuugaa

SEQ ID NO: 26017 - RNA, 21 nt, Artificial Sequence
  RNA Oligomer
gaauagucugcagguauaaau

SEQ ID NO: 26018 - RNA, 21 nt, Artificial Sequence
  RNA Oligomer
ugaauagucugcagguauaaa

SEQ ID NO: 26019 - RNA, 21 nt, Artificial Sequence
  RNA Oligomer
augaauagucugcagguauaa

SEQ ID NO: 26020 - RNA, 21 nt, Artificial Sequence
  RNA Oligomer
cuucuauaucugucuuagucu

SEQ ID NO: 26021 - RNA, 21 nt, Artificial Sequence
  RNA Oligomer
agcaaagaaggguugauaaaa

SEQ ID NO: 26022 - RNA, 21 nt, Artificial Sequence
  RNA Oligomer
uagguauaggaaagacugaau

SEQ ID NO: 26023 - RNA, 21 nt, Artificial Sequence
  RNA Oligomer
agcuggcauguaauucuuccu

SEQ ID NO: 26024 - RNA, 21 nt, Artificial Sequence
  RNA Oligomer
ucaagggcugaguuaagugaa

SEQ ID NO: 26025 - RNA, 21 nt, Artificial Sequence
  RNA Oligomer
ucccugacucuuauuuuccca

SEQ ID NO: 26026 - RNA, 21 nt, Artificial Sequence
  RNA Oligomer
ugcuugucuuugagaaauuga

SEQ ID NO: 26027 - RNA, 21 nt, Artificial Sequence
  RNA Oligomer
gggaaaggaacucaaaacacu

SEQ ID NO: 26028 - RNA, 21 nt, Artificial Sequence
  RNA Oligomer
cugggaaaggaacucaaaaca

SEQ ID NO: 26029 - RNA, 21 nt, Artificial Sequence
  RNA Oligomer
gugcuggugaucaaguuuguc

SEQ ID NO: 26030 - RNA, 21 nt, Artificial Sequence
  RNA Oligomer
gaagaucacugggauugaaaa

SEQ ID NO: 26031 - RNA, 21 nt, Artificial Sequence
  RNA Oligomer
ucauauguggcuuugggaaua

SEQ ID NO: 26032 - RNA, 21 nt, Artificial Sequence
  RNA Oligomer
cuugugauuccuauucgauau

SEQ ID NO: 26033 - RNA, 21 nt, Artificial Sequence
  RNA Oligomer
aaagcaagagacuguauguau

SEQ ID NO: 26034 - RNA, 21 nt, Artificial Sequence
  RNA Oligomer
aucuuuccaauaacagcacuu

SEQ ID NO: 26035 - RNA, 21 nt, Artificial Sequence
  RNA Oligomer
agugauggauauuguucguaa

SEQ ID NO: 26036 - RNA, 21 nt, Artificial Sequence
  RNA Oligomer
aagcaaagagugauggauauu

SEQ ID NO: 26037 - RNA, 21 nt, Artificial Sequence
  RNA Oligomer
cacuuccucuuacuaugaauu

SEQ ID NO: 26038 - RNA, 21 nt, Artificial Sequence
  RNA Oligomer
guaaaagcauuuaacaccauc

SEQ ID NO: 26039 - RNA, 21 nt, Artificial Sequence
  RNA Oligomer
uguuaagggaugauggcuuuu

SEQ ID NO: 26040 - RNA, 21 nt, Artificial Sequence
  RNA Oligomer
ugcugauauguuuccuguauu

SEQ ID NO: 26041 - RNA, 21 nt, Artificial Sequence
  RNA Oligomer
acucugaugguuuuggcauaa

SEQ ID NO: 26042 - RNA, 21 nt, Artificial Sequence
  RNA Oligomer
guguuuauccuggcucauagu

SEQ ID NO: 26043 - RNA, 21 nt, Artificial Sequence
  RNA Oligomer
gagcauugguugauuaaaguu

SEQ ID NO: 26044 - RNA, 21 nt, Artificial Sequence
  RNA Oligomer
ugagcauugguugauuaaagu

SEQ ID NO: 26045 - RNA, 21 nt, Artificial Sequence
  RNA Oligomer
acuugagcauugguugauuaa

SEQ ID NO: 26046 - RNA, 21 nt, Artificial Sequence
  RNA Oligomer
uacuugagcauugguugauua

SEQ ID NO: 26047 - RNA, 21 nt, Artificial Sequence
  RNA Oligomer
ggauacugcucuuuuacuuga

SEQ ID NO: 26048 - RNA, 21 nt, Artificial Sequence
  RNA Oligomer
uggauacugcucuuuuacuug

SEQ ID NO: 26049 - RNA, 21 nt, Artificial Sequence
  RNA Oligomer
cuacaguaucaguggaaaaga

SEQ ID NO: 26050 - RNA, 21 nt, Artificial Sequence
  RNA Oligomer
caaaaaguuggacgacauuga

SEQ ID NO: 26051 - RNA, 21 nt, Artificial Sequence
  RNA Oligomer
uuauaacugguugcaaaggua

SEQ ID NO: 26052 - RNA, 21 nt, Artificial Sequence
  RNA Oligomer
caucauaaucauagcaaucca

SEQ ID NO: 26053 - RNA, 21 nt, Artificial Sequence
  RNA Oligomer
ggcacugaguuuggcauuuuu

SEQ ID NO: 26054 - RNA, 21 nt, Artificial Sequence
  RNA Oligomer
aagucuggcaucauaaucaua

SEQ ID NO: 26055 - RNA, 21 nt, Artificial Sequence
  RNA Oligomer
ggaugguucucacuguuuuuc

SEQ ID NO: 26056 - RNA, 21 nt, Artificial Sequence
  RNA Oligomer
uugcugaaauuuaggaugguu

SEQ ID NO: 26057 - RNA, 21 nt, Artificial Sequence
  RNA Oligomer
guaucuauagagcuggcaugu

SEQ ID NO: 26058 - RNA, 21 nt, Artificial Sequence
  RNA Oligomer
aaggaacucaaaacacuagaa

SEQ ID NO: 26059 - RNA, 21 nt, Artificial Sequence
  RNA Oligomer
ugggaaaggaacucaaaacac

SEQ ID NO: 26060 - RNA, 21 nt, Artificial Sequence
  RNA Oligomer
uguccuaaucaugccaugugu

SEQ ID NO: 26061 - RNA, 21 nt, Artificial Sequence
  RNA Oligomer
ucacugggauugaaaaugcuc

SEQ ID NO: 26062 - RNA, 21 nt, Artificial Sequence
  RNA Oligomer
uccucagcccuucaaaucuca

SEQ ID NO: 26063 - RNA, 21 nt, Artificial Sequence
  RNA Oligomer
gguguacggugggaagagauu

SEQ ID NO: 26064 - RNA, 21 nt, Artificial Sequence
  RNA Oligomer
gaauccauuuagcaccuccuc

SEQ ID NO: 26065 - RNA, 21 nt, Artificial Sequence
  RNA Oligomer
gcuugaccacuggaugcuuug

SEQ ID NO: 26066 - RNA, 21 nt, Artificial Sequence
  RNA Oligomer
gacuguauguauuuuuggaac

SEQ ID NO: 26067 - RNA, 21 nt, Artificial Sequence
  RNA Oligomer
agagacuguauguauuuuugg

SEQ ID NO: 26068 - RNA, 21 nt, Artificial Sequence
  RNA Oligomer
ccauucuacaacuguaccgag

SEQ ID NO: 26069 - RNA, 21 nt, Artificial Sequence
  RNA Oligomer
gguguuauugcugccauucua

SEQ ID NO: 26070 - RNA, 21 nt, Artificial Sequence
  RNA Oligomer
cuuacacugcuugcuuugguu

SEQ ID NO: 26071 - RNA, 21 nt, Artificial Sequence
  RNA Oligomer
uuccaaaucguaucuuuccaa

SEQ ID NO: 26072 - RNA, 21 nt, Artificial Sequence
  RNA Oligomer
acguaaucuacccuuauguuu

SEQ ID NO: 26073 - RNA, 21 nt, Artificial Sequence
  RNA Oligomer
cuaugaauucuucagaaaagc

SEQ ID NO: 26074 - RNA, 21 nt, Artificial Sequence
  RNA Oligomer
uccucuuacuaugaauucuuc

SEQ ID NO: 26075 - RNA, 21 nt, Artificial Sequence
  RNA Oligomer
caagcaaagagugauggauau

SEQ ID NO: 26076 - RNA, 21 nt, Artificial Sequence
  RNA Oligomer
cagguguuuguguguggaaau

SEQ ID NO: 26077 - RNA, 21 nt, Artificial Sequence
  RNA Oligomer
ggcagguguuuguguguggaa

SEQ ID NO: 26078 - RNA, 21 nt, Artificial Sequence
  RNA Oligomer
auguuaagggaugauggcuuu

SEQ ID NO: 26079 - RNA, 21 nt, Artificial Sequence
  RNA Oligomer
ggcgaacuguauuccuuuuaa

SEQ ID NO: 26080 - RNA, 21 nt, Artificial Sequence
  RNA Oligomer
gggcgaacuguauuccuuuua

SEQ ID NO: 26081 - RNA, 21 nt, Artificial Sequence
  RNA Oligomer
gcacucugaugguuuuggcau

SEQ ID NO: 26082 - RNA, 21 nt, Artificial Sequence
  RNA Oligomer
guaaaaugcugaccuauagaa

SEQ ID NO: 26083 - RNA, 21 nt, Artificial Sequence
  RNA Oligomer
accgaaaauagaaaaugccau

SEQ ID NO: 26084 - RNA, 21 nt, Artificial Sequence
  RNA Oligomer
cacagagagcauuaugauuuu

SEQ ID NO: 26085 - RNA, 21 nt, Artificial Sequence
  RNA Oligomer
gcauuuuucaaaccucuuucc

SEQ ID NO: 26086 - RNA, 21 nt, Artificial Sequence
  RNA Oligomer
caagaagucuggcaucauaau

SEQ ID NO: 26087 - RNA, 21 nt, Artificial Sequence
  RNA Oligomer
cggaaaaucauagggcagaga

SEQ ID NO: 26088 - RNA, 21 nt, Artificial Sequence
  RNA Oligomer
aaaugaauagucugcagguau

SEQ ID NO: 26089 - RNA, 21 nt, Artificial Sequence
  RNA Oligomer
gcuucuauaucugucuuaguc

SEQ ID NO: 26090 - RNA, 21 nt, Artificial Sequence
  RNA Oligomer
accagaauuuuagacagcaag

SEQ ID NO: 26091 - RNA, 21 nt, Artificial Sequence
  RNA Oligomer
aaccagaauuuuagacagcaa

SEQ ID NO: 26092 - RNA, 21 nt, Artificial Sequence
  RNA Oligomer
cuggcauguaauucuuccucu

SEQ ID NO: 26093 - RNA, 21 nt, Artificial Sequence
  RNA Oligomer
gcuggcauguaauucuuccuc

SEQ ID NO: 26094 - RNA, 21 nt, Artificial Sequence
  RNA Oligomer
aggaagugggucacaugaaau

SEQ ID NO: 26095 - RNA, 21 nt, Artificial Sequence
  RNA Oligomer
gcuuuauuagguauaucugag

SEQ ID NO: 26096 - RNA, 21 nt, Artificial Sequence
  RNA Oligomer
gggcugaguuaagugaaagga

SEQ ID NO: 26097 - RNA, 21 nt, Artificial Sequence
  RNA Oligomer
caagggcugaguuaagugaaa

SEQ ID NO: 26098 - RNA, 21 nt, Artificial Sequence
  RNA Oligomer
gguuucacacuaaagaguuuc

SEQ ID NO: 26099 - RNA, 21 nt, Artificial Sequence
  RNA Oligomer
ugguuucacacuaaagaguuu

SEQ ID NO: 26100 - RNA, 21 nt, Artificial Sequence
  RNA Oligomer
aaauugacugacauacuggaa

SEQ ID NO: 26101 - RNA, 21 nt, Artificial Sequence
  RNA Oligomer
ugacugagggaaacauugcuu

SEQ ID NO: 26102 - RNA, 21 nt, Artificial Sequence
  RNA Oligomer
cuggauuucugaacuaugguu

SEQ ID NO: 26103 - RNA, 21 nt, Artificial Sequence
  RNA Oligomer
agggcugggaaaggaacucaa

SEQ ID NO: 26104 - RNA, 21 nt, Artificial Sequence
  RNA Oligomer
ucaaaucucagaugguaucuu

SEQ ID NO: 26105 - RNA, 21 nt, Artificial Sequence
  RNA Oligomer
uuacacugcuugcuuugguuu

SEQ ID NO: 26106 - RNA, 21 nt, Artificial Sequence
  RNA Oligomer
gauaauacauuucguauggcu

SEQ ID NO: 26107 - RNA, 21 nt, Artificial Sequence
  RNA Oligomer
cuauuguguuauaagagacgu

SEQ ID NO: 26108 - RNA, 21 nt, Artificial Sequence
  RNA Oligomer
cugugcugugugucuucuugu

SEQ ID NO: 26109 - RNA, 21 nt, Artificial Sequence
  RNA Oligomer
cuauuuccaauguggagguuc

SEQ ID NO: 26110 - RNA, 21 nt, Artificial Sequence
  RNA Oligomer
cccugcagcuauuuccaaugu

SEQ ID NO: 26111 - RNA, 21 nt, Artificial Sequence
  RNA Oligomer
acgugguaaaagcauuuaaca

SEQ ID NO: 26112 - RNA, 21 nt, Artificial Sequence
  RNA Oligomer
gcugauauguuuccuguauuc

SEQ ID NO: 26113 - RNA, 21 nt, Artificial Sequence
  RNA Oligomer
acuaaacuucuuuacugcuga

SEQ ID NO: 26114 - RNA, 21 nt, Artificial Sequence
  RNA Oligomer
guauagaugcacuuccucuua

SEQ ID NO: 26115 - RNA, 21 nt, Artificial Sequence
  RNA Oligomer
caccgaaaauagaaaaugcca

SEQ ID NO: 26116 - RNA, 21 nt, Artificial Sequence
  RNA Oligomer
accaugcucuuuuuguuaaag

SEQ ID NO: 26117 - RNA, 21 nt, Artificial Sequence
  RNA Oligomer
caggcuggucuagagaagucu

SEQ ID NO: 26118 - RNA, 21 nt, Artificial Sequence
  RNA Oligomer
caguggaaaagauaaggaaaa

SEQ ID NO: 26119 - RNA, 21 nt, Artificial Sequence
  RNA Oligomer
uggaugaggguguugcuuuca

SEQ ID NO: 26120 - RNA, 21 nt, Artificial Sequence
  RNA Oligomer
aggcuuuguuuuucuaaaggc

SEQ ID NO: 26121 - RNA, 21 nt, Artificial Sequence
  RNA Oligomer
gaggugugaagauucaucauu

SEQ ID NO: 26122 - RNA, 21 nt, Artificial Sequence
  RNA Oligomer
ggaaaaucauagggcagagag

SEQ ID NO: 26123 - RNA, 21 nt, Artificial Sequence
  RNA Oligomer
gaucgaaaauuacggaaaauc

SEQ ID NO: 26124 - RNA, 21 nt, Artificial Sequence
  RNA Oligomer
cugcagguauaaauuugaaca

SEQ ID NO: 26125 - RNA, 21 nt, Artificial Sequence
  RNA Oligomer
cugaauaaaaauggagggaua

SEQ ID NO: 26126 - RNA, 21 nt, Artificial Sequence
  RNA Oligomer
uggaaguaaaggcaaacauaa

SEQ ID NO: 26127 - RNA, 21 nt, Artificial Sequence
  RNA Oligomer
gcugaguuaagugaaaggaaa

SEQ ID NO: 26128 - RNA, 21 nt, Artificial Sequence
  RNA Oligomer
agaaauugacugacauacugg

SEQ ID NO: 26129 - RNA, 21 nt, Artificial Sequence
  RNA Oligomer
acaccgugacugagggaaaca

SEQ ID NO: 26130 - RNA, 21 nt, Artificial Sequence
  RNA Oligomer
uggguacaguuaggaaaguuu

SEQ ID NO: 26131 - RNA, 21 nt, Artificial Sequence
  RNA Oligomer
cagcccuucaaaucucagaug

SEQ ID NO: 26132 - RNA, 21 nt, Artificial Sequence
  RNA Oligomer
ggcaauacucaagaaggagaa

SEQ ID NO: 26133 - RNA, 21 nt, Artificial Sequence
  RNA Oligomer
cucuacacacuugugauuccu

SEQ ID NO: 26134 - RNA, 21 nt, Artificial Sequence
  RNA Oligomer
guguuauugcugccauucuac

SEQ ID NO: 26135 - RNA, 21 nt, Artificial Sequence
  RNA Oligomer
agauaauacauuucguauggc

SEQ ID NO: 26136 - RNA, 21 nt, Artificial Sequence
  RNA Oligomer
guguguggaaaugacagcaaa

SEQ ID NO: 26137 - RNA, 21 nt, Artificial Sequence
  RNA Oligomer
gcagguguuuguguguggaaa

SEQ ID NO: 26138 - RNA, 21 nt, Artificial Sequence
  RNA Oligomer
cacgugguaaaagcauuuaac

SEQ ID NO: 26139 - RNA, 21 nt, Artificial Sequence
  RNA Oligomer
caucagcaacaaccucaaaau

SEQ ID NO: 26140 - RNA, 21 nt, Artificial Sequence
  RNA Oligomer
cagaugaaaauaagugcuuug

SEQ ID NO: 26141 - RNA, 21 nt, Artificial Sequence
  RNA Oligomer
caacagaugaaaauaagugcu

SEQ ID NO: 26142 - RNA, 21 nt, Artificial Sequence
  RNA Oligomer
cacucugaugguuuuggcaua

SEQ ID NO: 26143 - RNA, 21 nt, Artificial Sequence
  RNA Oligomer
gagaguaauguguuuauccug

SEQ ID NO: 26144 - RNA, 21 nt, Artificial Sequence
  RNA Oligomer
gaagagaguaauguguuuauc

SEQ ID NO: 26145 - RNA, 21 nt, Artificial Sequence
  RNA Oligomer
gaguuaaccaugcucuuuuug

SEQ ID NO: 26146 - RNA, 21 nt, Artificial Sequence
  RNA Oligomer
cagagagcauuaugauuuucu

SEQ ID NO: 26147 - RNA, 21 nt, Artificial Sequence
  RNA Oligomer
acagagagcauuaugauuuuc

SEQ ID NO: 26148 - RNA, 21 nt, Artificial Sequence
  RNA Oligomer
cauugaguagagucaugguau

SEQ ID NO: 26149 - RNA, 21 nt, Artificial Sequence
  RNA Oligomer
acauugaguagagucauggua

SEQ ID NO: 26150 - RNA, 21 nt, Artificial Sequence
  RNA Oligomer
aggauacaaaaaguuggacga

SEQ ID NO: 26151 - RNA, 21 nt, Artificial Sequence
  RNA Oligomer
ccucuuuccuuauuaaacaug

SEQ ID NO: 26152 - RNA, 21 nt, Artificial Sequence
  RNA Oligomer
agaaaacuuguauagaugcac

SEQ ID NO: 26153 - RNA, 21 nt, Artificial Sequence
  RNA Oligomer
gaaauguaaaaagggaaugag

SEQ ID NO: 26154 - RNA, 21 nt, Artificial Sequence
  RNA Oligomer
ugaggaagugggucacaugaa

SEQ ID NO: 26155 - RNA, 21 nt, Artificial Sequence
  RNA Oligomer
gaguuaagugaaaggaaaaac

SEQ ID NO: 26156 - RNA, 21 nt, Artificial Sequence
  RNA Oligomer
gguuauucuguuguuuuugga

SEQ ID NO: 26157 - RNA, 21 nt, Artificial Sequence
  RNA Oligomer
gugugguuauucuguuguuuu

SEQ ID NO: 26158 - RNA, 21 nt, Artificial Sequence
  RNA Oligomer
ccgugacugagggaaacauug

SEQ ID NO: 26159 - RNA, 21 nt, Artificial Sequence
  RNA Oligomer
ucagaugguaucuuccugcag

SEQ ID NO: 26160 - RNA, 21 nt, Artificial Sequence
  RNA Oligomer
cuuugggaauacuuggguuuu

SEQ ID NO: 26161 - RNA, 21 nt, Artificial Sequence
  RNA Oligomer
uuccauuccaaaucguaucuu

SEQ ID NO: 26162 - RNA, 21 nt, Artificial Sequence
  RNA Oligomer
cuucuauuugucugcugugcu

SEQ ID NO: 26163 - RNA, 21 nt, Artificial Sequence
  RNA Oligomer
cugcugauauguuuccuguau

SEQ ID NO: 26164 - RNA, 21 nt, Artificial Sequence
  RNA Oligomer
gcgaacuguauuccuuuuaac

SEQ ID NO: 26165 - RNA, 21 nt, Artificial Sequence
  RNA Oligomer
ugggcgaacuguauuccuuuu

SEQ ID NO: 26166 - RNA, 21 nt, Artificial Sequence
  RNA Oligomer
ugcauuuccagaccugaccuu

SEQ ID NO: 26167 - RNA, 21 nt, Artificial Sequence
  RNA Oligomer
ccugaguaguuaaaagcaauu

SEQ ID NO: 26168 - RNA, 21 nt, Artificial Sequence
  RNA Oligomer
accugaguaguuaaaagcaau

SEQ ID NO: 26169 - RNA, 21 nt, Artificial Sequence
  RNA Oligomer
guaauguguuuauccuggcuc

SEQ ID NO: 26170 - RNA, 21 nt, Artificial Sequence
  RNA Oligomer
gguugauuaaaguuuagguac

SEQ ID NO: 26171 - RNA, 21 nt, Artificial Sequence
  RNA Oligomer
caaggauacaaaaaguuggac

SEQ ID NO: 26172 - RNA, 21 nt, Artificial Sequence
  RNA Oligomer
aggcacugaguuuggcauuuu

SEQ ID NO: 26173 - RNA, 21 nt, Artificial Sequence
  RNA Oligomer
acggaaaaucauagggcagag

SEQ ID NO: 26174 - RNA, 21 nt, Artificial Sequence
  RNA Oligomer
guagcuucuauaucugucuua

SEQ ID NO: 26175 - RNA, 21 nt, Artificial Sequence
  RNA Oligomer
gaaaacuuguauagaugcacu

SEQ ID NO: 26176 - RNA, 21 nt, Artificial Sequence
  RNA Oligomer
agaaaccagaauuuuagacag

SEQ ID NO: 26177 - RNA, 21 nt, Artificial Sequence
  RNA Oligomer
guuuuuuggaaguaaaggcaa

SEQ ID NO: 26178 - RNA, 21 nt, Artificial Sequence
  RNA Oligomer
gaggaagugggucacaugaaa

SEQ ID NO: 26179 - RNA, 21 nt, Artificial Sequence
  RNA Oligomer
gugguuauucuguuguuuuug

SEQ ID NO: 26180 - RNA, 21 nt, Artificial Sequence
  RNA Oligomer
cagugugguuauucuguuguu

SEQ ID NO: 26181 - RNA, 21 nt, Artificial Sequence
  RNA Oligomer
uggcuuugggaauacuugggu

SEQ ID NO: 26182 - RNA, 21 nt, Artificial Sequence
  RNA Oligomer
uguacgauggagauugggaaa

SEQ ID NO: 26183 - RNA, 21 nt, Artificial Sequence
  RNA Oligomer
ccaaagaaauugaaaaguacc

SEQ ID NO: 26184 - RNA, 21 nt, Artificial Sequence
  RNA Oligomer
gcaaagccaagcaaagaguga

SEQ ID NO: 26185 - RNA, 21 nt, Artificial Sequence
  RNA Oligomer
cugauauguuuccuguauucu

SEQ ID NO: 26186 - RNA, 21 nt, Artificial Sequence
  RNA Oligomer
agcacucugaugguuuuggca

SEQ ID NO: 26187 - RNA, 21 nt, Artificial Sequence
  RNA Oligomer
agagaguaauguguuuauccu

SEQ ID NO: 26188 - RNA, 21 nt, Artificial Sequence
  RNA Oligomer
agagucaugguauacggugcu

SEQ ID NO: 26189 - RNA, 21 nt, Artificial Sequence
  RNA Oligomer
ggcugcauaauaucacaucaa

SEQ ID NO: 26190 - RNA, 21 nt, Artificial Sequence
  RNA Oligomer
ggccuuacguaauauauuuuc

SEQ ID NO: 26191 - RNA, 21 nt, Artificial Sequence
  RNA Oligomer
gagaggugugaagauucauca

SEQ ID NO: 26192 - RNA, 21 nt, Artificial Sequence
  RNA Oligomer
ggaaagacugaauaaaaaugg

SEQ ID NO: 26193 - RNA, 21 nt, Artificial Sequence
  RNA Oligomer
augucuuggauacauacguau

SEQ ID NO: 26194 - RNA, 21 nt, Artificial Sequence
  RNA Oligomer
ggaagugggucacaugaaaug

SEQ ID NO: 26195 - RNA, 21 nt, Artificial Sequence
  RNA Oligomer
gcaacaugcaugaccuaaugu

SEQ ID NO: 26196 - RNA, 21 nt, Artificial Sequence
  RNA Oligomer
uuacaccgugacugagggaaa

SEQ ID NO: 26197 - RNA, 21 nt, Artificial Sequence
  RNA Oligomer
aguuuuuuucuuacaccguga

SEQ ID NO: 26198 - RNA, 21 nt, Artificial Sequence
  RNA Oligomer
cgaaagcagcuuggcuuggua

SEQ ID NO: 26199 - RNA, 21 nt, Artificial Sequence
  RNA Oligomer
gguuuaccucccugguguuau

SEQ ID NO: 26200 - RNA, 21 nt, Artificial Sequence
  RNA Oligomer
acuucuuuacugcugauaugu

SEQ ID NO: 26201 - RNA, 21 nt, Artificial Sequence
  RNA Oligomer
acuuguauagaugcacuuccu

SEQ ID NO: 26202 - RNA, 21 nt, Artificial Sequence
  RNA Oligomer
cacaucaaauaggcauuuuuc

SEQ ID NO: 26203 - RNA, 21 nt, Artificial Sequence
  RNA Oligomer
cucaaauccuugcugaaauuu

SEQ ID NO: 26204 - RNA, 21 nt, Artificial Sequence
  RNA Oligomer
gcaauaagcaaagaaggguug

SEQ ID NO: 26205 - RNA, 21 nt, Artificial Sequence
  RNA Oligomer
gccuugugguuucacacuaaa

SEQ ID NO: 26206 - RNA, 21 nt, Artificial Sequence
  RNA Oligomer
agugugguuauucuguuguuu

SEQ ID NO: 26207 - RNA, 21 nt, Artificial Sequence
  RNA Oligomer
gaaaguuuuuuucuuacaccg

SEQ ID NO: 26208 - RNA, 21 nt, Artificial Sequence
  RNA Oligomer
auggguacaguuaggaaaguu

SEQ ID NO: 26209 - RNA, 21 nt, Artificial Sequence
  RNA Oligomer
gaaugauggguacaguuagga

SEQ ID NO: 26210 - RNA, 21 nt, Artificial Sequence
  RNA Oligomer
cugaacuaugguuuugaaugu

SEQ ID NO: 26211 - RNA, 21 nt, Artificial Sequence
  RNA Oligomer
uggguuuuuucuguuuguacu

SEQ ID NO: 26212 - RNA, 21 nt, Artificial Sequence
  RNA Oligomer
cuucauguccucuacacacuu

SEQ ID NO: 26213 - RNA, 21 nt, Artificial Sequence
  RNA Oligomer
agacaucagcaacaaccucaa

SEQ ID NO: 26214 - RNA, 21 nt, Artificial Sequence
  RNA Oligomer
cacacgcuccuucaacuuauc

SEQ ID NO: 26215 - RNA, 21 nt, Artificial Sequence
  RNA Oligomer
gcugcauaauaucacaucaaa

SEQ ID NO: 26216 - RNA, 21 nt, Artificial Sequence
  RNA Oligomer
aaaaggagccuuaugcaugau

SEQ ID NO: 26217 - RNA, 21 nt, Artificial Sequence
  RNA Oligomer
uguuuuucugugcugauagua

SEQ ID NO: 26218 - RNA, 21 nt, Artificial Sequence
  RNA Oligomer
cacuguuuuucugugcugaua

SEQ ID NO: 26219 - RNA, 21 nt, Artificial Sequence
  RNA Oligomer
guaaaaagggaaugagguuuu

SEQ ID NO: 26220 - RNA, 21 nt, Artificial Sequence
  RNA Oligomer
ugauggguacaguuaggaaag

SEQ ID NO: 26221 - RNA, 21 nt, Artificial Sequence
  RNA Oligomer
ggugaucaaguuuguccuaau

SEQ ID NO: 26222 - RNA, 21 nt, Artificial Sequence
  RNA Oligomer
caaugcagucaacuggagaga

SEQ ID NO: 26223 - RNA, 21 nt, Artificial Sequence
  RNA Oligomer
gcaauacucaagaaggagaau

SEQ ID NO: 26224 - RNA, 21 nt, Artificial Sequence
  RNA Oligomer
ucauguccucuacacacuugu

SEQ ID NO: 26225 - RNA, 21 nt, Artificial Sequence
  RNA Oligomer
gcuauuuccaauguggagguu

SEQ ID NO: 26226 - RNA, 21 nt, Artificial Sequence
  RNA Oligomer
ugaauucuucagaaaagcaag

SEQ ID NO: 26227 - RNA, 21 nt, Artificial Sequence
  RNA Oligomer
uguguguggaaaugacagcaa

SEQ ID NO: 26228 - RNA, 21 nt, Artificial Sequence
  RNA Oligomer
gcagaguaccuugcucauuug

SEQ ID NO: 26229 - RNA, 21 nt, Artificial Sequence
  RNA Oligomer
gacaucagcaacaaccucaaa

SEQ ID NO: 26230 - RNA, 21 nt, Artificial Sequence
  RNA Oligomer
acauccuuuuucaaaggcuuu

SEQ ID NO: 26231 - RNA, 21 nt, Artificial Sequence
  RNA Oligomer
gacugaauaaaaauggaggga

SEQ ID NO: 26232 - RNA, 21 nt, Artificial Sequence
  RNA Oligomer
aaagggaaugagguuuuuguu

SEQ ID NO: 26233 - RNA, 21 nt, Artificial Sequence
  RNA Oligomer
ugcugugcugugugucuucuu

SEQ ID NO: 26234 - RNA, 21 nt, Artificial Sequence
  RNA Oligomer
gcagccaaagaaauugaaaag

SEQ ID NO: 26235 - RNA, 21 nt, Artificial Sequence
  RNA Oligomer
cgaacuguauuccuuuuaaca

SEQ ID NO: 26236 - RNA, 21 nt, Artificial Sequence
  RNA Oligomer
gaaugaguuuacaacagauga

SEQ ID NO: 26237 - RNA, 21 nt, Artificial Sequence
  RNA Oligomer
cacagcugacuccuccaguuu

SEQ ID NO: 26238 - RNA, 21 nt, Artificial Sequence
  RNA Oligomer
ugaccauauuaacacagcuga

SEQ ID NO: 26239 - RNA, 21 nt, Artificial Sequence
  RNA Oligomer
gaacucuacuuuuauagccua

SEQ ID NO: 26240 - RNA, 21 nt, Artificial Sequence
  RNA Oligomer
agauaaggaaaaugucacuac

SEQ ID NO: 26241 - RNA, 21 nt, Artificial Sequence
  RNA Oligomer
ggaaaagauaaggaaaauguc

SEQ ID NO: 26242 - RNA, 21 nt, Artificial Sequence
  RNA Oligomer
ccaagcaaggauacaaaaagu

SEQ ID NO: 26243 - RNA, 21 nt, Artificial Sequence
  RNA Oligomer
ucuuaauggcugcauaauauc

SEQ ID NO: 26244 - RNA, 21 nt, Artificial Sequence
  RNA Oligomer
acuguuuuucugugcugauag

SEQ ID NO: 26245 - RNA, 21 nt, Artificial Sequence
  RNA Oligomer
uaagcaaagaaggguugauaa

SEQ ID NO: 26246 - RNA, 21 nt, Artificial Sequence
  RNA Oligomer
ccaauagaaguauugcagcuu

SEQ ID NO: 26247 - RNA, 21 nt, Artificial Sequence
  RNA Oligomer
uguccucuacacacuugugau

SEQ ID NO: 26248 - RNA, 21 nt, Artificial Sequence
  RNA Oligomer
cagcaacaaccucaaaaucaa

SEQ ID NO: 26249 - RNA, 21 nt, Artificial Sequence
  RNA Oligomer
accucccugcucccaaaacua

SEQ ID NO: 26250 - RNA, 21 nt, Artificial Sequence
  RNA Oligomer
cgcaccauuguagauugucuu

SEQ ID NO: 26251 - RNA, 21 nt, Artificial Sequence
  RNA Oligomer
cuguuuuucugugcugauagu

SEQ ID NO: 26252 - RNA, 21 nt, Artificial Sequence
  RNA Oligomer
aguagcuucuauaucugucuu

SEQ ID NO: 26253 - RNA, 21 nt, Artificial Sequence
  RNA Oligomer
auaagcaaagaaggguugaua

SEQ ID NO: 26254 - RNA, 21 nt, Artificial Sequence
  RNA Oligomer
caauaagcaaagaaggguuga

SEQ ID NO: 26255 - RNA, 21 nt, Artificial Sequence
  RNA Oligomer
agccuugugguuucacacuaa

SEQ ID NO: 26256 - RNA, 21 nt, Artificial Sequence
  RNA Oligomer
ccauguguagacaacacccuu

SEQ ID NO: 26257 - RNA, 21 nt, Artificial Sequence
  RNA Oligomer
guccucuacacacuugugauu

SEQ ID NO: 26258 - RNA, 21 nt, Artificial Sequence
  RNA Oligomer
guaucuuuccaauaacagcac

SEQ ID NO: 26259 - RNA, 21 nt, Artificial Sequence
  RNA Oligomer
guauggcuauuuccauuccaa

SEQ ID NO: 26260 - RNA, 21 nt, Artificial Sequence
  RNA Oligomer
ccaaguucuccuucuguccuu

SEQ ID NO: 26261 - RNA, 21 nt, Artificial Sequence
  RNA Oligomer
cugaguaguuaaaagcaauuc

SEQ ID NO: 26262 - RNA, 21 nt, Artificial Sequence
  RNA Oligomer
gcucuaccugaguaguuaaaa

SEQ ID NO: 26263 - RNA, 21 nt, Artificial Sequence
  RNA Oligomer
ugaacucuacuuuuauagccu

SEQ ID NO: 26264 - RNA, 21 nt, Artificial Sequence
  RNA Oligomer
ggucuagagaagucuuuggag

SEQ ID NO: 26265 - RNA, 21 nt, Artificial Sequence
  RNA Oligomer
uggucuagagaagucuuugga

SEQ ID NO: 26266 - RNA, 21 nt, Artificial Sequence
  RNA Oligomer
gcuggucuagagaagucuuug

SEQ ID NO: 26267 - RNA, 21 nt, Artificial Sequence
  RNA Oligomer
gcauuaugauuuucucacaga

SEQ ID NO: 26268 - RNA, 21 nt, Artificial Sequence
  RNA Oligomer
guggaaaagauaaggaaaaug

SEQ ID NO: 26269 - RNA, 21 nt, Artificial Sequence
  RNA Oligomer
caagcaaggauacaaaaaguu

SEQ ID NO: 26270 - RNA, 21 nt, Artificial Sequence
  RNA Oligomer
acagaacacacgcuccuucaa

SEQ ID NO: 26271 - RNA, 21 nt, Artificial Sequence
  RNA Oligomer
cacagaacacacgcuccuuca

SEQ ID NO: 26272 - RNA, 21 nt, Artificial Sequence
  RNA Oligomer
gccaagccauuucuaaaguga

SEQ ID NO: 26273 - RNA, 21 nt, Artificial Sequence
  RNA Oligomer
aaaggcacugaguuuggcauu

SEQ ID NO: 26274 - RNA, 21 nt, Artificial Sequence
  RNA Oligomer
ggcagagaggugugaagauuc

SEQ ID NO: 26275 - RNA, 21 nt, Artificial Sequence
  RNA Oligomer
gggcagagaggugugaagauu

SEQ ID NO: 26276 - RNA, 21 nt, Artificial Sequence
  RNA Oligomer
gaauaaaaauggagggauauc

SEQ ID NO: 26277 - RNA, 21 nt, Artificial Sequence
  RNA Oligomer
agaauagguauaggaaagacu

SEQ ID NO: 26278 - RNA, 21 nt, Artificial Sequence
  RNA Oligomer
cuguuguuuuuggaagucgaa

SEQ ID NO: 26279 - RNA, 21 nt, Artificial Sequence
  RNA Oligomer
cacuaaagaguuuccuuguua

SEQ ID NO: 26280 - RNA, 21 nt, Artificial Sequence
  RNA Oligomer
acacuaaagaguuuccuuguu

SEQ ID NO: 26281 - RNA, 21 nt, Artificial Sequence
  RNA Oligomer
acaccauuuuaucucagguua

SEQ ID NO: 26282 - RNA, 21 nt, Artificial Sequence
  RNA Oligomer
gugaucaaguuuguccuaauc

SEQ ID NO: 26283 - RNA, 21 nt, Artificial Sequence
  RNA Oligomer
ucacuucuuugccaucuguua

SEQ ID NO: 26284 - RNA, 21 nt, Artificial Sequence
  RNA Oligomer
cucaagaaggagaauccauuu

SEQ ID NO: 26285 - RNA, 21 nt, Artificial Sequence
  RNA Oligomer
gccauucuacaacuguaccga

SEQ ID NO: 26286 - RNA, 21 nt, Artificial Sequence
  RNA Oligomer
ccugguguuauugcugccauu

SEQ ID NO: 26287 - RNA, 21 nt, Artificial Sequence
  RNA Oligomer
ccaaaucguaucuuuccaaua

SEQ ID NO: 26288 - RNA, 21 nt, Artificial Sequence
  RNA Oligomer
gccaaagaaauugaaaaguac

SEQ ID NO: 26289 - RNA, 21 nt, Artificial Sequence
  RNA Oligomer
guauuccuuuuaacagaucca

SEQ ID NO: 26290 - RNA, 21 nt, Artificial Sequence
  RNA Oligomer
acaaccucccugcucccaaaa

SEQ ID NO: 26291 - RNA, 21 nt, Artificial Sequence
  RNA Oligomer
aaacccaagcaaggauacaaa

SEQ ID NO: 26292 - RNA, 21 nt, Artificial Sequence
  RNA Oligomer
uacauccuuuuucaaaggcuu

SEQ ID NO: 26293 - RNA, 21 nt, Artificial Sequence
  RNA Oligomer
cagagaggugugaagauucau

SEQ ID NO: 26294 - RNA, 21 nt, Artificial Sequence
  RNA Oligomer
ucacuugcauugugcaauaag

SEQ ID NO: 26295 - RNA, 21 nt, Artificial Sequence
  RNA Oligomer
gguauaucugaggaagugggu

SEQ ID NO: 26296 - RNA, 21 nt, Artificial Sequence
  RNA Oligomer
ugaccacugauaaaggcuuua

SEQ ID NO: 26297 - RNA, 21 nt, Artificial Sequence
  RNA Oligomer
ggugcagaagucuugagcuau

SEQ ID NO: 26298 - RNA, 21 nt, Artificial Sequence
  RNA Oligomer
ugaccuaaugucuugcaaaau

SEQ ID NO: 26299 - RNA, 21 nt, Artificial Sequence
  RNA Oligomer
ugaucaaguuuguccuaauca

SEQ ID NO: 26300 - RNA, 21 nt, Artificial Sequence
  RNA Oligomer
gccuggcucagugauucauau

SEQ ID NO: 26301 - RNA, 21 nt, Artificial Sequence
  RNA Oligomer
uccucuacacacuugugauuc

SEQ ID NO: 26302 - RNA, 21 nt, Artificial Sequence
  RNA Oligomer
ccacuggaugcuuugccgaaa

SEQ ID NO: 26303 - RNA, 21 nt, Artificial Sequence
  RNA Oligomer
uuucacuagaauucaucaugg

SEQ ID NO: 26304 - RNA, 21 nt, Artificial Sequence
  RNA Oligomer
uaauaaagccuuuaucagugg

SEQ ID NO: 26305 - RNA, 21 nt, Artificial Sequence
  RNA Oligomer
auugauuuugagguuguugcu

SEQ ID NO: 26306 - RNA, 21 nt, Artificial Sequence
  RNA Oligomer
aaagacaaucuacaauggugc

SEQ ID NO: 26307 - RNA, 21 nt, Artificial Sequence
  RNA Oligomer
auaaggucacuuuagaaaugg

SEQ ID NO: 26308 - RNA, 21 nt, Artificial Sequence
  RNA Oligomer
guacucugcauuagauucugg

SEQ ID NO: 26309 - RNA, 21 nt, Artificial Sequence
  RNA Oligomer
uuucuaccuuaaguaaacugg

SEQ ID NO: 26310 - RNA, 21 nt, Artificial Sequence
  RNA Oligomer
gagucagcuguguuaauaugg

SEQ ID NO: 26311 - RNA, 21 nt, Artificial Sequence
  RNA Oligomer
aauauccuggauuguugaugu

SEQ ID NO: 26312 - RNA, 21 nt, Artificial Sequence
  RNA Oligomer
uauccuggauuguugauguug

SEQ ID NO: 26313 - RNA, 21 nt, Artificial Sequence
  RNA Oligomer
guaauuuucgaucaucuaugc

SEQ ID NO: 26314 - RNA, 21 nt, Artificial Sequence
  RNA Oligomer
aacaacaaaaaccucauuccc

SEQ ID NO: 26315 - RNA, 21 nt, Artificial Sequence
  RNA Oligomer
aucaagaacuuuuaucaaccc

SEQ ID NO: 26316 - RNA, 21 nt, Artificial Sequence
  RNA Oligomer
uuucaaucccagugaucuucc

SEQ ID NO: 26317 - RNA, 21 nt, Artificial Sequence
  RNA Oligomer
guagaggacaugaaggaaggc

SEQ ID NO: 26318 - RNA, 21 nt, Artificial Sequence
  RNA Oligomer
cauuuauaaaagccaucaucc

SEQ ID NO: 26319 - RNA, 21 nt, Artificial Sequence
  RNA Oligomer
caaccaguuauaaauaaacgc

SEQ ID NO: 26320 - RNA, 21 nt, Artificial Sequence
  RNA Oligomer
uaaggucacuuuagaaauggc

SEQ ID NO: 26321 - RNA, 21 nt, Artificial Sequence
  RNA Oligomer
aaacaacaaaaaccucauucc

SEQ ID NO: 26322 - RNA, 21 nt, Artificial Sequence
  RNA Oligomer
aaaaacaagaagacacacagc

SEQ ID NO: 26323 - RNA, 21 nt, Artificial Sequence
  RNA Oligomer
auuuauaaaagccaucauccc

SEQ ID NO: 26324 - RNA, 21 nt, Artificial Sequence
  RNA Oligomer
uuuucgaucaucuaugcauug

SEQ ID NO: 26325 - RNA, 21 nt, Artificial Sequence
  RNA Oligomer
auagaggaagaauuacaugcc

SEQ ID NO: 26326 - RNA, 21 nt, Artificial Sequence
  RNA Oligomer
ugaauagcucaagacuucugc

SEQ ID NO: 26327 - RNA, 21 nt, Artificial Sequence
  RNA Oligomer
uuuucuaguguuuugaguucc

SEQ ID NO: 26328 - RNA, 21 nt, Artificial Sequence
  RNA Oligomer
uaguguuuugaguuccuuucc

SEQ ID NO: 26329 - RNA, 21 nt, Artificial Sequence
  RNA Oligomer
ugauugauuuugagguuguug

SEQ ID NO: 26330 - RNA, 21 nt, Artificial Sequence
  RNA Oligomer
gaaaaaugccaaacucagugc

SEQ ID NO: 26331 - RNA, 21 nt, Artificial Sequence
  RNA Oligomer
auaaugaugaaucuucacacc

SEQ ID NO: 26332 - RNA, 21 nt, Artificial Sequence
  RNA Oligomer
uuauucagucuuuccuauacc

SEQ ID NO: 26333 - RNA, 21 nt, Artificial Sequence
  RNA Oligomer
uaaguuucccaaucuccaucg

SEQ ID NO: 26334 - RNA, 21 nt, Artificial Sequence
  RNA Oligomer
auucauaguaagaggaagugc

SEQ ID NO: 26335 - RNA, 21 nt, Artificial Sequence
  RNA Oligomer
uacucugcauuagauucugga

SEQ ID NO: 26336 - RNA, 21 nt, Artificial Sequence
  RNA Oligomer
gauugauuuugagguuguugc

SEQ ID NO: 26337 - RNA, 21 nt, Artificial Sequence
  RNA Oligomer
gaugucuaccaauauuuuucc

SEQ ID NO: 26338 - RNA, 21 nt, Artificial Sequence
  RNA Oligomer
guguguucuguguaccuuugc

SEQ ID NO: 26339 - RNA, 21 nt, Artificial Sequence
  RNA Oligomer
auauccuggauuguugauguu

SEQ ID NO: 26340 - RNA, 21 nt, Artificial Sequence
  RNA Oligomer
auccuggauuguugauguugu

SEQ ID NO: 26341 - RNA, 21 nt, Artificial Sequence
  RNA Oligomer
uauagaggaagaauuacaugc

SEQ ID NO: 26342 - RNA, 21 nt, Artificial Sequence
  RNA Oligomer
uucuauuggauuuugcaagac

SEQ ID NO: 26343 - RNA, 21 nt, Artificial Sequence
  RNA Oligomer
uaggacaaacuugaucaccag

SEQ ID NO: 26344 - RNA, 21 nt, Artificial Sequence
  RNA Oligomer
agugcaaggaaugauaagccc

SEQ ID NO: 26345 - RNA, 21 nt, Artificial Sequence
  RNA Oligomer
uguagaggacaugaaggaagg

SEQ ID NO: 26346 - RNA, 21 nt, Artificial Sequence
  RNA Oligomer
uacgauuuggaauggaaauag

SEQ ID NO: 26347 - RNA, 21 nt, Artificial Sequence
  RNA Oligomer
auuacgaacaauauccaucac

SEQ ID NO: 26348 - RNA, 21 nt, Artificial Sequence
  RNA Oligomer
uuaaguaaacuggaggaguca

(The sequence listing continues in the following parts.)

What is claimed is:

1. A double-stranded RNA compound having the following structure:

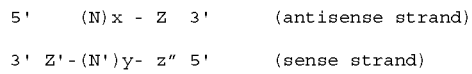

```
5'     (N)x - Z  3'         (antisense strand)

3' Z'-(N')y- z"  5'          (sense strand)
``` wherein each of N and N' is a modified or an unmodified ribonucleotide or is an unconventional moiety selected from the group consisting of a locked nucleic acid (LNA), a modified deoxyribonucleotide, an unmodified deoxyribonucleotide, a mirror nucleotide and a nucleotide joined to an adjacent nucleotide by a 2'-5' internucleotide phosphate bond;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent, but if present is a capping moiety covalently attached at the 5' terminus of (N')y;

wherein x=y=19;

wherein (N)x comprises at least five alternating 2'-O-methyl sugar modified ribonucleotides beginning at the 3' terminus and at least nine 2'-O-methyl sugar modified ribonucleotides in total, and each remaining N is an unmodified ribonucleotide or an unconventional moiety;

wherein in (N')y an unconventional moiety is present at one or more of positions 15, 16, 17 or 18;

an unconventional moiety may be present at one or more of positions 1, 2, 3 or 19; and an unmodified ribonucleotide is present at each remaining position;

wherein the sequence of (N)x is 5' AGGAGUUCCACA-UUCUGGC 3'(SEQ ID NO:140); and wherein the sequence of (N')y is 5' GCCAGAAUGUG-GAACUCCU 3' (SEQ ID NO:139);

or a pharmaceutical acceptable salt of such compound.

2. The double-stranded RNA compound according to claim 1, wherein at least one unconventional moiety in (N')y is a mirror nucleotide.

3. The double-stranded RNA compound according to claim 2, wherein the mirror nucleotide is present at position 17, position 18 or both positions 17 and 18.

4. The double-stranded RNA compound according to claim 1 or 3, wherein if an unconventional moiety is present at each of positions 1, 2, and 3 such unconventional moiety is LNA.

5. A composition comprising the double-stranded RNA compound according to claim 1, or a pharmaceutical acceptable salt of such compound; and a pharmaceutically acceptable carrier.

6. A method for treating a subject suffering from an ocular ischemic disease or condition, comprising administering to the subject the composition according to claim 5 in an amount effective to treat the subject.

7. The double-stranded RNA compound according to claim 1 or 3, wherein Z and Z' are absent.

8. The double-stranded RNA compound according to claim 1 or 3, wherein (N)x comprises 2'-O-methyl sugar modified ribonucleotides at positions 2, 4, 6, 8, 11, 13, 15, 17 and 19, and each remaining N is an unmodified ribonucleotide.

9. The double-stranded RNA compound according to claim 3, wherein the mirror nucleotide is present only at position 18.

10. The double-stranded RNA compound according to claim 1 or 3, wherein at least one of Z or Z' is present.

11. The double-stranded RNA compound according to claim 1 or 3, wherein (N)x comprises 2'-O-methyl sugar modified ribonucleotides at positions 1, 3, 5, 7, 9, 11, 13, 15, 17 and 19, and each remaining N is an unmodified ribonucleotide.

12. The double-stranded RNA compound according to claim 9, wherein the mirror nucleotide is L-DNA.

13. The double-stranded RNA compound according to claim 12, wherein the L-DNA is L-deoxycytidine.

14. The double-stranded RNA compound according to claim 1 or 13, wherein the covalent bond joining each consecutive N or N' is a phosphodiester bond.

15. The double-stranded RNA compound according to claim 3, wherein the mirror nucleotide is L-DNA.

16. The double-stranded RNA compound according to claim 1 or 13, wherein z" is present.

17. The double-stranded RNA compound according to claim 16, wherein z" is selected from the group consisting of an abasic ribose moiety, an abasic deoxyribose moiety, an inverted abasic ribose moiety, an inverted deoxyribose moiety, C6-amino-Pi and a mirror nucleotide.

18. The double-stranded RNA compound according to claim 17, wherein z" is an inverted abasic deoxyribose moiety.

19. The double-stranded RNA compound according to claim 1 or 13, wherein z" is absent.

20. The double-stranded RNA compound according to claim 1, having the following structure:

```
                                          (SEQ ID NO: 140)
5' AGGAGUUCCACAUUCUGGC 3'      (antisense strand)

(SEQ ID NO: 139)
3' UCCUCAAGGUGUAAGACCG-z" 5'   (sense strand)
``` wherein each of A, C, U and G is an unmodified ribonucleotide, a 2'-O-methyl sugar modified ribonucleotide or a mirror nucleotide;
wherein each of A, C, U and G is joined to the next A, C, U or G by a phosphodiester bond;
wherein z" is present and is an inverted abasic deoxyribose moiety; and
wherein the antisense strand comprises 2'-O-methyl sugar modified ribonucleotides at positions 2, 4, 6, 8, 11, 13, 15, 17 and 19.

21. The double-stranded RNA compound according to claim 1,
wherein the sense strand comprises an L-deoxycytidine mirror nucleotide at position 18 and each remaining ribonucleotide is an unmodified ribonucleotide.

22. A composition comprising the double-stranded RNA compound according to claim 20 or 21; and a pharmaceutically acceptable carrier.

23. A method for treating a subject suffering from acute renal failure (ARF), comprising administering to the subject the composition according to claim 22 in an amount effective to treat the subject.

24. A method for treating a subject suffering from an ocular ischemic condition, comprising administering to the subject the composition according to claim 22 in an amount effective to treat the subject.

25. The method according to claim 24, wherein the ocular ischemic condition is ischemic ocular neuropathy (ION) or anterior ischemic optic neuropathy (AION).

26. The method according to claim 6, wherein the ocular ischemic disease or condition is ischemic ocular neuropathy (ION) or anterior ischemic optic neuropathy (AION).

27. The double-stranded RNA compound according to claim 17, wherein z" is a C6-amino-Pi.

28. The double-stranded RNA compound according to claim 1, wherein no unconventional moiety is present in (N)x.

29. The double-stranded RNA compound according to claim 1, wherein in (N')y an unconventional moiety present at position 15, 16, 17 or 18 is a mirror nucleotide or a nucleotide joined to an adjacent nucleotide by a 2'-5' internucleotide phosphate bond.

30. The double-stranded RNA compound according to claim 29, wherein the unconventional moiety at position 15, 16, 17 or 18 is a mirror nucleotide.

31. The double-stranded RNA compound according to claim 29, wherein the unconventional moiety at position 15, 16, 17 or 18 is a nucleotide joined to an adjacent nucleotide by a 2'-5' internucleotide phosphate bond.

32. The double-stranded RNA compound according to claim 31, wherein the 2'-5' internucleotide phosphate bond is a 2'-5' phosphodiester bond.

33. The double-stranded RNA compound according to claim 1 or 3, wherein an unconventional moiety is present at each of positions 1, 2, 3 and 19 in (N')y.

34. The double-stranded RNA compound according to claim 1 or 3, wherein if one or more unconventional moiety is present at position 1, 2 or 3, such unconventional moiety is LNA.

* * * * *